United States Patent 10,174,376 (METHODS AND COMPOSITIONS FOR DIAGNOSING, PROGNOSING, AND TREATING ENDOMETRIOSIS) - sequence listing, part 4

SEQ ID NO: 68 - DNA, 683649 bp, Homo sapiens
  misc_feature (268289)..(368288): n is a, c, g, or t
actaagcagcggcagcttcctgcttcggatcctctctctgctgcttgcatttaaagagcaaactcgtcttgtctacccaccctccctcccccatcctccccaaaatagccttgtgatttcggaagtatggactaaaatcacactcctccttaccttaccgcttggactctggtggctcccaactcgccgtcagaccccacctgccccggtggtgggaagcgcctggacagaccatgaccacagccaaggagccaagcgcttcggggaaatccgtgcagcagcaggaacaggtaatgctgcttttgggggtccgtgtgtgtgtgtgtgcgtgcgtgtgcatgcgtgcatatgtgtgtgcatgagagagacagagacagagagggaggatatgtatttggggaagaattttgtattttgtattggtttatgactgtagccccctgagccaccaagctgggaggagacgtagagtgctgggtgctgctggagtctgcggctctcctctccctggcttctctctctaaagggcgccctggcttgatgattaaggtacaggcacagggaacctctgtcaaggtaaacttgatgtgaaacacctctggacaaaggcctctctctacagagccgccagatctaacgagttccctgggaaggttcccagctagtactttgtaacttgggggaagagggttgtagccagaaacatcagcgtattctgaccctccaacaggactttgctttggttctaagacaagtcaaagaaaatgagcttactgaaaggacttttctttggatacctcgtggccctttcctcctgtttccctcaagagcaaactgtccctgctagagaagccgaaggatagacggtcgggataaaggaggactcggccgagaaggtgcaggtttaaagggctgaccgcggacggggaaggctgcgtgggtcccacatggcacagggcggccgctcgccttgtcctgagaagaccacggtctgcagaggcccaaggggtgagggaggaaaggtgagtcagccagccgcttcaccacgcgtgtagacatcgtaattccctccttggaagatcttgagggttcttgtcttttaatcattgctcagttcacctcaggcagatcattaaaatagatcctgggagacaccaatagattcacaaagcagtttgctcaagcgtggtaaatcaacagcttaagctgacttctcctatttattttagggttgctgttggatctcatttgctaggattagggcaaagataggcgacctctttagagttcaggaagctgaagagcctccttgaggacactgtgtgacagaattccatgccaactcttcagagacttacacgaagatgagtttggatttgtatttagtggggtcatttcccaaagcccatttatcgataaaagggggccattttattagtaccatcattatcatcatctaaagaacttaaatgaagttttatgtcatctgggaagaagattctgtaaatacggacattaaaaatttttatattcagtgtgacagtgtgcataaggattgatgctcagtatagcttgacaggttcaaaacagacaaaccaaaccctcctcctttcaaaaattccacagaatatttgctcaataaagaaatatttccacactaaattagcattctgtaattaactgggtttctttttattacagttctcctccctcattagttatgaagtaagtgtgcgatgggctttcaggcttgaactaggactcaggtagcatccctgaccatgggagagaagtaataattacgaaagagtgcattgctgttcataggtctacacccgatacacccaaggattgggagtcagaagcccaatctgtgttatgtaaaagaaatcccttgtttcctgtacaaatttgctcttattttgcctgatacctgagcatgccaggagagtgggaatagttaattagggtgtgggttttggaggacctatgagctcttggtttgattttatacctttttgtcattggaaatcccatgtccttgaacctattcaatcggagaaggcttaaactgatataaaactgaagagcagaggcagccatggctacagcgagcaggtgggacacccagaagaagcagctgtcctcatcccatgcagttgtgaagccgctttttctccctcctcagagaggtgtcacctcaaccctaaaaaatgaacagcccccacccccaccatgaagtataatgaagaggggaacagcagagataagataagccagatgggacagggggtgaagaccccacatttcaagtgtatataccttgaggagaccttacctggggtctgaacacactgcttagaacataaagaggtaaataacctcctaaaataaaatccctaaagacagtctcttattcctgcattatatataattttgaaaggtattaaaactatgctgtgtgcttagactgcagaactcttaatgagttctccattctttattttattttattttcctggttgctaatgaaacttcagggatacctctattcccaggctggtaggcatgtgtagggagaccaggaaagaggaatatgtttctttttttttttttttaatttattttttgagtgagagagaggattgctgctttgtggattggttttgaagcagggggtcattaaactgtgctaactcaatgactgcctgcaaatcaccaagtgttgattcttatgagaaactcactggcacctcacatcctcatcttgtgaggcattaaccagagaactgggattgaatggagcctgatgccatctccgacatccttccagctgtttggttactgcaatagactacccattacttcttagcaagtgaacagaggaaagtgagtttctttaccagccttggtatttggaaaccaggcatatgggtggtgggtggaaataatttttgtgtgctgaggatggccacaaattaggggggaaattagaaaaaaaaaagattttactattagttagagattgttgttttttttctaccgtgtttgctaaaaaaaatgtgtaaaaagagtattttgggatttttggtttgttttttaaaggatactaaataaacaagccagagtaacaaggagaattggcttctgggagactatttctctttctctttggagatgctaaagtttatttttaaatgaagtattgcaaacccagagatgtttggaagcaatatatactttaatctgcatgaactgagttgatcctttggctctgaagccaatcaggtgatactgagactcctcggtgaaaatggctgagcattggctgcacctgacctctgctcctgcgcagagggaagcctggtgagggacccagaaaaaacactgaggcaagtctggcttaaatttactatattctcacaagccaacggagctcttccttagaaaaccaaattaagggattttttttcccttaaaataaataaaagtacaaatttattgtagtacatactgtctccatttcaaatgatttaaaattgaaaagcagtgatcagtaaagctattaagagaagacgaaaaattaattccctctgcttgcaatgagccaggacacatttttgctcaaatattaagcagggataagtttttcctagcatattgtgtgcatgtgtatgtatgtgtgtgcatgcgtatgcacacacaaacaaatgcacacacgtgaacagtcacacacaggcacacctcgtgtgtcacaaaatcagagttggaaaggaccccacacatgcactcgttggtcctagttcatgctctcgtgctgaggaatctcacaaatgtgtgagaatatgcctttcctcaaaagatctccagaaaaacctcctttcacatggaaatagcctacattccactggctaacttggatctttggttatatgttcagtcacatttttaacttccttagacctgaaaatcagctgttctcatcacaccttgtatatgtgactgctgttttttgttgcttctcagttttcttcaagttgtacaaatcctgatagataactccccatgtgtctgttcttctattaaattatgagccccaggacctagtattaacttaaatttggtgtctgaacatatataataatgccattacagaagaactttttgaaatgaatagaaatttttaaacaacagattccatagaacggacattgaaatgcatgtgaattctgggagaggttaggtggcctcccggaagggcacataggtaatggcccagtaagagaatttctgatgttcctgtccgctgctctctgattttgatcttgttgcttcttgcagtagatactgaaagagaggatctaactttgaccataatgagagttaaattttttatgtagccatattaaaaggcaatgtgagacatccgtatttaagataaatgtggtaacaggaaaaaaaagaagtgaaaagaacacagaaaaacaagattcaatattaggaagtgcacataactattgaggagtcccaatagggaaggtggtccttttgcagttcaaaaagggcatggggtggggttggtggccctttcacagttcacacggacattggatgtagcagccatgctcacgtacagtaaattccatctgtgcatggtctaaattatctaagactctgtagataaaaagaaaacttgaaggaactgctgaagaatagggacaccaggttcttaggattgtgtagaagtacatctgggactcatggacttccagagccgggagacaggatggagtttggctgcaaaataggctgatgtgtgaaggatttgaggagagaactgggaagtcttggatatcctacagagagcaggtccagaaccagagctccctactgggaacaccagagtgggtccttgagctgatggggagcagcatggagtctttggggaagggaaagagcttagctggtgtggtgctatcctcagaggagggatgttttgcttgttaccaaagagaacaacatgatgaggaagcaagcacgcaactagcctggaggcggcatgcgctgtgctctgagaactgacaggtagttcacaatcttttgggatccgtgtcaccaacttactaaaaagtgcaaatcagcaagtgccatttagcacatcaaatgaaagcccaggcaattgagagcaaggacaaatgatacccagattggcttttggtgcaacccaaactcaaaacaatggaaacagtgtttctgtttggttttgttttttaaaatgctttctctgtgcattaaatgcattttgttattttattctgacattccattaaaccaaatccagccccctcattctcaatactgtggttatcagggcagatatactcaaaaccttcaaatgctccatggagaacacgtgagggctggagggtgcttttcattaaccttcaccgaaacatcttagctccagcgtgcacgtggaaagtgttaagatgctaatcacttagaggaatgaacagcgtgcacgtggaaagtgttaagatgctaatcacttagaggaatgaacggtcaccgtctctgcctcatcgggaattgtagcgttattatcttttatggaaatgagctgtgcctgtgtttggcactcactgatctagttttgcagtaggcatcatgcaccctctgtcattgagaaagagagggcagagtgaatctgtggatccagagttctaaaacctgaggaagagtatataattcggggagaaagtgattctctataagctctgagaggtcaatggttgacatccttgcttgtaaaagatcggacaggtagggggtgtatcatcttgtttcagacactgtttggaaaaacaaaataaagtggttttatttgaagatgtaggcttggttaccccatagccttaaatcatggaagtaggtaaccatgtcaatttgcatggggagccgcgtgcagtggctcatacctgcagtctttgggaggccgacgagagaggattgcttgagtttaggagttcaacaccagcctgggcaacatggcgaagccccatgtctagaaaaaatagaaaaattatccaggcgtggtggtggcgcatgcctgttgtcccagttactcaggaggctgaggtaggaggatcacctgagcccagggaggtcaagtttgcagtgagccgtgatcacaccgctgaactctagcctgggcaatggagtgaaaccctgtctccacaaaaaaaaaaaagaaaaagaaaaagaaaatctgggtgggatgtaaattgcaatcctgtttgttggtgcaattctgcatgtggctgatatcctaaagtccttcctgactttgatagcatgtgtttcttgaagtggggagtggagaggtctcaacacacacagcccaggtagaatgatcaaatccagaaagtttattctctgtcctactcccatccccatttgttgttgacctttcaggactctttacttctacatcccgggtaggcccttaatctccactggtacccatggtttagcaccattttctcatacttgactcttctatcaaaaatgctccatgtgcttttccacctgggccttgctaaatgactgagacaaatccattcattaaacaaaaagtgtaaggtgggtgtcatgcagtactttcctgagagcatttgcaatttcaacagtagctattggtgataaaacccaatgcaattattaatggtggaaatttcaggcacaaagttgtggcaagacctgatggaagaaaaaatatttagtcacatcgttaaggaataatgaaggtgaggtcacagcggggacagtcttggcaccccttaaatcatcgacaggctgtgcacatcctggaggtatctgttcattctgtgttcacattagagctggtcttgtatcaggcaagtaccaaattacagatcctgttgctgctttctgctttcaaatcctgaaggatttgatagtaatagtgttgaaatgtgcagcgattccttcttaggaaaaactgccataatatgcacaggcatggagtcagtgctgtgggtcccctttgatcctggtggctgggatcctgaatgcagccctccaccaatggctttacaaagcacgttgctgatataatgaagtcttgctccgcaaatttttagtgacaatgtatgtaattattcctttactagtatctgatccatttttaagaaatttaacttcccctgccagaattcaagaaaaactgctttccccagtgtggaactgcacgagactcaagcgtcacctcgagctgctaagttattaatttggaacacaggcttttaaacaatatctgtatgtgcgcccatgtatgtgtgggcagagggggcgatgggagaccagccaaatctgctgattaaaatgggaacaccgtggtgatggcggggctctctcaaaacactttaaaaggccgaagtccatcttgtggacatgctcataagatttctcttggagacaatggtaattcattctcttaaaaaggattggttcaaccctttgagtaggctacccacagcaagatgtgagatcagaaccaaaaaatattcaaagcatattccatgttttgtcttttggaaataatatgtgacagaggtggtcttgaatagtaatgatatatgtttccaaattaatgaaaataagttatttctttattctctagcagtgattcttgaaattcttcattctttttagaatatttgaagttgttatagcattcactctaggaattccaaaattatgacactaagtatgtatctcaaatcaggcctctgagtgggaaagggaaggaaacatatttttaattttaatagtctgcctaatatcccatccacttattagacagatattggatccaaggaagatttttattttgataaacagtaatgggagagccaaggtagggggaaaggagagctggatgggaacagctcaaggtcaggagagagcagaacagtccacagccagggtgcctggacccaaggtgcagccagcggtctgctggagaaaggtggaatgtggctgcaggggcacacagagatggtttgggaaaacagaaacaggaactgtgatatgaaagtgttttgaaagcatacaatggaaaacagcaatgggcttgtaaagttctagaagggagggaggaagtctgaacgtggcacgagaggctcttgcttaagagaacaggtgtttgtggaataggtaaaaccagaggagtgacttggacatcaaaattttattttctgaatgtgattatttaatctaggcatgttttgataggtgaaaaaagggactagaaacttctggctttcaaagagcaaaaagagtttgttatttcacaaataaattcaagtttacctagaagcaacaagatattttaagatatggtatatatatatatatatatatatatatatacacacacacgcacgcacacacacacacacacacacacccttacatatatatgtagtacttcctggaatagcctgagaaagaaacatttaggaagactcaatataattattaatacaatttctggctctgattttgatgagccagatattttgatgttcattttgatgcagtctgccatgcctggaacaccaggtcatatggtacatatgacttggttaaagaagagattaaccaataagagaactttggcaggtaagaactattttgccattaaaaaccatgaagctgtaacaacgtctcaaaagctcccttggtgcattttattaattctttctgctcattactaggcttgggatgatgaagacctgacccttgacttgccaatagctaacttacgggggagttgggagaattgctgtgctttggcatggatgcccctgacttctgatccgagctcctccacctgctagctgagggatattggacagttctggactgattctgtatctatgaaatggggatgattcctgtcacgctgttgctgtaaaaaacaaaatatagaaacacggaatgctgttcttggcatggagatttcaaactattgttcagtgaacacctactatgtgctgacatcccaatgctacttgaatcttcttattttcagcatttggtcagagctcatgtcccatttttaagatgatttgttctacaaaatcatagaatgtttgacttttaaagcttcttatagcccctcttgcccagtgatttttggacttttgttttagtaacgtaaaccccttttccaaagggcacgtcttttccaagattggcatgtgaaggtggtgaacgtgctggcttagtgcccctgagacgtgtcagcagagccccagggcatgggggagcccagctcacaaaccacacatctaattcagcagtctaatcttgcacaggagtaaaaccaagctcagagaggttgagtaaattaccaaaatcatgcagctggcaagctgcaaattcagaacacaactccctccttttttttttcctccaaatcaagcaatcctgagtgaaacgtgggaaatataatatgccaagaagattaacacgaaaactgttaactggcagctgcaaaggaaataaaggaattagataatatgaatgggttaacaaattctcgcctggaggtcagttaagaaaaggtttgtgtcctccaggtaaatcaaacctactgcggtttttcctcttcacatctcatggacaaacacagccatttcttctttttattgcaccagtgctggatgcatgaggttgttcgtagcaatctgtcatatttgagtaattcgttatttaatgagttgcttttgaaacaaggaaaataatgaggatgttaccgttgtgtatctccccaatttttaaaaggaagcaacaaatagtaaattatgcatgctttggaagtatgcagtagttaattttcaatctcatcttacagctgaataacctcaaaggtagtagttatacaacaggtgtgggaatatgtgagtgtgagggagaggaatcccaggacatcacctgtacacattgggggtttggcccagcagggcttcagatgttgaaacatctggaaattttatttgctcacaagcttaaaatgaaccaaaagtatgttgcttattaacacttttgaggatctgatgaaagccataggactgcttgccagaaaaatccctacaattttttgagttcctaaggttcacattcccttcatttctgtctgtggactccaggttgagcgtctctgtggtcaccatggtccccagcaagctagcacagtcttaagacacatcagtaggaatgtactcagtgctcaaagcttacatagatattgaccagcagccatcacctctggggggctgtgctagggaggcacagcatgtagaagaggctggaatgggccagggagagtggtaagggagcaatgggtaggagatcccagaagtggtaggtaatggaccgtgatccatgtcaggtgattaaaggctaaaggaatatggttctgtcctcaaccacatggtggcctcagcctgggatacatgactgtgtcttcctccataggggtcagtttaactaagaaccccaagtattgaagacctcaagactttaatatggtacttcctgtaccttgacacacatatataagcttctgaaggacacaaaacatgccacgttacttgttgtatctctgacgccaagcacaatggtgacccacttgcttgtgtgctaaatgaatcagtgagtgaatgaattgtgtcctcctctctaaacctcctctactgagttatacacaaagttgagggtctgtggttttactatttattcatcgaatgaaccattgaacaaagtaatcaaattttcagagccctgtagagaaatcaaatctccctctgaattgctaactcaccttgctttccctattgtttaaagtgtcatagccactcttcctttcccaacactccaccctcacctgtcctacccaaaaacatttctctgctacagaagcatgaactattcactccagccaccagccatgcatcaacattcagtcttgctgtgattcatctccataagataagtgaatattctctcatttaccaactgtatagataagaaaaccatcagaaatcaaagaactgttgaaaaatgggcattttacatcaccaaagcccttttttgttgttgaaacagaagcttcaagtcttctccatccactgaaatgagttgttgaagtggaaaagtaagttctaattgaaccaccttctccgatgcagagaaaaagcagacttgaacaattgggttgatcttctatttctcaggttggagaagtgctttgaggaaagaaagatggggaatcaagatcagaggaatgcaaagttctggaatgtttgcctcagttgccctctactgggtctggcttggggaagtttgtagaactttttaatgagtcattgtaggttcaggagagatttcagatgtgggggacagggtgaaatgctttcttacacagaagtgaatgagttagtgaaactgtagcacgtacagtttgggagaatgggggcaatggggggattgtggtacgggagaaggagcaccagcctgggattcagacaggtctgagtttaaattccagctctggcacttgctaggtaggcagcgttggacaagttgggtaacctcagtttccaccttgagcaagtgcttgactaataacagctgtgactgttaccagtatggtaattacagtatcccaaggtgtaaagaagcagaagcatgattatatgagttgggtcaaagatttggctgtctccctgtccccccaccaatctggctacagggcagactttgctaaatagacacagatttacttccaatgaagtgggtttgctgcactgaataaagtagtttacttttccttcactgcagctgtgcttgaaattggacagaaagccaggtgtggtggctcacgcctgtaatcacagcactttgggaggctgaggcgggcggatcatgaggtcaggagattgagaccatcctggctaacatggtgaatccagcctgggcgacagagcatgactctgtctcaaaataaataaataataataaattggacagaaaataagatagagttgtagcaattagtctgcagtttttgactttattaaattcacttagacatgtggctgcaccattatgctaaggtacctgaggctctactatggtgtattcattgtcgaaaatgtgtttgcgatgtagatacttctttcacctagttctatagtgatactattgggaatctgaagttgtcaagcagctagtgtatataattgcatgtaaaatagactgtattttgtacttattgaaatctaatggtgatacttggttttagattactgaatgtagattctgaagaattatggccccagtaatgaatggatgtgtaattagaatttttatcattattctgtaacatctctgctgaaaatttcaggtttatataattgttttggcttggcttgaaacacaaattatacttaaagtaacagacagtaattgagaaaattatacttaaaggaacagacagtaattgaatccaataaaaacaccaaagaagatcaagattgctgtgagtggagagtctggcttgtatattttgcgaacctcatggcttgaatgacatattctcaacaaatgcatgccaagtaaagaaaatactgactttatgtttttgattcaaatattcatttcatgaaactccaaataacttttagtgatatggtagtttatgtgttgatccagtgttttaaattttaacaatatacagagaattcctaattacactggagattttgaaattttcaaaaaataaaattttgtataagctttaccctgtgagggaatcctcacttctggtctcaaatcagctagtgttgggcattgaaaatattcacagagattatgtattaattatatagttgtacttagaaatgtatatgagagttgttaatgacataggactcaatattcgtctccctcgttctcactctttgtatgcttaggaatgccaattacttcctcacattatcctgtaaagaggtataatcgatttagagataatgagagtgacctagggaaaaagttattaagccacaaatcaattacaccctatcaaccacaccctcacttgctctccccacctctcttccagcccccaaataccaagaccaaaagcttggaatcacttcatggaaagtcctttgaaaatgatttgtacactgataaaacttcttggaaacataaatcccttgactgatacttgttgagcaagttaaagatgtcccagttcacacctattgcaacagaaccagaaatcactgaaagaggctaagttgtacccgtaagtttggaatgcagagctgggtttctgtcctttgttattcaggatgtatttctttctttcttgggctcagtaagtagagtgtagtaacagtgtaatagcatttgtgttcccaccttcccacactataccccaccccccccaagccatggcatgagcttatatgttagagaaaaaagaaacagcttcggagaacctggccattcgagggccatgctgtctggtagcttctgtgttggcagtgaggatcattgatgtgggtgatgggcttatgcccaggcatgtgtgttcttcatccagcctaccctcctctgcggttctggtttagagtgtgttggtttggggcagtgtgatgatctttatgtggcccccagggccagcagcaggaggtgtctgccatgtcaggggagagtaatgaagtctggacaccatggaatgcctgtgtgcagcctctctgcgcttgtcctcatgaacttctccaacagtcttactgatttttttacaacaaaaattatacctaatgattatctatttcatgtacaaacacaaagaccattttactgttaggattgaaataaaactttttttgtcttcaaattgttttgctctaacacaggcgagatttttatttttaaagacaaggttaaaactctttttctctgcataatttcagtgtctagaatagagtaacagtcctgctttatatttgtataacgcttagcaccagtgctaacaaaatgcaacatgagactgggcatggtgattcatgcctgtaatcccagcactttgggaggccgaggcgggtggattgcctgaggtcaggagttcaagaccagcctggccaacatggtgaaaccccatctctactaaaaatacaaaaaattgctcaggtgtggtggcgggtgcctgtaatcccagctactcaggaggctgacatgggagaatcgcttgaacccaggaggcggaggttgtagtgagctgagattggaccactgcacttcagcctgggcaataggagtgagactttgtctcaaaaaatatgcaacatgccgggtgcagtggctcacgcctgtagtcccagcactttgggatgctgaggtgggcagatcacgaggtcaggagatcgagaccatcctggccaacatggcgaaaccctgtctctactaacaatacaaaaattagctgggcatggtggtgggtgcctgtaatcccagctacacaggaggctgaggcaggagaattgcttgaacccaggaggcggaggttgcggtgagccgagatcacaccactgtactccagcctgggtgacagagcaagactctgtctcaaatatttcaaatatatatatatatatatatatatatatatgcaacatgaactactatgtaatttaaaaattttactagccacctttaaaaattaagaagaaacagatggaaatgattttaccatgtattttatttaatctaatatctcaaaaatctattattccaacatagaagcaatataaaaattgttaatgaaatattttacgtttgttttttccactccgagtctttggaatggcatgtgtgctttacactgacggtgcctctcacttcaggccggccctgtgtccagtgcggtctccataaaggactctggtgtccagaagttcccatggccgctccattccgtacttggttttcacaaaaactgtctcctaccttctaatgtcctcaattctacaggaaaatgagaatcatctccagacagtagaaactgtatccataatccatattatgaagagataaaatagccaattgtactttgtttttttttttgttgttgtttttcttgagacagaattttcctctgttgcccaggtcggagtgcagcagtgcgatctcggctcacagcaacccctgccttccagggtttaagcgatccttctgcctcagcctccctagtagctgggaccacaggcatgtgccaccatggccagctaattttttgtacttttagtaaagacagggtttcaccatgttggccaggctggtctcgaactcctggcctcaggtgatccgcctgcctcaacctcccaacgtgctgggattacaggcgtgagccactgtgcccggcccctattgtacttctgtttgaacttatattggcaaatgtagtaattttctagagttttagaggaggtagtgtttattattataaatatttgctgagaactttctgagcaaagggtactatttattctatataaatatgtactgagcatctgctagttatttaacagacttctaggcacaaaggatccaatggaaaaaataagaatattcatatttaacagcttctttgtgctctaggcattgattattctctgcattgatagaatttacacttgcagctttcaccaaagaaaatgttccacagtttaggcagcatggcaaaaatccatctctacaaaaaaataccaaaattagcaggtggtgcatgcctgtagtcccagctactcaagaggctgaggtgggaggatcgcttaagcccaaaagatcgaggctgcagtgagctgtgattgtgccactgtgctctagcctaggtgacagagccagaccctgtctttaaaaaaaaaaaaagaaaaaatgctataattttacaaaacctgctctccatgtatccctctctactctccttaagatgaacactgggtctggggtgcaggggtgccacagctggagttgaagaggaagttaggagaaggctaggaaccatcacggagatttttcaccctggttccttcattattacttgttggggatcagtgaagattagaaattgatgatggcggccaggcgcggtcgctcacgtctgtaatcccagcacctttgggaggctgaggcgggcggatcacaaggtcaggagttcaagaacagcctagccaatatggtgaaaccccgtctctactaaaaatacaaaaaaaattagccgggcatagtggcgggtgcctgtaatcccagctacacaggaggctgaggcaggaggatcgcttgaacccagaaggcggaggttgcagtgagctaagattgcgccactgcactccagcctgggtgacagagcaagactctgtctcaaaaaaaaaaaaaaaaaaaaagaggaagaaattgaacatggctttacagaggagcttctcttccctgcaggtagcggccttagacccttgtctaaggcaaaagtgggatttagggaaagatactgtggtagctgacacagaattgcaaaaggctgaaaacccccgccagcgaagggcagcagctgctcccctcctgtgggcactctattgccctcatagagagaaggcatctcccagcactttctacaaccacacccccaacccccaacccccaacccccagcttagttctctagaagagcagaccctcaccctcccccacctcctcagcccagcctggaaaggcccacggaaggactctgccagccctggctaaagttatgtgtccacctctagagcagccacctggcctggggacgaagcagtatgagcccacattctgagttgtaaaaccccacaattaggaaatagacttaaagtgctcccatcacattaggatgcaatgtgcatttttgtttgtagaagcttgttctccatttcttcttatttgggcaaaataagctcagtttgactaactctgccatctctaacccagaccccaccatgctctgacactttgacaagcacactggatgggcaaaagagtcaactaccgaaggaagacaattttcgtttggtctaaaactttatacctgtgatattctgtgccatggagagactcgtgcttaataattcactttccaatgatcttaggcaatgtagaagattacaaatactgtgagacctgaactcctccttcagggaacttaacagttttcagtggcgggggaaataagagtagattcctgaaaccatagcagcatccgatagaacagaacatttcctcgactctagcaaatctcttaattccaggtgtactcgggaagatagtagcatttattgggtatatactatgaagagagaagtgtcatatcctgagagggggtttataggcagtaaacattgtagtctttgccttcaaggtgtttgaaacataaaacatgctcacattagctaaatatgcctgcttcaatgcctgtacttatatcacacaaccgacgttatcaacctggtttcaaacgccatgagcaaaaatcaaatcaggtaatgtgtgtgaaagttcattatgactgtaccaccatacaaaccgagatggtattactccagtcagaccttctgttttatagtgtgttccagaagctggcctggttgcagaagagagtgagctcattagccctgttcaaaaaaaaaaataaatggaataataaagaaacttcaaaaccaaatgaaataccattccatgcacatcttggaaaagtttataacgtatttaaacatgaagagctattgtaagcttgacaataaaactgtgaggatattgttcatttccgagattcacttttccaagatagctctatcgtgaaagtctcttttggagtttatgtatagttctttaaattggcacagttggcttaaagctaaaacactgtagtttgcattaaaaaagaaaaaaaaaaagcaagtgcttttgcacaaaaggctgtaagaaatgagggctgcatatgaagcgagtgttccgttgactgtgtgagtgtgagatccttttggctttagtcatttatttggggcaagctccgaccttgatgacagatgatttcgtcaagctctccacaaaaggtacatgtctattttcatcgtcaactaacttctgtggagcacttgctgcttttggtcccctaaccatgaggttttattgacccatttgccatctctggggtaagtggatggaatcatctttcttgagaggagaactccaggaataatattacacttgtctctgagccatttgagcttgctatttttacagatttcagccttagttccttttcctcttcctctgtcaccctcagaacactgggacaagggggagccatgctgtttcataaacttcccatagaggttctgagtctcctttttagctgattcccatgagtttgtaatattttgatctgagctggttgcagtttgaaataaataaaagcaatctgatttcattctagccaacatctgatgggtttgatatggatgaaagctaatgagaggtacaagtgagacagtacaggtgaaaactacaaaatctctcttgtaaaatacacatatacgcagacccatattttccaatgacacttaaaaggagtgataccaagaggaaacactgagtcccatgaaacatttcttcaatcaggacagaaccatgagcagaggacatagtgggtggggttcgtggaaaaatagaatatatatctaattttctgtttgatgatggtctacggattgatttaattatgattactacagtaacttgcctagtacttcctgttcacggttgccttttacatgcacagcaggttgcttggggagctgatgtctgctcctagcctttctgctccggtaccctttgttctgttccattatgtttcagataatttaatcaaagttgtgtttgcttgtgcgctcccccctttgaatcattctcactgcacttctgccccttccatgcagatgcaggctgatgccggatgggtctccactggcctcttctctggacttctctggggcccgtatcagaacccaaaacctagcctcagcttgacttcttcctcttaccacggggtgaccccggtgtgatctcccctcccaggttccatccagcatgaccgccgggtctccctctgccctacttgattgcactcaccttttgttaccagtccaggcagcaggctccatgtctgggttgggggtgtttcctggcctgacggggcaccttgttcgtttcacccaggcaggaaatcacgtcttgtttcaacatcctgaatcttgtcctgacgtggaaaccgtgatgctagctgacctgacctgcagcctcaggcatccctcggccctttcatggcctggtgtttatgtggtccgtcctcacaaactcttaggatgggatttattgtctccattttcttttctttctttctttcttctttccttttgttattttttttttttttttgagtcttgctctgttgcccctggatggagtgcaatggcaccatcttggctcactgcaacctctgcctcctgggttgaagcggttctcctgcctcactcagcctcccgagtagctgggactacagatgtgtaccaccatgcttggctaatttttttatatttttagtagagacaaggttttaccatattagccaggctggtctcgaattcctgacctcaagtgattctcccaccttggcctcccaaaatgctgggattacagatatgagccaccgtgcctggcctacagtctccattttctataggaaatgaaagcttagtgagagaaggtgcccagacccccaatggctgcgaatcggcagagttgggccccagtgggtctcctcactccatcccccttgtaccacccagtgtctcaccagccattctgctcagatgggatgtagggcctatatagcaaatagaagttttctgggaaccccttaatgacaaaaaatacttgctttccagagtattcatggcaggccttgataatcttgagcctcaagtgcccacaattccttctgggactgactttaaacctttatttcaaatacaagctgggtcttcattattctttgttgcaatggatctctttacacgttaccctcagaaccacaaattagcaagagtctagctggaatctctcctgtgatggaaatttcattccctaagaaatagagcaacctttcttaattaggcatttactctaatgattcagaaagttggttctttatttttgctttattttcattagaaactaaagatttggatggtgttttcataatctattgagaactgcaccaagactgtcagtattcaatacatatgattaataatcagagggaagacacttatattttctgtcatacacacatacctaaatgtttaggccaagggcacatttttaattgattcaaatagcaaatataaattgtgcctctctgttacctgaatgtcttacttttttggaggttttgttgtcaggaactgccatataagaggcatgcatcattttaattgaatcttaaacctgacacttttattgaccaaaaaaaaggatttcaagttatttttcatgcataaagcctgcatgaagcctgtacttctttagtgaaggctatctcagatatgtatgaccttacctccttgcctttaggaaaaattaaacctcactgtctgagatccttgagatttggcaaatgttgatcaattaactcttcaaagacttatgatgaaataactgtaggcaataaaacatactgaaatatgtccaaatgaccagcacagcaaaatatgcatgaccctgtgcctaaggtctgtggcatacaagccttgggttctgtttatggggatgtcaccttctatgactcaggtccctgtctagaaacatgatatggccacgtcttggtggttccttatttatgcggtcgagtcttttgtattcttaagtcatctctggaggataaaagtcagagctcaaagtctatatatactgtcacaaaacaaggatgcagatataatgatgataaaattgaacctatgatttaagaaatgcgatatgaatatgatatgacaactctacctgccaccagtggactaatttcccttgttgccaggggagacctcatcctcatcctaatttacacagtgttgtatgtttgtcaagaatgcataattctgccagtctgttgtatttctaattttagcctgtatacatagaaacactttaaaacatttgcaggctactgcaatcatcgtcatacaatctgtatagttgttacatagaaataatatcagttggtttccccataataattttttctagagagctagctgttcaatgctaattcatatcctttcttaaggtatatggcaagtaaaatggatttcctcggggcctggaaggaattcctgttcaatgattggaacatttaaaagatttcctcttgatttcctacaaggaaggaataggaaagggaggtgattggtcttgttagcctggaaatagtattcactgggtcgctagagggtgggcagagagggacgcaaaaaggcgtgtgtcagagttcctgtctccggggaggtcacaggatcgttagacagataagagagacgcctgtgtctaggtgtctttggttcagtcctaatgttctgcttggtgtctggttcccacaggtcatttggggggtctgaatggtgatggatacctctcagagaaaaaaaagatttaggcttccaggcaaagtggagaatgaagagtaaagacttggaatgatgggtggcaggataaaatagaagaatcattagttattagaattattagggtaaaaagccgtgttaagtgctttgtaggtaggaggaccgtatatcccaatttgcttaggccagtcctggtttatggcaattgccctgacttgagttttagtaacattcccttttattctcaatagcgtcccagtttgggcaataagtcatatggtcaacatatatattgatgaagaattaggatcttaatataggaacagattgcgagtgaagataaaggtaaaatcaattttgaagtccccttatactacaccgtaatttgatatctatatcaatctctaattttacttgaggagtagtgttgacctcatgtcttagaagaaaaaaatgaaggtaaaaaaataataaaattttgcttaggccgttgtgaaatttcctttcaaagacggaactagaatttagaactcaaaaacctcatttcctatactaacccccaccctacattgccggggaaaatggaaaaagcaaaagaaataatgggatataaaaatgtatgggacacattctttcctctattatgagcttgtctcttaattaccaccatttatactggacatgtgatttgggtttccagaatagtaaaaacacagatattataagccctgtgatcatttgcaaagaaatctcatttgcccaggctattacatttctgttctgccttcagtggaaatacacatagaatggaatagaaatatgcattactatgagtaattccagacaccttaatgcttttagcgggagtgcatttggagtttgtttcctgagacccctctggtggaggtggttgttattcatgcttgctggaacagtcctccccacgtctgtgagctcaagcaggtcctggcctcagaaccacagaactccaatagccagagactaaaagaaaagggaaaaatggtttgctcggatccctgggttgcttggcccacaccctgagtgtaatatgtgatcagggttagaaagcaagtggtgggagcaggtcttgcttctgtgggcatggcctcctagagaaatagtccagcgctggaggcacagagaggggaggacaggcattccaaggctcttgaagaactgaaatctggaatcgacatgaagctacatcccgaagcagggaagtaacgacgggcctggaagggattcctgttcaattagtggaatatttacagaagtgttgttttgaagatgaatttatggatgatgttcatgtaaagtgagatagaatgaggggacagacagggatagggaagcaattaatttgccatagatgtgggtctgaaaataatctttactggcttgcctggtgttgtctaaagtagcaggggaagctttgagaatcctattgatttcaggttactatccaggaactataaaatattaaagcagaaaggagacttagtgatcattaaattcattctgaaatgagaaaaatcaagcccacagaaatggagggtttacttaatggagggtgtacatggtattaggggcaggaaccaggtctagaacacacccactggctccttgtcattaaccccgttgccctggagagaagagaagccggtggtcacactttgacagacacagtgtgggtgatgccagagccaaaaccttgggaagggaactgtgtggcttcatggacatgaccagatccacagtcatccactgggttactgtcttcccagttctcatcagccagggttgtttagaaacattgaaaaatgttgctaactgtggatagctctgtaagtagggttttccatctttctaacacttattacatttttttattcctggaacaattttgaatgagaagtggaaaccatggttttagccctacttatctcttaaggaagaatagattggaacagtacaggtgttttgcttaagtttgtggatttacttaaatattccctatgaaagctccggtgtacacatttattttattcatgatttcaacaaagctttactgtgcaccacatacagtccagcatggtcccatagagctttcagcaatggtggaattgtgttgcatccgcactggccagcgttgcagccactagccacatgttgctgtcgcagtcttaaaatgtggctggtgatcagggacgatgagcttttctcatatatctgttggctgcataaatgtcttcttttgcgaagtgtctgttcatatccgtcacccactttttgattggcttatttgttattagagaaatgcaagtgaaaaccacaaggagatactatctcacgccagttagaatggcgatcattaaaaagtcaggacacaacagatgctggagaggatgtggagaaataggaacgctttcacactgttggggggagtgtaaattagtttaatcatggaagacagtgtggtgattcctcaagggcctagaaccagaaataccatttgacccagcaatcccattactgggtatatacccaaaggattataaatcattctataaggacacttgcacacatatgtttcttgcagcactatttacaataacaaagacttggaaccaacccaaatgcccatcaatgatagactgaataaagaaaatgtggcacatatacaccatggaatactatgcagccataaaaaagaatgagttcatgtcctttgcagagaaatggatgaagctggaaaccatcattctcagcaaactaacacaggaacagaaaaccaaacactgcatgttctcactcacaagcgggagttgaacaatgagaacacatggacgacacagggaggggaacatcacacactggggcctgtcgggcggtggaggggaaggggagggagaccattaggacaaatacctaatgcatgcagggcttaaaacctagatgatgggttgataggtgcagcaaaccaccatggcacatgtatacctatgtaacaaacctgcacgttgtgcacatgtatcccagaacttaaagtaaaaatttttaaacatgtggctggtgactgagagatgcaattcttaactgtagttagttctaattaattgaaattgagatcaccacagatggcagaggctttcatgtcagtttcagactctggtattgggtcgagggagaaaagaaaaaagacaagtcatgatctctgaggacaaggtattcacagccgagagtggcagggatgaggagagacaggtaaacaattgtcacactggagtgtggccagttatgtcactgtgggaataaggtcctgtgagagcacggaaaagatgagcgtgatatgattcctctttggggcgggcaagcatcagggcagtttgacaaagagcagatgttcctgtctttacgaacggactgagaccgctccagacatctgagatgaacatgaagagaaaggaattttcaacaatggagcaaacatacattctcagcagtgtaaagagcagagcgccagaggcaaccgtgtacttctggtgtacttctgcgtgcacgttggtgtacacaccctctggggaggtgaactagcaggcagcttggcaagaagtcgcctgcggtgttctgcgtctcagcccttgttcaccatagtgctctgtgtgaagttggacaaatgcatctacctttctggacttcagtctcctctccactccccgaaggcagggcagagcagctgtatgactccttctcagatctgggcttagtccttacaagcttctgttgcattctccagctcctgcagtggccttccctcaagacaatgagaagcttcttggcctcctctttaacactgggtgctatttaatgagggcacctcaagatcctcccagttaccacgattgctggtggcagtcatctcccctccgacaacagttttgtgctctgagtgcctgtgctgtttccacatttttttctccccctcaggtattttagaccccaaagatacatgggtactctagggatactgtgtaaagactgggtagtatttggaactggcagccagagagacgacattggcaattcattcatctatcattacctcaattggcagtgttctcagtacgcagggactgtctctgtgtggctttttgtgagagggatgtaagatttatttttctctatgacctacctgctggcatggtacaaaaggtctctgccgaggtctgagggacctcacttgagctgcactaatagacggggggataactggtagaccaggagagtgtagacaggaagaaagaactcacctttgtaaatgagccactcaggcttttgattttgtggcccttgaattcccacttcagctgatggtcacactcatctgtggggaagctaattttacaagaaatggaacaggagggggttgctgttggatcaagaagatgcagctttggaaggtatccacgagggaatagccatcaatttgccacgtgtgtgagctctaccatcccgcagcacatgggagcgtgctgtgctgtgcctgtgtgctctcaaggtagacgaggtgtcactatatggtcatccacacagcaggtgtggccaaatatagagatctcgtgaaaaactaatagcctgccaaagaatacagccactttttcagggtcgtaaaaacactctgtgactttcccaaaatacagttactatacatgcactagcaaatcccaggatgttctcttcttatggtgcacatagctaaatacccacctgtggaatgtgggtttatttgggaagaagctaatcctattaggagtttcatattctcaccaatttgggtgatggggtctgtgaccaaagatcatagaaagtaagaaatacaggactcaaaaatgtgttcttcattatgtcttcacctcgtgctttttaaacttttttttttttttttgagacagagtctcactctgtcactcaggctggagtgcagtggtgcaatcccagctcactgcaacctccgtctcctgggttcaagtgattctcctgcctcagcttcctgagtagctgggattacaggcacatgccaccacgcccggctaatttgtgtatttttagtagggacagggtttcaccatgttggccaggctggtctcaaactcctggcctcaggtgatccacccgcctcagcctcccaaagtgctgggattacaagcgtgagccaccacacccggccatggttttcaaactttaatgtgcatggaaattactggaagtgtttgttaaagtacagatgctgcttcagctggttgggcataggtcctgagatcccgcgtctctcacgggctcccaggccatgcagttgatgttggtccatggatgaccctctgggtagcaacgtttggggtctttgtgtgtccacacatggtgtgtctgtccattaggaggaaagtgccagcgcatttgccaaagcgtttagataggagcctgttagagtttgaagttccaggaccaaggaaatctggtaaataaaggacagttgtttgttcatggatctaggtttataaagtgtgtatacattttgagattctgtctcccccctccaaccttaaaattagcaaaatgtagtctttctttgtcgagctctaggaataatttttctgcgtcagatgcatttttgggaaggtgcgtttggccatttcccactcaccgtgcccgcccagtatccctgcagtactttggaagcaccataattgggaaagagtagaaagttcttgccttggaaatgagattcttatctgggtcttgggcactggaggatctcaggcgcgggaggctcgcgatgggtccggggaacagctgctgtgttcctgtaggaggaaatgcctgtgatggaggcttctaaagccagctcccgtctcagagaagacagctctatgcctccacgtcgtgatagcaaatgttcccttttggctgttttaatagttctgcttcaagcgtatttgtttttccttatttcctagcatctttgagaaagatctgttctatactctgtagcccagtttggagagatatgacatgtttgactatgtgaggaaatatacatatttctcagggcttttttttttaaattgagtgttattggactttgatgtttgatttccaggcagtctttaatgtgaaaggcaaacacattcattttctatcagttcctgaaaatgttcccaattttagaagctctagactggtcttgccaatatagcaacatagtgacagttactcgtctgtaattctgtacttaaatcgtgaactgctagcactatcgattaatgctttatacagtttcaaagctgtactcccaggctgcatttagatggtttaaagcattgatttctctctctgacaactcttaagttattggctgccaaaaaaatgaggaaaggttggttaatctccatggctcatatgttgcttgctgtagagaatattggtgaagcatagtttttcttcattgtaagatgcactagggatgtgaagactgttttgaatcattgtgaaaactggaatcagaaaaacaatctcctcattcaattcaagaattcgagatccaaaacaacattcagtttggtatttggcagtttaaccaatatctgactttatgtaattttaattattggggtcagccattggtattgcattataatttgtaatgatttatatcagccttttaaaaatgctcacagtcatggacaaaactggaaaaaatgaggaagtaacccaatccaaattacttaatatcatctgctgtaattagaaattagattttagtagactgtttccataatacatttcagaattatttttataacttaatagtataaatacaaaataatttcagctttgttattttattatgtgctgtgctagtttaaattattccggttataggtgtatcatcaacaccttatcttcagcaaggattttaaatatgggctgaccaaatttatgtggaatttgcattttgttattcgtttaaaaacatacagaaaatggaaaaaaaaaaaaaaacctttgcaaagattctcttttgagtgctagcttttcctgatccctaaggatgccggctgctctgccaggaatgtgcccttcatattatatcttctagaatgaatgtttggaagggaaagcagtaagatgcaaaagcaagaaggacagatgatgttcatactcacagtaatagctgtctcccctcttatcagttgtgatgctggaacaaacacctctttcctgactgcagggtttggaggtccccaagtccaccctcacttctgccatcaatggcaagcggcactggctgcgtggaaaagccaagatgcctttcaccataccatgtctggagtctagttgctgctcaataaaccctggtggcgatcactctcgagattcagtaacattatccagaatttaaaaaaaatacaagcctgggcacagtggctcacgcctgtaatcccagcactttgggaggccgcggtggcagatcacttgaggtcagaagttcgagatcagtctggctaacatagtgaaaccccatctctactaaaaatacaaaaaatagccaggcatggtggcacgcacctgtagtcccagctactcaggaggctgaggtgggcgaatcgcttgaagctggtaggcagaggttacagtgagccaagattgtaccactgcactcagacctgagcaacagaggaagactctgtctcaaaagaaaaggaacagaaaaaaaaaatacaacaatgtgtggtccttgtattcaagccaagcttatttctgcctcaaagcattgtgccaagtttgtatgttacttcaggtttcataagccagcagatcctcttcctgggactgaaatgatgatttcagttttttcaatgcttaagcgtggaaaacaggcaggtaatttgtgacccataagggaggggtgagaaccacatgaagatgaaggtggtggaaaggagcagctgatgtcacgcactgtctacttaacattgccacgttaatgttaatgccggttatagaaagcaatgggtaattgccatatttttgttacggcttattgcagtgaatgcaggatgcttctcacatctcttacacatcaagtaagagtatttcttaaaaaacaaaacaaaacaaaacaaaacaaactctcaatgccacatatacctgaattgtgagtacttatttcacctaacaaatacctaacaaatattgatattttgccacttatgggttgtataaatgaccattaatatgatttgtcaggcacagtacacacaactaacctataaacaatgtgcagacgtaggtcataaactgtgacactcgaaatccaagtagtgcccctggtgggagatgtttcacatgttaataagcaattaccgtagtagattaagagtacagaatcaatccaagaagccaataatttagagttggatactgtagcacaagattgcaggaacctgagtgctgtgtgccacgctgcacatcagaggttgcaagatgtcctgcaatgcaggctcaggaaagtgactgatgcgctgtgttctaatgtggaattctacaggtattcgtggaaaaacatcaatacattagcaaaacctggaccgtttctggtgttgctggtgctgcatgggatgagtctgtggggcactccatgggatatatttaaagaggtgttattttgtctcaagcggctagggcggagatagagcatgctatttgccacattgcattctaggggttgcaagacatcctgaaatgtgggctccatgaaagcggttcatgctgtgatctgtacccccagatctcttcccaggcaggtctcatccaccaccagaaatggtccatgttttactactgtattgatgtttttccacaaatacctgtagaaatccatattagaacacagggcgtcagtcactttcctgagcctgcattccaggacatcttgcagcctctgaaatgcagcgtggcacacagcactcaggttcctgcaatcagcatgcccacatggtcataatacagacttagcaacctggaaggaagtctcagtgatctgtgacccagccctttctcctgatagaccgtggaactgcaggcagaagatgcacggcgtctcatctcagatacacagtggtggtgccgggatggtatgtgctctccattctccctggagggctcttggtccatcttgcttcagtgactagcatgagaggagtggtgatagcagcaggtgccgtggccactgggcaggcggggtatggagaacgcagccacacggccgccactcctgctatggaggcaccaggtcccgcaacactggtaccataggacagggcttcctggtatcacaggatttgccagagctggaacgtaacgcccacttcacaccttggagtatgattcaaagtagagtttgtagtgaattccaaaaggcatgtgattcaagctaactgccaagaccattcagagttgtggggagaaaaccccactgtgggcacgtgagtcagggaagcagcatggaagcggcttgggtaggattgtggcaactggaagggagttgggcgggccatggttacagatgcgggaagtggtcggagtggggaagaggacctgtctgattcccaggaagtgggcaggctccatgcagagcaggatcccccgtggagcctacacagccttgcacacctgaactgaggggcaacgaagaaggggtctttgtagttcccttggttaggcaagtcaccagctggaagtggcagccgagacccggcagggacaaccctgtctttcccagtgagcatctgatgatattatccggggcccgagcagctagggtagaaaaggagaagcatttaaacatcagtgcctcaaatctcctttccaaacatcccaggtatagaaagttacatcactcttgcaatttggttcatcaattgtcctcactgcaaagttgaacctaaactaactcctgttgggaggcagactagggacaagtgactttcagtgatgctgaactgtgaggctgaggcactggccatactgcctcccaaatggaaccctcgtttgtgcaaatgcccccggccagggtggtacccacacacatctgcacatgactttctcagtctcctcctaaattatccctattctttttgaaaacataaaattaacccaggtggaagtttgtgttgtaaaacatggagtagttttcaatattgtaataggctcttcaagaagagcagcatttgcccacaatctgaatttttagaaaacgtctaaaatctcgagttatcagcaggacgatatccacacagtagatacatccctaccggactcagtggcaaattatgacacaggccaaggtctatccttgcaccatctgtcatttctgagtcttcaaagagctcagagatgtcctctgtgtgcctccttacccaggcaggcagcctaaactcccagggttcttcccaggcagatctcagccatcctgggctcaggaaggcattccaggaaaccagaacgcaagggataaaagatggaggaagtcacctcttttagcagagtttgcactttgatgagaatgaaggctcacgcccagggagaaggtggataagagagacgtttaagcaccagctctaaggtagttgcagtttgctgggctgatttgggtgctcctgaaggatttgttgtctggggactcttgcctggtgcccaaggctgtaccttcttgcgcgtaagcctgttcagctctcggcccgtgtggcatgcaggccacaggagaaggtgactccagcccctcctccgttgactgcatttctcactgagcgtatatctgtcttgccttctcgcagattgttttcacgtggcatttcacttaactttagtctggattcacattttttttttccagaaggtgagattcttcttcaccaagatgtcacagtttgggcaaagttcaaagttgcttaaatttcttcgaagggctccatgagcagttgtactccagcaggactgtcactccaaattggactctccagctggtcaggggcggctttccaagaatcttgatgtcccagagcccctctgatacagtatctgaaaggccttttttgaatgtttggaatgctcttgtctgagagatatcttaatatgaaagcaaatacctgaagcataataaaagcttgtaaagcatcaagaaaagaaacgatctcaggaaaacctaatagtaactcgtgatccagggacatataaaactggagatacaccgtgaaataaaaaatgtcaggtacttaacagcatgcaaatgactgaagccaaaagaaaaagaaagaaaagaagaagaaccaattaactatgagagtctgcatccttccccagggccagtgttaatttccatcgctgtctttaagcacatcgttttgaaagagtgtgctcgggttcatccatcttatttcttctgttagcctcagaaagggagaaagtaattttcctacattgtcagcttctttacaaatgtctgggccttttctaaacagaacccccattgaatagaggaaaacaaccattctcacactgaatgccctctttaaccctaaatgcttattcagtcatttagcacctctcttcctcgccttttttcccttctgaacatgacctgaaagaagatgttggaacccccctgcatggcggcgggtggcattgccctgccccattcatctgcgcgttcatccgtttctcttacggagcagcctcaatgctctaccgatgtgcgggtgccaatctgtctccccgaggttattcagcatctaacgttgctatttaatctccagatttctaaacttgcagcagactggctgtgaacaggccagattatttgtttcctcttaaaataagtgcttgatggttgggttgtgtggggccggtccttggtggtcactgcatgtaatcaacattcatagactgtaggaaaatgtggtttaatgaaacattctgccactttttcttctttggcacgcgttaagcagtgcgtgcaatgcattgcaaatgcaagtaattcagagtttacaaggaaaggaaggagagtgaggaaccccagaggacagggacgtggggtggtgggacagggcttcaggctgatttatctttcatacagtagtttggccagtgggaacgcggagtgggaggaggctgtggctgcctgctcttcccaatggggaggaggctttacggtcctctcagcggagctggtgtttactaaaaggtctttcctaaagagcccaccgaatagaaaacgtctacttcccgtaggctcctgagaagcttcctgaagtcagtgagcacgttctgcataaaagctcatttgaactctgcactaatttgcctagcaattcataggaatcaatcatctaatattcagtccccatctaatgaatggctgcttaaacacactagtttttttttttcattgcattgggttaggaagtttgcagctggtaaattaaaataggaagcagtctttggtatgaaagtggcatattttaagtgccttggaatgcacttgttacaagtgctctgctgttatgtgagcagtagtttaatgtggttggctgggcgtagtggctcacgcctgtaatcccagcactttgggagcctgagatgggcggatcacgaggtcaggagttcaaaaccagcctggccaacatggagaaaccccgtctctactaaaaatacaaaaattagctgggcatgggtgcacacgcctgtaattccagctactcgggaggctgaggcaagagaattgcttgaacctaggaggcagagtttgcagtgagccaagattgcgccactgcactccagcctgggtgacagagcaagactccacctcgcaaagaaaaaaaaaattaatgtggttgaccattagaaacacaacatcaaaattgttttggagccatcttagttggttaagattgatgtgcaaaaatcaaatatttggcagttataaaaggacataccatagattttaactaatctcttttatgtagagagtggcaaaaaatcttaatgctttaatgaaacctactttacaatcacgaatgttatttgtattctgtgaacatattgcaatgtacaagcagctgaacaatgaaataaatccaaaatccccaaacacttcccagtcagctcagcctcacaggtgtccattgggtccttggttctttgcttcctctccatccccagctttcagcacattgctgtgtggccgtcttgaaggaaagcccttcattctcttcaccttcgctcaggtttcctggctcactggctatggtgaataatttatccctctgattttaatgagtgtattttattgtgtttttaaaaagtagggacccaaactgatcttcatgctatctctttgtttaaaactatatttgaaaaaaatacttccattaattttttagatattgaatccagaagcactggtgatagcagcaataactaacatgtgtttttcatgaataggtggcaattattgcaaaaaaatgctttacatacgttattgcaattaatacagccaccaccttagtcgctgttattatacctaccttgccccagaacagtgaggcttgagcagctaaaaccacttgcttgaggtcttctaggcagggagtaccatgaaacccgtgtccactacagaatgcctggcgctgctctttttggctctgagtgtgcttacgattttttgaaaaacatttcccttgagacatccttttcttatagtatttgtagttttttcagcatatataaatatataaattgaattattataacataaacttataaattacattctctaatgaatggattcaaggctcctggcagagatactagtttttatgcttgtaatcaatcacacttaaatatcatgcaatccaaatgctaacaaaattactctgtccccatttggcatttagaaaacatcaaaaacatgctgatgatgccaaatagggtttttaagaatggggcgaaaggtgaaggtgtcaagtgcagcgaggattcctgcagctctttccttgtgtgggggtatgtcagcgtcagtgcaggctgcggtgtctggctctgtccttctgacatctgcggtggctgtggtccacctggagaggtggttatgtaggactcagggaaatacataattgtgagcattccatttattcaggttttagaaatgaaatctacaatcgcatgtgcctttctcatactctgtagtcgcagatctgatgagaaaagtgagagacagaacagagaaaaccctcactcctgggtcgggctttacttcttgactgtccaaaaaaggaaagatataagattttgattctttcttggaagctgcatcattactttgctttattgttcaagaaattgaataataggattatataataataatatgtaataataatcctattattcaatttcttgtcccttctgtttagtcttggggtgtgtatgcatgtgtgtacgtgtgtttgtgtttcacttttctccttgatgacatttaagactgcacccatttttatgttccaggtgttgtagatcttgtcaaaatggctgtctgttccttggttaccttctcctataatgacgcaagaagaatggttgaatttaaaaggcaatacatttagaaccaattaaagagaacatttttagcacagggtgtggcgcttacaagagttcataaaaaccgaagttgctgggaatgagttgccattcacctgcactagaaactatggacttgtgtcaacgatgggtcctttggggaggaaatcatctcatcacctgtgattcttttcttgttatcagagggagaaaatgttggcacagcttccctctagaaaaagatattgttaataattggttaattatgaagactgatgaagaaaagacattacagctgagatggttgggagggagagaatgtctaggctgtgaagcaaaaggaactaatgattagccagcagggtctgacaaccaggttacggtcagcagccccaggatatctgatcgtgtgggcacagcatggaaaggaatgcctctgaattggcctactaagctgaggcagaacaggcagacacactgggatttgagccggggatagggtgtggtcaggtggagagacagaactgaggccttcacatgtttgggggttctaggagggacagattctgtccagcctaccttttctcaatgcattaaactttggcaaagtaatcaggttgcagaagcaacattagagtatcctcctttagctgctgagttgggggtgaagtgggctgtaagccccggggcagttttcagaggacaggctttgagactgcctgaaagattcatcaccttaaggataaatttcctggaggcgaactagaagatcctgtgcattaacagaacagtcaatgcctgttatccaggaactgatgtgaacatctgacagcttctgtacctttcaatcttcaagcactgcatggtgaattttgtgatttaaggaaaccataaatgaattagatcacttttttccttccaaatgcgagattccaaatgacagcagaatttccgtccacttcctaaaagttaaaggtagaactgcttgagtgaggctaccagtgctgaactggcaagccaatcgtggccaaagctctcaaggtaaactgaaatgatcaatgtatttatagtaggataatcaaaatttatttattaaagaaaccaagatgagaccaagagcatccagtggccaatattgatgtgcctcacttgaaggcatttcaaaccatctcgccgctaaccaaggtacagcaagattgttcagctttgctgaaaatgacttgaccgtagatttgcttctggggcaaatggattgtaaattgctaaaatgacactggtttgaatggcctgaaaagaggaagggaactgctgcttccgtgttccctgagtgccttgtgtcattacctcatttactcactgcaacgccacacactttgtggcttcctgattttacagatgagaaaaccaagattctgaaggagtatgcagattccccaaaggcacacagctaatcagcggtggagcgaaattccaaacagctccaaagactgcctgtctccaaggggcatctcactgcatcttcgcaagtgcacaggcagcgtcagtccgggcactgaaactgacagctgctgcggtcttgattttgagacagtttgggtctcagccagtgctattcagcggcttgaagtccaaaatcacacccgtgcacatgtaggattgttgtctcacgtatcagtggacctgtcccctgcagggaagagttgataaatatggcactctgcttcacttttcttgtttttgttttagtttttgtttttgaaacagagtctttctctgtcaccctggctggagtgcaatggtgcgatctcggctcactgcaccctctgcctcctgggttcaggcgattctccggcctcagcctcctgagcaggtgggattacaggcgtgtgccaccatgcctagctaatttttgtattattagtacagatggggtttcaccatgttggccaggctggtatcgaaatcctgacctcaagtgatcctcccgccttggcctcccacagtgctgggattacaggcgtgtgccaccatgcctggctaatttttgtattattagtagagacggggtttcaccgtgttggccaggctggtatcgaaatcctgacctcaagtgatccgccagcctcagcctccgaaagtgctcggattataggcgtgagccaccgtgccccaccctctgcttcacttttctactctaagttcttttaaaagaaccatgacatggcagaagaagagactgatgaaaggtaggcaggaggggcactgccctgtctttggtcccaagccttttcctctcttatctgcagtcattcctgttaaggttatttccttgggaaaattccacacccacaattgtctgttcccaagcacaccctcacgtctgtgttctaacacccgcttcttacctactttctctcaataacaataaggtaagaagtaaattttctaactggcagacaggcgtatgaaaaggtgctaaacatcattgctcatcagagaaatgcaaatcaaaactgcaatgaggtatcatctcaccccagctaaaatggcttatatccaaaagacaagcagtaacaaatgctggcgaggatgtggagaaaagggaaccctcatacgctgttggtgggaaggtaaattagcacagccactatggagagtagtatggaggttccttaacaaactgaaaattgagctaccagggaaaggttttaacaagagtactgctaccagctgtaccagcctgcgatacatgctaaggactcaggtgctacgtgagagagatccagttaaaaccccagcttcaagatttaggggctgtggaagcttgtacgagtttcttggcaactctgattcacattttccggtgagacccccatctctactaaaaatacaaaaaattagctgggcgtcttggtgcacacctgtagtcccaactactcgggaggctgaggcaggagaattgcttgaacccaggaggcggaggttgcagtgagctgagatcatgtcactgcactccagcctgggtgacagagtgaaactccatctcaacaaaaaataaaagatgaataataacctccaagtgctgttgtggggattaaatatgagaatatgtttaaatgcttaatagctggcacttaaacataagtggaaaaagtgatcatgtgaccgctcggcaaatatcgctggtaccgttagttggtttgggctgctataccaagataccatagactaggtggctcaaacaacagacatttatttcctgaagtttcctgaagttctagaggctgaaagtcgaggatgagggtgcgggcagctttggtgtctggtgagggctctcttcttggtctccacaccgggcaggaggggagagagagtggaaagaggctctcacctgtctcttctcgcaaaagcactaatcccatggtgagggcctcaccctcatgactcaccacttcccaaggtcttaccacctgataccatcccactagggtgacgatttcagcatggaattgagggggcacacattcattctatattttagattgtgctacttgcaaataatttcactgctggaaaattctgaggggctggtcaataggaagtgcatgtcattgcaattcttatttgcagtccattttcccatgggttggaaagtggggaggaaggcatcctactggtctgggaagatccatttgctgatacaggtaagcagatagaggtggatttcccaaggtggaaatcctaaggtggatttgcttagtcttgggacctgttgctgtccacgcccctaccttgggctttgctgttcctccttccgccccacattggctgagagcccagaggtcagctatgcttcccattctgtgtggactctgccatatgcatccataaaggccactgccagccacactctgcatccctcatttatggtccctggaactgggaccctgtctgtgctaccccttgcttccttctcctgatgtttccaactggagagggagaggacattctcattccagagcaagccctgctgctccctcgttccatccatcatttcttcgcatgcaaagtaccttctaaatgccaccagaaaactttctgtcagtcagacagacatgcttttgaactgaaacatactttgattagggagcaaggtgagccgattctttctgttacgtatcagcaaatggatcttcccagaggggtagaagccttcctccccactttccaatccttgagaaaatgggccgcaattaaaaagacaagcacttcctgtttaccagcccctctgaattttccaatggtgaaattatttgcgagtatatctcactctttctcagaggttggcccagactcccaggataaaggaaagaccatttgggtcttcacatactgggaggaaacaaaactgaagacttttcaagcctctcaaacctactttacagtgattctctctttcatctttctttttttttctttgagatggagtcttgctctgtctcccaggctggagtgcaatgaatggcgcaatctcggctcactgcaacctccacctcccaggttcaagcgattctcctgcctcagcctcccaagtatctgggattacaggcactcaccaccatgcccgtctaatttttgtatttttattagagacgaggtttcaccatgttggccaggctgctcttgaactcctgatctcaggtaatccacccacctcagcctcccaaagagctgggattacaggcgtgagccacagtgcccaggccctccttcacacttttaattgggaccccccctgtgtcttgagggactctgagtggcattacagtggagtcactttgccattaatcctatcactgagagcaccaagcaggtgttcatgcccaggtaggctgagcatctgtatcaaggcttcctgagctttcctgtgccttccatcgtcacttattttactgcaaaataacaaatgctttttggggatacactaaagctaccacacatttaatattgactctggagtttcaagtaacttaaaatctactaatctcagtgaactttcgcccagagtataatgttttccattttctatttttcctttcatgtagttctactctagagatggatgtgagaaagataatacaggaaccatcctgtatctcagcaaactctactgaaatcagtaggtatcatgtatgtgcatgcacgtacacacacacacgtgcacaaattagccctgtaatgttattccatgtcagattgttgcctttggccaaactcagcgattgtgaatgacatctcctgctcggttcatgtaacgtacaggagacctgttcttagcatttaccattatccttccagtcttgactaaggttgggtgcacattcacagagactaccaactctcgattcagggtttgaaaagtctgaatggttgtgtattaaatggaaaagatcagaccaatattccctagccttggatgaaactgtttgtttgcaaaatgatgttttagacagaagtgagttttcagaacattaaaagattccagtgataatatttgcaaatcctttcatctgcatgaaaatttagcaactaaatctggccattaaagcataatctttatttgaccaaagcatgatataaaaatggaataaactataatttatctttgctgacagctaattacctggaagtctgattaaagggaaaactaaatttacttaattagtgttttggtgtttaatctgtatacatataaatatgcctatctcctctcctacatgaacatttctagaaataaattaccatttttattttgtccctttcagatgctgccaaactgagggcagcattagaagaatgggtattttagcaacaatggtagcaggtgtttgtagactgtgatcccattagaggagcagagtgaggtaacacaagaatgggatgcttaccacaaagtagttttcttttttccccaatggctcctcctttaactgtgaacaagaagagtgccaacttgtggagtgaaccagccctgccaatgaatcctggcttggtggtggaaaaatctgcatataattaagccccttgaggcaagtggactttgatagacaagaggtggctttgaaaacgttgaaatcatttgttttttagcagcagtatttggcagtgttgccttttgacggtttgaggaactatgctgtaagtacagccaaaggcagaggaggttttatggaactctcagctcccacccccacctcctgatgctgcaaagttctcccactagatgcaatttaaacaggagacatatgtaacacacctcaggtggtgtaatgaaatcatcctcttttctgagcttctgaaagtcaaatatacttatattaattttttaaagtgatctgaaagtcatacgattctattcttgaaatagagaggttttcgttacttaagtggcagacttactgacagttcagttataggcttacaaataattggactaaaatatgatttttataaagcattgtaggttttaatcaaaatccctacagaaatgaaagtcttaattaaatctgaaatcctacttcccagacctgaagtttccaatatcattttttattctcgcccaacatcctctgtgattaaaatagaacataagtggtgaaatcgctgattatttaaaggatagcatcatagaaacaaacccaaagcacgtagaagtcattttagactcatgaaaggtagaagatgaaagaggcttgcacagcatcttcatctcaggaagacttttgggtcaggttctgttcatttcattatcgtcactcttctcggttgcataattggaagttctctaaaataactacttctgacaaaatttctaaaagttgctgagtggaggcttaaaaaaggactaatatccttaatgatttgataaagattaaaatcacagtttcaggaagggttactttttgcctacttcacagacattcaccctcttctctggtagcctggacagtcattttctagaaccatcttccttctttattctgccatttggctgaatgacccttaaggtgacacaaagtaaagggactatgacaaggttaacaaatgtgcaacacaagttgcctgttctctgttgtttcgatgaagcattcagctcaatataaaaaactatatctcattaatacaccttccaactgggcagaggatgggagcacagaggggtccacagctgtaagtggaggcaaacatatgccatgaaacccaggccagtgaggaagggggtgacatgtggattttaatagttaatttttgttgttgttgttgtttgttgttgttgttttgttttgttttttgagacggagtctcgctctgtcacccaggctggagtgcagtggtgtgatcttggctcactgcaacctccacttcccaggttcaagtgatgcttctgcctcagcctcccaagtagctgggattacaggcgcacgccaccacacctggctaatttttgtatctttagtagagatggggtttcaccatgtcggccaggcttgtctcgaactcctgacctcaggtgatccacctgccttggcctcccaaaatgctgggattacaggcatgagccaacacactcggccaatttcttttttgatgtccaggtacagagaagttgacattttcatttaaacacatacttgacccaaggacacaattcctttaatacggctgggtatgctaagctatggatcatcagtgccacagtaaaaatggacttgtgtttataggttgtctcctggagattgttgtgaattatatgcattttaggaaataataaacttgtaatatgttcgcctgtgtgacttaacgccgtgtcagctagagtaagtgtgcagcacatccaaaccggaccttctatggctttaatacttctgaagacctctgtaaagattcttccttctcagtacccaagtgctgaaaaaaaacatgtattattataggtcagaattagcattttagtcagttattctagaagtagagtaaaaaacaaattttcagactcacttatgtatttttcacatgggtaatcctttgagtcaggaaactggctagagttacattccataaataaaatgttttgatgatgatgccaacttgggcatggccttgtctcttaacttaggaggaggacaggcagacctggggggtgatgattaagtaaaatatcagtcagacagatgaaccgtaggacaaaaccaccaccaagggctgtggggatggagatgagaccctggtcacctcccctggagaatgtggagaagacttcaccctatggttgatggacatgtggtctggggctggaaggttcagtgggattttaggaaggggagaaggaagcaggaacaggggaaacagtttgatctgagacactggtgtaaggttgggataattttcagtgacatggggaggaacacggccttgaagggtgggagagtggtcttccattcatgacttactgagcctgtcatatgtgtgatgcagtggaatccacagaggattctgtcctggatcacacgcaaacccagccttcatggagcttgtgtgtggtatggcgtgctaagtcgtagacccattacttaaaatgactgtgttgttaaatgtcaaccgagtatcatggagacattcatgatgggggactactgtggtctagatcagcggtgtccactaaagacatttgaagacgggctgggggcctgtggtctgacccaggccaggaagatgtgtagttcagagtgagttgggtatcactgctctgccttgaacaggtgcaccctggtgttatgggactatcaggttcaactgcccgttgcatggtaacagaccaccagtacaccaaaacagcaggatgtggagcagacaatgtgtttaataatcatagggcagctgaacaaggagacaggaggaaacctcaaatccgcctctctgaggagctttacatgggtgtttttaagggaattttggttagggggcttaggagctggagatcactgactggacagtgtgtgggaaatgaaatcataaggatgtagaaattgcactcctgcgctgaggctgttcctcggagggcattttcagatgggctggagtcagtgggcccattggactgtaggttctggaaaatatctccaaatggaaaatttgaggtttcttaacatttaaggtgttacctagagaagttaggagcatgtgacgggggcacgtgacttctaagcagcaagcagctatcagaaagtgggccaaaggacaagctggttaatgcgtcactgtgcttctacttaaagcttatgcttttgttaaaaatttagcaatttggttttattaattttatgaggacggtttccctggtgagcatttggctccacagagagggatccaacagctaagagtctgcagtagaggcgggatcccacagcttcactgatcaccccattttcctgtggccccaccaccatctcttctcttctcccaggaccctagctcgggtggaaacagtggggaggccttggtctccagctcagaacccaggagccaaaaatagcagctgagtgtaaattttcattaagacaggggattagagatcaaaaggggtggcctcccactctccagaccccaactcctccctgagtcagcacccccacctgcacctgcacctggagggaccctgcctgcccacactcggtggtggccacagcctgcatctagcagggtgtaccctgtgccaggtggcaggagagcctggaatgtgctgtcagttctcagctgatctacaagggtaaccacagtcaaagccattttaaggaggggaaagttaagtaaggaagaggccaattaatgtgcccatgaggatgttaacaagcagccttggaattggagccaagacaggactccagagcctgcatggggggcctctgggtgtatcatctttgctccagctgagcaccggcttgtctcaagaacaggctactgcatggcacctctgctcccctggggtcctggaaaggttccctggtctggggcatctgctcccagccctctggaaggtgggagtgaggatgatgacatcccagcagggcactggccgaccagcctgctcctatagcaatgccttcctgtcctcctgcccactgcccctttgggcactgctggtggccagcactggcggccagtgctggcctcttctccctgctgcagagctgcttccataggcggacctggtcagagctcaagtggaggggaagcaaaccttttggagtgtcttgggttacctccttaaacattaaagacaaggccgggcacggtggctcacgcctgtaatcccagcactttgggaggccgaggtgggcagatcatgaggtcaggagatcgagaccatcctggctaacacagtgagacatcatctctactaaaaatacaaaaaattagccaggagtggtggtgggcgcctgtggtcccagctactcaggaggctgaggcaggagaatggccagaacccgggaggcggagcttgcagtgagccgagatcatgccactgcactccagcctgggcaacagagtgagactctgtctcaaaaaaaataaaaattaaaataaaaattaaagacaaattaaaaatttgtccttaaaaatgcagggacatggatgaagctggaagccatcattctcagcaaactaaaacaggaacagaaaaccaaagactacatgttctcactcataagtgaaagttgaacagtgagaacacatggacacagggaggggaacatcatacactggggcctattggggggtgtggggtaaggggagggagaacattaggacaagtacctcatgcatgtggggcttaaaacctagatgatgggttgacaggtgcagcaaaccaccgtggcatgtgtatacctatgtaacaaacctgcacgttcttcacatggatcccagaacttcagtaaatttttttttagatgcagatgtttatgcactgacttaaatatttaataaggcatgctttaatttgtttgtttttacttattgttttaaaagctagagtcctgaccaatttgcttctgcctccacacattttgtttttagagatataaactacaagtatatctcagcaatatgaggccaggaaagagatgctccgagcatgctctgtagccgtggcccctgggccagcagcatcagtgctacctgtaggcttcagacctgcagaatcctagggcccagcccagatgcactgaatcagacctgtattttaacaggtcccctgggtgacctgtaaccacattccactttgtgaagttctgtttaaagaagcaggcctgggatttgcttactattcagtgaaactttcaataaagcttcttttctcttcctccgtgaacggcagttattttctcgtagcaagagtctggactacagttgttctgaatcttttgagtagatattgaaggggagatacatgagcatgcaagcagacgtgcccagtatagcgagaaccagaataatgaacccctgcaaagtgggagggcatttggaaagagtgcacgctgagttcatccccagcataaaggaaccagcccgttattctaatctgatgagggaattcttcctgacaattgagtgatggaaggaggcattttaaatctttccatgtgtgtctcttctggcaagtggacagggcttgtgatgaatcctaggtctgataccagggtctttaatgtaaaagacaaaaacatactagacatctagcctattaaacttgaactccagccaaataagagctgatttcctgctgcaaatcaacaaaagacctcctgcacatggaagacgactctgacactaacactgatttagggccaggaagcctgcagtttaaattaagctggaggatactagctttatatgaaaatggcaggcaagtgtctgtggctcacagaacaagtatgatatacttttgttgcaagacctttgcatagaaaatcatcttcttttagaaaataaattccgttgccaagttttgtttcccattctactctgccccttaatgtccaaggagaattctccctgaagtccttgaggatggggcttattcagcacatcatagatttatgaagcctttgccatgtgtcaagcactgtgctaagcccaggggattaagagcaacaggcaagccacagtctccctctgtgcaccagccctggctccgtgaaatcaggaaagcaggaggaaagaactcaaagtgcacgcctggggaagtatcactgccacctaaacccttcttctcagctatcttccctatccaaccactagacacactggtgtttctagtcgtctcaacttgctctctttctatgagttccacaattctcagtctagtaataatagccaacatttcttgaatattgtcatgtgtcatgtgataagcccagtgtggtgttttatatgcattttaccatttaatacaatggccgtataggaggcactatctttaccctattttattgatgagatattagggactgggacagacactcctcatcctgagcctaagccactgcaacagcttgtaaactttcccttccaattccaagctactcctttccagtatatcctgcaaatggcttccctattaatattcctaaattatgatttcgctgggtgtcttttctcttcccaaagataaacactattttgacaccttcaccatccattcggtttggcttgctttggaaccctgtataaatagaatcatgcaatacatattcgtttgcatctagcttaatttgcctaagattatgtctgaaagtcgcctcacatgtagtactggttcactcttcgcatttctgtaaagtgttttgttttaggaatgtagcaccatttattccttctgctgttggtggatgttcatattgcttccagacttgatcattatgcacaatgctgcgggcactcttgtatgttcagtgcataagtgcatgcgtttatattgatggttgtgagctatgaacatgttcagctttggttgattctgccagagatttccagagtagttgcaccaatttatactcccatcagcagtgaaccagaatgtcattttctttacattctctcctcacctgcccttgggaggggtgaggctgttttggtggtggtggtgtttttaccattctggtaggatcccattgtcattttgatttccatttcttaggtgacttgagcacctttttagatgctattggccatttgggtagcctccttagtcaagtacctattcaagttttttgctcatttttaaattgtattttatttgctcattttgtattatgttgttattgtatggctcccttatacttgaactacaaaagttatttatatattctaggtatgagaccttcatcagatacattattgcaaatatcctttctctgtagttggccttttcatataatatttttcacaatggtgtcttttgatgaacagaattttacaattttgatgaagtctaatttgttaatctttgcttttttagagttttaatgaaatatctagtgttattcaagatcatgaaaatgtttctgttatttgctagaagctttattattttaccttcaacatttagatctatgatgatccagaatatctttttgagtatggtgtgaggtaggggtcatgattcatttatttgtatatgaatattgagttcttacagccccatacagtgaagacaccatgctttcccccacattactgctgtgaaacatttgtgagaaatcaggtgacaggtggatctagttttggactttctatctgttcccctggtttgtttacccctggagagaaatcacaatatgtaagttactatatcttgttaactggtagtttaagtggtttagatatcatctttaagattatctttattattctttgccctttacgttttcattaaaattttagaatcggcttgtcaaattacacacacatactcactcacatagtggttgagattgcattctatgaaagattaaattagtaagaatttacatatttacattataaaattttccaatccatgaatgtgatgtactcctccatttgtttagatcatctttaatttctcttaacctcattttaatgttttctatgtaaggtcttgcttatttttatgaggttcattcctaagtgtttgagggttggtgaggctaatataaatgttttattattttatttccattttctgttttttctatttaatttctattctgttcattttctgtgtgtttatatgagtgaaatggaaatacaattaacactaattttatattgactttgcattttcttagtccttacttaaaacttggcattttattttatacagttttgtaattttatttggatgtttatttttcctgttctcacagtacttagcccaatgttgaccaaataaatacttaagtacttgtggatttgttgattaatgatttatttaaataacttttgtcctagctgggttaccttaaaagttctaacttggtctggcacagtggcccttgcctgtaatcccagcactttgggaggctgaggtgggaggatggcttgaggccaggagtttgaggttgtagtgagctgtgattgtaccactgcactccagcctggacaacatagcaagaccttatcccccaacccccccaccaaaaaaaaaattctaacttattatatcaatcttttcaatagtcagacaattctatctaagaagttaaatgtaactgaattccatgggcttctcaatcatttcaaaaattacaacttttaaaacaaaataataattccggaagtagatatacacattttcctgcaaatgtttctgtactatgtcacatcttgctgaaggtcattttagttaaattaatgtaaaatgcagactgcatgaaataaagaataaaaagaacaaaagaatagcaaatagaaagaattaaaaaaacatgggaaggcaattagcgaattttgttgaaatttgacactacttaattagcagctcaaatttcctgaagcttgaggctttaccatctagacaatattacattgaattttgggggtttaaaaatataattaaaagtttattggacaaaagttttacccacacctagcacatcatagacaacactattgataaaatgaaattaagctactgtatttgattatcctcataatatattttaaatgaaccatgaacaatgaatagctgacctatagtaaaagcaagaggttaaagtaaaaagaaatgtatctaaaatgaaaaaacatacacagtagttttctttgattttaaaccaaacatggatatgcctgtttcattaatgcattatctttagaaagtaatgtggggcttttttttttttttttgcaattgaaaataagattcatttaatcagctatcgtagttcatctgttaaattacagcactttgctgtccattttgtaaaataatcttcaaactaatgaagtaaggtcaattgcatgcaattttattctagccaaattgctgttaattgcatcaacggctttggtaaggtcaataaatgttgcctttttacatcctctcctgaaaatggcagaaaataaacaccttttctctgtaatgtattcaggctcgaggcaactcatagcaggtggactattcgattttcattacctgatttgaaaatgttccatttctaaagaattgtgggaggtattggagtcaccaaagcacttttagcaaagatatcttttagctgggcctggtggctcatgcctgtaatccaacactttgggaggctgaggtgggtggatcacctgaggtcaggagtttgagaccagcctggccaacatggtgaaaccccatatctactaaaaatacaaaaattagctgggcccgatggcacatgcctgtaatcccaactactcgggaggctgaggcaggagaatcacctgaacccgggaggcagaggttgcagtgagctgagattgcaccattgtactccagcctgggtgacaagacaatgtgaaacttcgtctcaaaaaaaaaaaaaagaaaagaaaagaaatctttctcggaagtgctcccttgttactcttgaattatgtcagtggtgtccctcaaatagagacaaacttatactgaacaactcagagtagattgtggaccttgacttgttaagattttaatttttatgataatcagtctagagcagatcatctgttctcctttaacctgtcttacaacaaacagtaaatgtttgtatgtcagctcaaccatagttatactgtgaggtataccagttggctcacctgctcagccgtgcagcctaggtcagtgtaaggaggggatatattacctggacccatggagggttaggacctcgctgtggccttattcctgctgcagacctgacccagtctttaggacttgatcacatctttacaagctttatgctttaagatatgcttttctaaccatctcaatttgtaaactgtgaacactctgtggtttctgaaatggcggagatgtgtctgaaaggtgtcatgtgcgccgtattacaaagaaaccctaaaaacagcaacaagtgagagatacaggtggaagtaagagcagtggctggaggcagagagagactgtggcaagcggatggcactcgacgtgtgggggcagttccctaggacctctgggagagttgcacttatcctattttccttgccttcacataaggtcacaatcactattagagtctgtttgatatactcattactaatattgattttacagttcaagaaacaatatttcttcttttgttttgagatgaagtctagctctgtcacccaggctggaatgcaatgacgtgatctcagctcactgcaacctctgcctcccaggttcaagcaattctcctgcctcagcctcccaagtggctgggattacaggcagccaccaccatgcccggctaatttttgggtttttagtagagatgaggtttccctatgctgaccaggctggtctcgaactcctgacctcaggtgatccacctgcctcggcctcccaaagtgctgggattacaggcgtgagacactgcgcctggccaagaaacaatattcttcttttaaaactgaatgagcagaaatactgttagtagccagctgaattcaggaaatgtgatgcatgtgctggtgcacatacccaagaagactgaagacagcatagaaggacagaacaaaaggccagtgccaagggtggcagagggagtccttggtgcactctgggacaagccccctgcgtgctgggtgtttcgggtggtctgtctccatgtgcaatatcagtcatgtgaagccttaacaaggcattcatttagttagtatttcagatttgccaaccctgttggtgttgggataagggttagagatacagagaagcacccctgccccggaggagatcactgcctggtgagaaaaccaggatgggcttctactcaccccttcaagtccttgatgaaaggttccttctgcaggagcccccagcccctgccttctgctgtgtcctgctcctcctcacctatgctcctggcccctcttcccctgccttattctttatggcaccattgcctttccagcttagtttcagtggcttgctcattttcatttctcctcactatcacacaagctcccagagagcaggaggtcttgtcattttttgttcatttgtttccaccaagatacttagaacaatgtctggcatggtgagccctcaaaagtatttatggagggaatgaatgaactcgtgaataaatgaatgtatgaagtactaatagatgggtgagcatggaactctatgtgatcaagtgtaaaaggcactttcccaaacacaggacttaatgagaggcagtcagatagtcaaacactacagcacttgagttagagaaacgttttgactaatcaaggaagcctttctgggaagtataaatgtctgcattagaactagaaagtctagaacgccgtaggaaggtacagaggacaagaacgatctccttgggcaggcagaaatgatcgagctgcgagctgccggaggaccgcatgcaggggaaattttgcttttctgagtgctgcttggctttgagatgtaagatttagacgttagacactttctagctcattttactatgccagtagtgatcctccctttcttatttctttaagaattgaagctggcatgaatctgttttcaagctgccatttagaagttggaatagtgtgttatattaactttatttattcttaaaatatcatcttggtgcccaggatgacactgcctgaggagctatcaaagagccaatccctgtgggatttgtgagaaaattcagccatctctagacctccaattccaaacctctttcatctcccaagactctatactttgatctaacctcttgagtgacttccttcaatttcttcctttcacagcaacaatttcagtcccagggcatacacttatacttataaactatttctggggccagcttgacctcaaacccgtacaagatgatcgttccagacagagaaattctcaggacatgaaaactttcttagaatgtgctgaaatagggttgtgaatgcgtgtgttgctacctctgaaaacttgatttagtgctgtccagcaaaagtcttgacatcctatgttagttggctcagctctatacaaagaatctgaaagcacggtagaagatggttggcttgtgttaggttagaaaggcgtaacaatgagttgttttctaagtgaccagcatgtgtgatttatgactgtattccagaaaaattcaattatatgagataaataagtacagagttagtatggggcttcagaataacaggaagcagcataaatattgccctcgcccaccagaattcatcactgatggcctgctctggccctgccttctgctgtgcatggaatttttattgagcttgatgagattctgtgtaataagatgctggattccgggggctaatggcctacgagaagatttgagtgttgagattctgtataatcagatgctgaactccatgggccagtggcctattgagaagatccgtataataagatgctggattctgtgggccagtggcctatgagaagatttcagcattgagattctgtatagtaaggtgctggattctgtgggccagtgggctatgagaagatttgagcgttgagattctgtataataagatgctggattccgtaggccagtggcctatgagaagatctgagtgtgcctactggatagttacctgctggaatgcaagttgtcactgcaagattgatttctagtgacaataacaagcagaagctgactaacagcacactgcccaccatctgctcaagatacccaataaagtgtatttgttcctcattttctcggaaaagtctccacctgaaggtcacagtgagatagaccaccacagtgaaaggacatttgaggtttcttcctgcctgcactggtgatgacatcaggaaacttgtgaaaccacggtcttttgtttacattagaaaatgcatgtgagatgacaggtcaacatcagcaaggcataacttaacagagataaaggtaatgctttctgttggttagaaaaagcaaaagttttgaaaaacacctgagcaaagaaatcttgagaataattgctagccaaaaaaaaaaaaaaaaaaaaagaattggggtcatagggaccaacattgagacactgttgttgaagcagcaatgaataggtattttgtccaaataaaaggacgtaatttaatcattgttaatgtattgcccatcattggtaagccctcgggcatacacttacacttataaacttatttaatccacacatagcattatgaaggaggcattatcatccctgccttacagatggagaattggagtagaagaagtagtaggtaacttgcccaaagtcatagagggtatcgacttatcgactgcactgctgagtttagggtctgcagtttgtctgccatgatggctcacatctggagtgtcaggttcagccctagaagccacgttgtctggtggtgaacactgaccatcttgcagtcactgggtccacaagaggggaaccactgtgagaaggtgtcctgtgaccaacattgttgaggagtatctaaagggtgaattcagggaggttgtgctacagccttaaaaacacataaagtaactcagcgtcatcctttcttgttcacactggaagaactgaagtcaatagctggtcctagggagatgaataccaatatgagagatgcaggctgcacagacctggaaacagcttctgtggcttcgctcaggaaagaagccagacagccttctctcagggctcctgcaagtgggattcctgccctgcgggttcccaggtgaacacaaaagtcagttccaactctaaaattatttgtcattcggtacaacaaagataccactgcctccctagcaatagagttttttgtttgttttttgctttttgagacggagtttcaccctgttgcccagactggaatgcagtggcaccatcttggctcaccacaacgtctgcttcctgggttcaagcgattctcctgcctcagcatcctgagtagctgggattacaggtgtgctttatgatgccatgctattttttttttttttttgcatttttagtagagatggggttttgccatgttggccaggctggtcttgaactcctgacctcaagtgatccacccacctcagcctcccaaagtgctgagattataggtatgagccaccatgcctggccgcaatagagttttaaatccttctagaaggtactccctgagccaaccttgcactctctttgcaccccatggttattctgatgaggcagccattcaaggccacctgggctggaggcctggctgctccgagtgcagccctgctccactacatcagcatcaactggagcttgtttggagtggagactcttcgtccctgcaccaaccatcactgcagttttgcagggtctcagatggttcccgtgcacatgaaggttggattcccacatgaaaggctgtcatcataacccacctggaggagctttcagaagactatggtctaggtccttcctcctcccctccacccattgttcttggtgagccctaggcattgccagtgagggtttccaaagctctcccagtggctacagtggcagccagcattgagatgccctggtataaggccacagaagccagccacagtgaccagccctcctgagggttggccatgaactgatctctagggctctgttgagccttttgaacattgtttagagtaagaggaaatgtagttgttataagaaatgctcaatgttccagaagtgctatgagttactagaacaggaattttcaatggcagttttattccagtttgtccccagtgcttcaagagagggttgggtagggctttatgtgtttggggaagttgctgaagaaagcagctgaataactgaatccttttacttataaaaaggttcaaagttgtccagctgaaatgctgaggttgggagccttcaaattgaggacctcagggttctccaaacagaaggcttgcaagttccaggctgaggctaggggagctgtctgtgtctgtggcccccatgggtgattggtcccctctgtctgagcacgtgcgcggaaaaccatgctccgtgggttgacagctggtggtttgcttatttgcttgttttgaaaatgtctattttttaagactctattgtagctgaatttaatataaatgctttcatttgaacatttggccatctttctttagctaacatgtgctcttatttttatttagcctatttttaaccattgagttactacaaaacattatctcaggtttattttcatctgttacatgttttaaactgtagccatctgtgtctgaaacatttttatctgctacaagttaatattttaaaatgttattaattgggtaattatttagctgtcttcaaaaaacaaaaacaaaacagcaatcctgcttttccagctagtgagcagaaagtcagggcggtggggagtgtgttgtctgtccagccctttgcttgggacgggagtggtctcttgtgcttccgtgccctggtcttacctcaaagttactttcttaccttgaagacccaccattaaatataaactaatcagcctatataaacacaaatataaccagtaaaaacaaacaaatcaaactcatcataagtataagcttttagaaaagactgttgtcccaactttgacaaaaaagtggcatagtacatcatttgaaattcaccatactcacatggatgatgtcaccatccccgccctcagactcattgtccatctgttaggaagaggtgcacccaccacaggcagagcacagctacaggcccacacacacttatgccgcactggagaaaccgacctgccagcccagctcatctccttgtttcttgaattacccagttcatgtatgagaacaagaggaatgtgatctgaaactccccagttaacaagctgtaaaactgcttgacgcctgccaggctgtgcgaacaaaccaaggggcaggaggtgagggcaggggcggtggggtggggggttgcattctggaagagtcccagggtttcctctgcatcccttcggtgagcttagtcgcagtaccttagtcacagccaggtagctgccgttctcccattcccaaaggacaaatgtactaggatttgttaaaaagggaaaaatcctctgcatctagaaccaaatacctctctcatctcttccctgatgggagtaatcattctgcacctcgagattgacttgatgtcttaacttttgcattggatgatgttacctatgttgggagttacatcggaaccggcacagtagttgtcaacttcagctacatgggaaaattcatggaagaagcttgaaaaaatgtaggcacccagctgacattcattattgaatgaagtcataggataagcttctttctattagatttttgccccagcactcagatgacctccacaatctacagacaacccagagaagtgggagggttctatcagtgagttacaccgggcttataccaccaaataactggctcaactggactcagaaaatgggctgttcatttgacttggtgtcaggctgaaaggaagcagcttcatccaccattatgtcaagacatagacgagttcagaaattcattgcaccgtaggttattgttgagccacatggaattaaagggcttgcccaaagcagatacttctctggattttgccaagctaggcagtcacacttcccccaaaaagaaaagtagaaattagacaaaaataaactttatagcactagaaccaattttaatgaaccacaatcatgatacggatttagtagagaccataaaatccacaggacaaggtgcgatctccacttgcctttggtcaaagctgagaaacaaagaaccggaagagctcactccattgtgtcctgttttctatggagagatgagccccccttcttctcttcctgtgaaccagcttgaatcggaggggaacgtgtaactatgaggttcagatcacactggaacacagcgtggtccatttatgctcagagtccgccaggtggcatggacttcagacagcacagataccctaattaccatgcctggtcttgcggttcacattcaccgtccttcttaaaagtggggaagggggccaggcgcggtggctcatgcctgtaatcccagtactttgggaggccgaggcgggcggatcacaaggtcaggagatcgagaccatcctgactaacacgccacggtgaaaccccgtctctactaaaaataccaaaaattagccacacgtggtggcggacgcctgtagtcccagctactcgggaggctgaagcaggagaatggcgtgaacctgggaggcggagcttgcagtgagccgagatcgcgccactgcgttccagcctgggcgacagagcgagactccgtctcaaaaaaaaaaaaaaaaaaaaaagtggggaaggggaaagggagccttgtctctatcttccggggtaagcctgcgctgctgggctcctgacaggttccatagactcctcttgcagcacctggggtgctatcttgtcacagcttataacctgctccagagcctggctctgagcaaaattgctgaggctgaaaaaagacagtaatgcaactcaggctgctagggtgttctcactgacaggactgcagattctgtttggctgaccacaagttacaaagatgaagacaaagtgcgagcaattcaagggccagcttgactagctggtaaaacgagtggcaaatgtactaggatttattaaaaagcggggaaaaagattccctgcatctacaaccaaatacccctcccatctcttccctgaagagaaatgattctgtaccttgaggttgaccggatgccttaacttttgcactggatgatgttacatatgttgggagttacttcagaatcggcacagtggttctcagcttccgctgcacgggaacgttcatggaaagaaatttaaaaaatgcaggtgcctagcttgcaactgcagagattctgacttcactggtccgcggcaggattcctgctcttagatttaggtaatctgagagttccccccaagtgattgcagtgtacaaccatggtaggcaccgctgcttaggttgaatgacatcagcagaatgttttaaatcaacaggtttcatgagtttgagatggaagaattgggtgaggtagaacccattaaaatagttaaatgggataaaaaaaatcagaaagttgaaacaatgaaaggcagatgtgactttgtaatcatcaggacatttagatttgcccaagtcccaatacaattccctccctgtgaagccttagaaattcctcagaactgtctttagtaatagaggcatgcaatatgattggcagatgaatttacagggaggagtttgagcacgcatggaaaacgttctgattttgttgtctttgagatgctcttcgatgtcacagaaggaaatgtatgattagtgtcggtgttcttgtcaagagatggctctcttcctttcttaggggaggaggcaacgacgagctttccatgtcccattggagttgttgagagacagggactgacaagatcaataattgtttccaaataatggggcgcattagcagcttcccagggtcatgctaaggtgacaggtgggggcagatgtggacagagacccggaaggatcctaactaaaagggaactcattatgtgtgatggtccccttgccagccataggagacatttctactagccttggttaacctggagccacagtgtgatggcaacaggcgctaggccatgttttgagttagtgtaatttcaaagtgtacagtttaccaaatttgaacttttttttaaattttattttttctagtctggcttttgcaagtgactctgacaaaatatttctgcattcaaatatctggcatttctataacaatttgagaagcttggccttataagaaaatctccaccaacacctggtgtatgttcatgtgctttataaatattaatttcattgaattgaaaagccaaaagtctgtttttatgatataggtttgttttcttgacttttctccaaaattattactagagtctcattttttaaaaagtctgacaggaacatacccaacatatatttttaagtaatacagcagaagaggaaacaattagaaatcagagtgtgtagcatgagtaagtgtaaatataatttcctgaaatcttcatttcaattgtgtgtgtatgcaattagattgtaaaatttattattgattgattgattgattgatttttgagacggagtctcgcactgttgtccaggcgacagtgggcgcgatctcggctcactgcaacctccgcctcccgggttcaagcgattctcctgcctcagcctcctgagtagctgtgattacaggcacctgccaccacgcccaactgattttttgtatttttagtagagacagggttttaccatgttggccaggctggtctcgaactcctgaccttgtgattcacctgcctcggcttcccaaagtgctgggaaggcatgagccaccacacccagccgtgaaatttactttatactgtggaatgtaagtgaaattctgaaagctattggataatggcgttgtttagaataataaccttatagcgtaaaccacaaacatgaagtcagccgactactgcgatgtatgccaagcacaggaatctggagaagtacgagcctcctggctccccactggactttttattggggtgctagaccagtggttctcaaagtgtgctccccggggcagcagcatcagcctcacttgggaaattcctagaaatgcagattctcaggcatcctatcccaagcccaccgaatcattatctctgggggtgaggctcagcaatctatgttttaacccttttcctgtttgctttgagaatgttctctggcagcgcttgcggctgcagtgtttactccggataattttgccacgaaacatctcacttttgttactgtttttgcattgttctagcatatcgtctttggaaacaaaagacatcattctatttacagcattctggttttagtagttgtatttccatttacaaaacatagtaattctcgatcgctgaaaatgtcaaatcctagaaaacgtagcattcctacgcatgatgttaacatcgttcgcaacagttgttgaccaaagattcattagatgaattaaattttcccaaagtagatgattctgatgttagtaacaagaacagtttttatatttcactttcaaattgaaaatcagatttgcttcagcttcaaagagcatgttaatataaaattaaatgagcattgacggcaagctgcatttttttcctaaacaggaaaagggttgagcctcgcaggtggttctcttctgatatgtggcctctgagagaatacctggccagccaggtatgaaggtggaccatgacctccctgtctcagctccaggcctgcgcaatatccatcaatcccataggcatttaggcctagaagctaatcatgatgggtgtttcttttgtttgttcattcgttcgttcgtttgtttttgagatggagtctcactctgtcacccagacgggagtgcaatggcccgatctctgcccactgaaacctccaactctgggttcaagtgattctcctgcctcagcctcccaaatagctgggattaaagacacgcaccaccacgcccagctagtttttgtatttttagtagagatgaggtttcaccatactgatcaggctggcagtgttttcttctttacttctgttgctgaagtttgtaactaactttgtgtcaactgtttatttatttatttttgagacagagttttgctattgtcacccaggctggagtgaaatggcatgatcttggctcactgcaaccttccgcctcctgggttcaagcgattctccagcctcagcctcctgagtagctgggattacaggcacccaccaccacgcccggctaatttttgtattagtagaggtggggtttctccatgttggccaggctggtctcaaactcctgacctctggggatccacctgccttggcctcccaaagtgctgggattacaggcgtgagccaccacacccagcctcaactgttacttgatcaacccttaacagaatgtggaagttagtgaattgctaacgctgcccttggcctgctatttcccagctggcctctctgtgcccagcccagctctgagctgccacatgtcccctgcctttcaaagaatccaccttctggcctgacttttctagctaaattttacaaaccataattcctagctttcctattttctcagaaaaatgtccaccaggtgtttattcaggtgtctcattgttataatccaataaataaacacatcatattcatgggatagcagatatatgcatttatttatttatttatttatttatttatttatttagatagagtctcactctgtcacccaggctggagtgcaatagcacaatcttggctcactgcaacctccgcctcttgggttcaagccattctcctgcctcatcctccctagtagctgggattacaggaacccaccatcatgcccagctaatttttgtattttttgtagagacagggtttcgccatgttggccaggctggtcttgaacccctgacctcaggtgatctgcctgcctcggcctcccaaattgctaggattataggcatgagccaccacgctgggctggatatatgcatttaatagggactctttgatgcctgagggctcatgttatcaattgtgaatacaagacaggcctatgggaggggtgtttattttttgggggggaggggggatgggcagctggatgggagttgagagtggtctcatgttcatcaaatcagcccaagtagatgattgatttctctgcctcagtcagattttgtgacaaggtaaagcagtagattcttgagtagttgataaatgatattacaatcttttctaaatttaaactcttcgttgatctttgtcctgtttgtataacctttatcttttttgaaaaatgttagttcagcaactgtttagtttaattagctgattcattaaacttgggtggtggctcaccaataaaaaagcatttgaatgtttgaatgtcactcagagctcttcaatttctttgcagaaatactcaacctagattcttttaaattctctacctcagaacctgatagaatacttgcatatttttactgatgatgtttcacctatacttaatgtaataagtaaacacactacacgagaagtcattctgtaggaaagtgagtgcggatttctaattacttaggcacagctagtttcctagcctgacaggtgtggaaacacctttcacactcgaagcatgcagaggcttgcatgagctcacctgagcattctgaggagcctccctatgcagttttggaaccctctgtttgattcaaaggtctgctcctgataccagggaggttttagctttctgccaaaagaaatgctctttcatcttcaaatcaaatgttgaagtgggccgggcatggtggttcacacctgttatcccagcactttgggaggctgaggtgggcggatcgcttgaggttaggagtttaagaccagcctggccaacatggcaaaaccctgtgtctactaaaaagtacaaaaattagccaggcatggtggcaggcacctataatcccagctactcgggaggctgaggcagaagaatcacttgaacctgggaggcagaggttgcagtgagccgagattgtgccactgcactccagcctgggagacagagtgaaactctgtctcaaaaaaaaaaaaaaaaaaaaaaaaaagaaagaaagaaagaaagacagaaaaaacaaacaaaaaaatgttgcagtgaaaaaatatcacctcctcctactctcaggatggtacttctgcccattctcctgagtaggctcaagcttctgaaaggagagaaagtgggagtggttgatatttcgtgactctcactggcgaaggcccacttgcagactggccctgcatcccgctgtcctgaatgcacacgtctgtgtgccgtgggatggcctctagagcgattcctccctgaatccctgcaacagacacctctgagtccaggcacagcaggatttcaggaaccagggaggagctggccaggtgtacacccgggcagatacctgtgacccgtgatttcaggggtgacagaaaatgcctcttttccaaacaccaagcaaaggaaccaaaaccaaatctacacaaacatgacctttccctgtaactctcctgattgctttcatcctgtgctttgaaacagggaaaatgcgtagacataccgggaagccagaggggccgtcgtcctggttttatgatgcgggcaggaggaagttatcaagggccgtccctgaaaacaggctttatttggacagtgtgagggatgtaaagaggagaaaggcagaccccagagagaacaggtgccctagcagagatgagaccaccccccggggagtggggagagcctcaatcagagtcccttactggaggtttgctctggggcagccccagtggaggttgctgcctgctttcatgttgtcggatcacattctccaggcagaaatggtttggaggatcctgggatttgaaggctggtgctcgctaatcatggctatgcatgaagcgtaacacagggcggtttgagtcatcttcctcggggagttttgagaggaacctaggatgccttattaggaatgaggttattgcagagcatggattttctgaaagacaaggcaagcacatggccatctggtcagcactcaccgctccctcccctgccccaccatgagtcgcccccaacacgcagtgcctgtgctgaacacactgtgcctggccgtgcgtgggcagtcacttcctagcccagctcccagactggggtcgccctggatgacagcatcacccttgtgccttgttcatttacctattcagatatgaagtcaagatactgtgggtgtccagagatgcttttttaaaaattgcttcctggggaataaaaaggaatggccattaacacattagttgacatgctcaaaatttaatttgcaaacagaagccaaaagagacagctaaaacttttcattggaagcaattaaaataggaaagcaacgggactgaacagttgatagtttgccagtgcaggttctgctctgtgaggcacgtccaggaccccctgcatcagtgtaagtcggcatacaggggttagagtgcaccatcctgggaatgcatgacacataggtgtgcttggttacagaccagcttccccaccacccaggctgaggcctttgcagacagaaatcaaacctacctggattagcacagccctggggactgaccctggaaatggagttcgcgtctcttcccctcttggcctgtctttatcactcacagctcagttagtgcctctcggcatctccttcctgctgtcttgccctgcaccatccgcttcctctctcgttttctttcttcctcacattctttcatttaaaaaaaattccaagtatgagcaaaaaataattttaatgggatgaatacactcaattatggtcttagttgtgtgcttaaagggagtaaacttagaatgtgaagagccagaactagaaggttcacagtctgtgtagtctcttcctaattaattcatttttctgtaagggccagccttcaagaaaatgtagaaataacgatttaattctattttattctttttttatttgattaataattactcaattagatccccatgactttatgtaaggagaggccatggtgtttgcttcgtgaggcggttgtgaggagccatctctgtgaacgggctcctggccgctgaggtgcatttcacaggtgctcatgctagctccctcctcagtgtgggcttggccttgcaaatgggcacaatttgcactaaatgcagactcctatggattttgcaggtagattctagtttttctgaacaatttttgcatttatttctgcatgcgctcatttaaaaattgtgttgttgtagtagagcatgcatactaacattgaccatcttagccatttttcagtgcccagttcagtggcatgagggcatttacactgctgtgcaggcattttccaccatccatctccagggcttttccttatcccgaacggaaactgcgctaattcaacacgcgctccccattccctcctcccgcagcccctggcacccaccattcaactttctgtctgtgagtttgatgagtctaggaagctcatctcactggaatctgatggtatttgtcctttgtgcctggattattccgtgtagcataacatcctccaggttcatccataggttcatccttgttgtagcctgtgtcagaatttcctacccttttaaggtggtgagtgctaagttttaaactgattgccttataagccaaaatgttagaaaccagcctattttcacacaggaggctgtgcttccagaaatctgcctaaccctgtcacgttgctgtgtcacgccatcaggctcttaatgagagcacatgaagaaaccacagattttggagttagacagactccagttggaatcctagctccacaaccacctgctgggtgaccttggggacattatttcatgtttacgagattaggacaggaatagtaaatacctcatagtgttttgtggatcaaatgagctaaggtttaaaaagtgcttagctagcaagggggagaggtcagcttcctaagtgtctgccctcccctggagtgtggtatcatcactgtcactgttgcacgtgagccattttaaggaaaaggtgtgtttttcaggttatctttcctatgccaagagccataggagtgcattgacacgtgcagaccccgcaggaactgtgcattccccgatggcaaccgtgttcactcatgcttctgtctttcccctccacactttgagagaatgggctgacattataggttttttttttcttttctgtttattttttctttttctgttttttttctttttttctttttttttgagacgcagttttcctcttgttgcccaggctggagtgcaatggcaccatctcagctcactgcaacttccgactcctgggttcaagcgattctcctgcctcagcctcccaagtagctgggactacaggcgcctgccaccaggcccagctaatttttgtatttttagtagagatggggtttcaccatgttggccaggctggtctcgaactcctgaactcaggtgatctgcccgcctcagcctcccaaagtgctgggattacaggcgtgagccaccgcgcccggccgacattatagttttaattaattctttcaacaaatatctctaagtactcattatgtgacagacactttgaaggcgctgtattgaagcataggaacttggtcctgagcaaatgagggacttaatgagagcacatgggcttgcaaaccgtgaacccatctcagggactggaaggctctgacaaaagaggagcgtgagtcccggggaagagagggcagacagttctggatgtggagggtcaagaaacgcttttttgaggaggtgacatttgagcggaggctggcgtgaaatgggggagtggattatgaagagtgccaggggaaatattccaagcagagggaagagcaaattctagaacccttgagtggctatatgcctggcacaccccaagggcaggaggtcgaccacaatggcgaggggatgttggcccgggtggaggggtaggaaatggagtgaggcaggacccggaaaggcaccatggctgcagatttctatcagctgacctttattcactacggttttagtatgagccttgttacagatgaaatgttgtggaggtcctaacctccactgtgctagtatttggaagtgaattatttgggaggtgattagggtgagatgaggtcatgaaggcgtggccccatgatgggatcagtatccttataagaagaggaagagacgccagtgctttttctctgtctccatccaatgtacagactcagtgagaagggagccatccacaagccaggaagtgagctctctgcaggaacagaagctgccggcaccctgacttggacttccagcctcagaactgtgaaatgtctgttgtttaaactactcagccattggtatttcattatggcagctggagcagaccaacgcaagccttttattctccaaatgattctggtgacctctcaagacctttctctatgacgcccgccaactttgtaaataaatcctaccctttcatgaatggacgcagagtgaggaagagtcacttccttcacactcaggagcacatatactcacctgctggcccacctcgaggggcccagctaggtcagtgccaggagaggcaaggttggtgcatttcacattacccccactgaccccaccactggtagctgcctgggccccaccagccttcccggaaaccgtgtgcatttgcacttagccagacagcacacggtgagaggcttatttgctcatatggtactttcaagaatctgcagcattgggtaatttgctggccatgtggagattcccatgtgcggggaagggctgctgggctgaggacctgagcagatggtggtcattaatagcaccaacatgtgaccagctgtaattgtgctggaaggactgaagccactgatggttgctccgtactttggttctacttaaaaaatacttttagcaggacataattcattatacaaggcagcattagcaaagaaatatcagactcccagtaagtgccattttcctacccctgtgttttaacaagtattcctggtgtttagaaatacatagtctctcagtcatcgtgtgggtaaaagtgagaagagttgtttttctcagtggatcaagactaagtcttatgagatttgaaatctagaagctctgctaaaattgcatatagcaatgcctgtgaatatgtgaaccgaatgagaaacacatttgtgtcctagagcagaaacttagattcagctctttatacacacaatgacccctcctggttaattgacttgcaatggtagtttcaggtatccagcagtagttctggctacagcagatctgtctacccactgcctctaaagctaatctctccagttaatagcttgcagcctgggcctcattaagtcaaagaacttctgcccatacaataggctgtaatcctctgtattagtatgaggtaatttggctcctaactggggaatttttctcgtctaataagaggagaaattgtttggtacagtagaaatcatatagtttcccagcatttggctcttggagaaagtcagggattctgtatcctgttccttacctctggagggattcttaagttgttttgggtatcttacagcaaacacttttagtgacaaacaagtcaaattaataataataataaaaaacctaacagttgttgactactgcgtgcttaagaagagttctgagccattttcttgcatgaactcataatgcccacaacaactctctaaggcaggtattcttatccacatgttgcatacgaagaaactgaggcccagagtgattaagcttcatttaaaaagcgtgaaatggggcagtgagtcatgaacagtgccggaggaaatgttccaagaagagggaagagcaaattctagaatccttgagtggcaataagcctggcacatcccaagggcaggaagtggaccacaatggtgagaggatgttggcccacacagagcggtaggaaatggagtgaggcaggaccagtatcgtaccagtgctaagataaaagcccaagcagtctaatttggagtccagactcttgatcattgatatgatttggctctgtgtctccacccaaatctcatgttgaattgtaatccctagtgttccaggaaggaccaggttggaggtgattggatcatgagggcagtttccttcttgctgttctcctgatagtgaatgagttctcataagatctgatggttttaaagtgtgctgtttcccccttcgctctctctcaccctcctgcttcactgtggtaagacgtgccttgcttccccttcaccttccaccatgattgtaagtttcctgaggcctccccagccgtgtgaaacgtgagttaataaaatctcttctctttttaaataaattacccagcctcagttagctcttcatagcagtatgaaaatgggctgatacaatcactattcaatatagcttctaaaacatacatttgtattatagcatgctagaccaggctgtgtgagccacttgggcactgcatggatttgggtgagccggggaagatgtcaaccccactgtcagttgttatgcaaaggggagccttgtcttcatcctaagttgaaatcttagggactgtctcttctggacataatagaagtgtgtcctgtgtccataattgtaaataaacttactggcatatagaaacagtgcctggtgagctctttttgaggatagatgctaggtcttctctttcattctcaggacccagcacaatggtggggccactcaaatgtttttgaatgaatacatgccatttttttggaagctgtgagagtttatacatcatttttcacctattgccagacatttgctgtctccatatcttactctatacatgaaagcagaaagtagaataagccattgtatgatttcagagggagaagtgaggaaatgggaggtagctgtgtaaaattagatataaactaccatcaaaaagtaattgatttaaggccctcttaaaaacacattgtcttagctttggctgctatgacaaatgaccatagactggatagcttaaacatcaaaaagttgagaaaatttatttcatacaattctggtggatgggaagttcaagatcaaggtgcccacagacctggcactggagaggagggctcccttcctggtttgcagatggctgccttcttgttgtagccttacatgtcagaaagagagagagaagagaaaactctcctgtctcataaggacactaatctcattcatgaagcctctaccctcatgacccaattaccttttgtattagtctgttttcacactgtcataaagaactacctgagactggataatttttgaagaaaagaggtttagttgactcacagttccgcatggctggggaagcctcaggaaacttacaatcaaggcagaaggcaaaggagaaccaggcaacttcttcgcaaggaggcaggaaagagagcgagtgaggggaaactgccacacaattgtaaaccatcagatcttgtgaaaactcactcactatcacaagaacagcatgggggaaaccacttccatgatccaatcacctcccaccaagtccctccctcaacgtgtggggattacagttccagatgatatttgggtgggaacacagagccaaaacgattcacctctcaaaggctccacctcctactaacatcacattgggtgttatgatttaaacatatgaattttgttgggggacacaacattcagtccataacacatgtgttgataattacaactcggttccaagaggtgcctccataaaaggtcacagagaccccaagaacagagctgcctagagttctattgcagaactccagggttgcagcaattaattttacatctaaaatgttgctgtaagaatttaccccacaaaaattgatcaatgggatcacttggacacagggcagggaacatcacacaccagggcctgtcaggtggtggggggctgggggagggatagcattaggagaaatacctaatttaaatgatgagttgatgggtgcagcaaaccaacatggcacatgtatacatatgtatcaaacctgcacattgtgcacatgtaccctagaacttaaaagtataataattttttaaaaaaagaatttaccccacaaaaatgtgggagatgtaaagagaatagaaagcttgtctttacagaagaatgctccctaataaatatagaaagcattgtggatatagaaaagcatgattatgcaattcccaatatcataattgattaaaccaaaaattagtgaatgctaaaaattattgtcatagattattggggataagatatccatagaatattcatgtgtaatttcacagattcttattagtttaacatgaaaatattacctgtctaatggagaggtctagtggacacaacttaagccaatagccaaactaagcattgccaatattgggtcaaaatatgcgcttcctgatatgaagccatctgccacccaaaatgccacttatgtacaattactgcccaaaatgtttaagtgaatctaatcatgaggaaacaagcagagaaatccagatgtgggcccttctacaagataactggcctgattcttaacatcaaaacaaaattaaaaaacaatgtcatataagcaaaaagaaaccaaccaaaaagtaatgaggttgaggggagaatatactaaattgaaaaaacacacacaacattaaccttaattgtttcattgattaaaaaaatagatgcaaaagacattttgaaaaaattggggaatttgaattggggctgaacacctgtgttgaatgtattaggtgtggtaaaagaggggtaagagtagggttgtgttagaataaaagaaggtccacattgggaaacacacgctgaagtattttggggtggtgtttgcaaattattttcaaatggcttagcaaaaagagtgtgtgtgtacacacaaatgtgtacatatatgtgcatatagagggagagagtggaggcataattgtagtaaaatgctaacattggcgacatctacatgaagtgcagacaggtgttcattgtgttctccattcagcttctcctggaatttgcaattctttagcataggtagcatggggcaggtgggaggagatcatacctgtgcacaccaggtgaatcccagttgggaaacggcaggtgagtcctggggacatatgtgtctctgctagagcatccttctctttgctccagtgctatggggtgcagacgggggacatccattcatgcttttccttcttcacacattcccctggtacctttttgctggcagggaacacagtccagtgtctgggctgcagatccctcatggtcagaagaggggtttggtgagaagtgggagactggttgctagtcctgtgagtgcatgccagaggccatctccttggttcatccctgtttccccagttctgggcacaacttgcctgtgtttgccaggaatgcatagcttatctgagcttcctcatggggtgagtgggtgaggagagatggtgttatcatcaactgtcaaagctggaggcttccagaaatgacactgctgtccagggtggatggcagatgccatctggactgtctcatctcagtgtgcaggcctctagggacatcctgccctgggcgtggggcttctctgccatgagggggatcctggtgctgtgagtgtatcacaggtgatgtggcaaaggtgggcgtgggcaccagatacagacatttccagtgggatctcgttgtactttcatacatgtcactgccggactctgtggtcttaaaagccatgaagccagcccaaggacccttgccgctccatgccaggcagcctcctggccccgtctgactcgccttagggggtgccttttactccgttgtgtacaaagcattttgaaggaagagaaggaactaacagttagtgttgtcagtattctcagaattttggcaatatcccataataagaaatctgtttgatcaactcatatacacctacacatgtaatgcctctatatgggtctgtgtgtacatatcggtatgtatagctgtgtgagaggatctatagacatatgtgtgtatgtgtgtatacacatctataatgtatgacaaaagtttcatcagaccatccgtacgctcacactttgatgtttactaacatcaaagcattagtaaatcagtatttcttaatgcgctgcttgttactggtttaggctacttatgatccgaaaaatgctggtttcagcaacacggaaaacataaaaagataattatagaacagggttaggaaaccaattctgtctgatgtgtgtgtattattacatgagagtatttgtatgtatccatgtatgtgtctgcatgtgtgtgtatttccatttatctttgcaatggtgcagggcaactgtgggtctgctgccattgtgacttgtttctgtcctctcctgggccgggcccttcaaaaactgtggagggacatttgtcattggtgtccgagcttctgtgctatttctccagaggggtcatgggatgacacagagaggccctgtgctgcaggtaaatctggaggacagcttgcgcccagggaaattacatgcaaaccaggttttcctgtcctcttgagtggggcttttttctttcagaaacccccctttttttttcctttttttttttttttcaatgatctctgcagaagcagcagcatggggctcaaatttgaagtgagccgcagatgcaggtttgcttgcgagtgactccctctgctcaaaatcgtccgcattttttttcttcttctgagacagggtctcactctgtcacccaggctggagtgcagtgctgcaatcttggctcactgcagcctccacctcccaggttcaagcaattctgcttcagcctcccaagtagctgggaccacaagcttgcgccaccacagggcatcctgtatttcaagcttcccccttttgaaatgaggattgctgacggatggtgtgcaaactttagaacttgttgtcaagatgtcagttgaatcttaattaaccattgaggcagcctgggagatacgcctattctggtaggaatttttattctttcaagttcaaggatttgtccttcatcattttccaatccatgggatggtaacaataaaaatagctaatagctaacaaatgtttactctgtgctgcgctcagcgctcagcgctcttcatgtgttttttctcctttatttgttagggaatgaatgagctcactagttgccttcttctgccataatttttcttccttgttcacatgtggttggtggtatatattttagtattcctttttgtttgtttgtttttgagacagagttttgctgttgttacccaagctgtagtgcaatggtgcggtctcagctcacctctgcctcctgggttcaagcgattctcctgcctcagcctcccaagtagctgggtttacaggcacgcaccaccacgcccagctaattttttgtatttttagtagaaatggggtttcaccatgttaaccaggctggtcttgaactcctgacctcaggtagtccgcccgccttggcctcccaaaatgctgggattacaggcttgagccactgtgcctggccaatattccttttaaaatctcaaacctgccaaaacatacaggagggagaattattagctcatcagattcagtatatcaaaatgaacctgctgacaaggtggaacataattcacagactacagctgttattaatgtgtgactatttctggcaaggcccagggtgcacaatcagaaaactattaatatataacaggctgaagtggaaatgtgaatgagccaatacttggaattcctatagtatttacactaactgttcctctgcccttctgaactgagtacttcgcaactcataaaatacaatttcctgttttccactttgcagcctcttcacatctcctatttcttctggctcctctaattaatggaaacacttgcatttgagttcgcatcgatttgcaaaacattgtttaatatgagaatattttcaccgtcgagggcatgttgattattcctaggtgtaaaacattctagtcaaatttaatataagaaagtaacatgcattgtcaataattacatgaaaaaatatggtggaagatttttttctctgattaatgactcaacagttttaaacatgtgttagtgggctgggcacagtggctcacgcctgtaatcccagcattttgggaggctgaggtgggcagatcacctgaggtcaggagttcgagaccagcctggccaacatggtgaaacccagtctctacaaaaaatacaaaaattagccaggcatggtggtgcgtgcctgtaatcccagctacttgggaggctgaggcatgagaatcgcttgagcccaggaggcagaggttgcagtgagccaagattgtgccactgcactccagcctgggtgacagagtgagactctgtctccaaaaaaaaaaaaaaaaaagtgttaatgaattctttaaaataatacccatctcttcgattcatgaaaggattctttaaactcctctgcaagagcctgagtctgcccagcatcacggtgatggcctccatggtccctcttgctcagggagcagctgctttgcacctgggactctgcacgctcaccccattcagtctcccgggtgctccctggcaggtgcaccatcatcctcatttgatggtcgagactggagcgctaagagcgttggtgcacactggtgggacccaagctcaggtgtctgtgagacaaggactctgccctccagtaatgaggaaggtggcatcccctgtccctcaggaagattattgtttatttgaggaagtgcggtgtaaagacctgaatcaggaaaggacaagtcaaggcattgtggcatccaatggcatcttaaatgcctctgggagaaggaggtcactgggattgagaacattcagaaaagatttgtgggaggaggctgaacttgggcagacacttgaatgaaaaggatgtggggagtggaaggagcaggcattccctgcagtggggtgctgagattcagagaaagaagaggtgcagggtggtgtcttgatgaggcactaagaccagctcacaggccgatgagggtgagatctcgaaatctgtctgttgtcacactgcctctctatactaacagttttttagtgaaaaacacagtgagaaccagataagtgagttcactgaattttatttccaaaaaaatggaaagctctagtaacgttctgcagtaacactttggctcatgtctaagttctttttttctttctttctttctttcttttatttttttttgagacagagtctcgctctgtcgcccaggtgacatttctcacaatagcaaaagtttgaaatatgagtgttcatcagtagtggaatgattaaattagggtacatatagacagtgggatactctgaaactgttacagatgatgatatagctctaaaggaaattgtctatactatattcttcagtgaacaaggtaaattagaaagtattatatagttttttaaattttatttatttatttattttgagagggagtctcgctctgtcgcccaggagtgcagtggtgcgatctcggctcacggcaagctctgcctcccaggttcacgccattctcctgcctcagcctcccggtagctgggactacaggtgcccgccaccatgcctggctaattttttatatttttagtagagacagggtttcaccgtgttagccaggatggtcttgatctcctgacctcatgatccgcccgcctcggcctcccaattttttttctttcttgcattatgcatttttcatcaaatgcttggcttcgtgccttctaccatgaagaccccacttcacagcgacacatgctcttgggtcactccgccacccgtggggttgtgaatcaagttcttcagggagagaagacaagctgacaggggtgggacttgagttctgtgcatctgtgatcagattccgcctccacagtgctgggtggtgggaggaagcccattcatctctgtgagactaaagtccctcatctgtcaatcaagatgctaaattttatttatttatttatttagagactggcccttgttgtgttatccagagtggtgtgatcatatgagatgctaaatattccctcgtgggttgtcatgaggttcagctgcaaccctggctggcacaggccatgacacttccagcaatgtacctgcccagctgggattaatcactgacatttaactcccagttgatggcacctgtgtacggatgaattcctcaaaacagtatcagaatcttacgtactcactggtctcagcgagtattcacagagaaagcaagaaggatggtatttgattactcaataagtgagtcctgaggggtcattgctaggcaggctgaggggtggtctctgcagcccctcacagcctttgaacagccagaactttgattgatgaacaggtgctttcctgtaaaaagcaagaagcactatggaatcacagtttttgttgattttttcccctgctggtagtctggtcttcatgatatcattcttccagaaagccaaccctttcttgcaaaagtacaaggtgtgctcaggaaaaatgctgctagtgccaagattcctctttccatttctgtggccctcaggtgtggacatcgctgccttattttccctaaagtgacaaacaggatcacatcacatatttaaactctgaaatcggtattatgaggtttaatctgtatccatgtaggttttatcttgttgcaactgtttccatcctctcgcatttccagtgcccccatattgaccaggagcaccatctaggcatccgtttgtgttcctcctgccccccacccccaccatgcttctgtctgtcttctccatgagtaggaggaggtcacttggatcgagaacattcagaaaagatttgcaggaggagactgaacttggagagatgcttgaagggaaaggatttggggggtgtgcaagagggggcattccttgcagtggggtgctgagatacagagaaggaagaggcttagggtggtgtcttgatgagacactaagactggctcacaggttgatgagaacgagatctagaaatcggactactgccatgtcagctcacttcatgaatatcatgaagaccagtccaccaggaggatccaacaggaaggcaacttttttaagcaaagggattctagctctccactggattaccctgtttcatatgtaaaagttaggttaactcggaacaggagatgcaaaaaccccatctacttagagaaagctgaggagaacaaaagtagcgttagctggagacatatgccatttgttggagtgtccactgagctcgtgcaatactggttgaagccacttctcacagagatgaagcaccccgtgggtgagcctggaaataaaagtgcatggagccaggctgtggatgacggaaatagtaaatggcaaagcagaggagggcttgagcatgggtgggcaggtgagcaagcgtgcagggtgcagaaaccacagctgtgagaaggggcttttccagagtgaggttacagaaagatcaagtgaggcaggacagcatgtggacctggaagagaacataggcaaggggcgaaagagtgtggaaagaagagaaaatgaagctatatagacttcaagtaacagcatcattgctctagaactaggtcattcttggtctctgagctccggacaaattctgaagtgacctacatcattcatagaggcagaaggaggctaccattcattccagcaagcagggaaggctttcttgatatgtgctggtcccagactaagcctggaacacagtgacacacagtccttgccctcagggaactgaaagactaggaggggagggagtcatgtccataaattcaaaggccatagttgctgcaagatggcaatgagatgctaggagactataggtgggttttctagccaagtcttgggagaattcaggaaggcttcctggaagaggagacatccaagccaaggctgaaagagcaggagcccagcaggtgggtgggcccaggccatggacatagcatctccaggaggatcatgtgatccacccagactctcatctatgttgtttgcttttaccatgtagggtccctaccatttattttctcatatgagtgaagctgtctccttcaccagcccccacattatcatgtactgttttcatccagtcctctacagcctccccccaaccgagccccacagcccctgctgccaaagggattactgtaggctttgggacattctggactaatcccacgttcttcacccccttttatgtcagtcaccaggagaagctggtgactaaccacagttggtagctctttgtacgccataccttccccgactttctcttctgcttattttttctgtttcttgtttcacaatctgacatctcatgtgtctggaaggtcagctccatgaggtcaggaattgcctacttttttttttcaactgttgtacactcagcacctagaagagtacatggcatgcagtgggtgctcaaaacacagtgattgtgctgagtgcaaaggctcagcctgtaatcccatcactttggaagaccaaggggggagtttcacttgagcccagaagttcaagaccagcctgggcaacatgacggaaccccatctctattaaaaatacaaaaaactagctggatgtggtggtgcacacctgtagtcccagctacttgggagctcgaagtaggaggattgcttgagcctgaaaggtcgagctgtaatcacaccactccagcctgggcaacagagtgagagaccctgtcaaaaaatatatagtgattgaatgaatgagttatactgctaaatggtttaaacaattatctaaacattgtttatgttcttttgagactttgaagacattgactttcaaatccagtagtttccaaatttaatcatcagaattacttggagcactttttaaaaatgcccaagtcttccccccaaaactcttggagtagttacttcaggatatgcgactctgagattttggttttgattcagatataatccaggcattgggaccattttgcaaaggagagagtagaccagagataatgagtgcattatctctgccagggtctgctggggagaacctgccctgatgcccaggccagcgtgctctggctgcctggcttatgtctaacaggagctggagggcatgagggtgggacgctactgttcacatcacagggaagatgtgaatgggggtggtttggggtggagcgttgaccaggcttttaagagaactgtgggtttatgcctggtaatgataaaggaaagtagatttcaggtgcagaaaacatatccgttgtcatttaagtaaagttagaatcataggtctgagataatttaatagacttttccatttgtcaaagatgtatgtcttatttcccagtgatctctttccttctcaaatatacttgctactacaaatgacattccaagagcccatttcagtcccctgagcgttttgatttttctttcgagcagtagacctgctgtagtttaagctggttgggaaagctgtcgttcaccttgatggattaccgtccccgcagtgagcacccagtctccagaaagttcacggctccctcaccttatgtatctgatttatgtagaaacgtcgataaattagttaggagggcattcttgctgatatcagcaatcccagagcacctgggaggaaagcagagtgaagattttgaaagtcacaggcgatgtcggccactctcctgtgtggcccaggaacctcacacaatgataagataaggaagtttaatggatggtgctgccttctgaaagattaatcgtgccttgaaatctagatattttcatttcaggctgaaaacagtaaattagaaattaataaaaaggagatgatttcatcagctcaacaagtgcttctgatttcaagaagttttccttaaattttttttttcactgctgaaaaaaatcagtgtcttgataattttatgaagtagcctgtaattatttcactatggctttgcatctgagaactgaccatttgtgttttgaattcatgtcaaacaataatatattcgatagcattttatgatttattttagtgcctaaatatttataaaacaaaggcagggttttttattttcaaatttatgagctagataatgtcttgaagatgtacaacatagtatactaattttccttgcattctggcagtcctcaaaatgtaataggcaagtttattcttagacaaaagcccatttaattaaaactcacacgataactttcatacatagcaattgaattattcctaaaaggattaaatacctaagctttgaagttggatgggtgattattacaaaagccagattaatacaattgacctaatttctagtcagtgacattataagcagccttgtaagaatagctgttactacaaatatgcgggtttgcaatgttcaattctaaagtggtctaatttgttcttactacctgccagaatgtatgcattcaagtgggtgtcctccatgacagctttaattggtagtacaatggtatgagtgtggaaaggagctggtatttttcctgtttattcattaattgaacaattgattggtcatctactgcatgccagttagcttattaggggctcagatgcaagtgggggaaggtaataatcaacaaggaaatatctgtcatgtagagaaataaaggaaggtagggtggagggttaaagtaagacaggttcagtattccactggggatcagggagggctctcacttaagtgaggtaggttgaccatggattacctgggggcagagtgtgctcaagcagcacctgcaggccacagggaggctttgagttttgttctgagtgagattggaaggtgttggagagtttgagttttttttattctttgagattggaaggtgctgggttttattctgtgagattggaggtattgagtgagattggaaggtgttggagagtttcaagcagaaaaactgtaagatctgcagatgttttaaatagatgtctctgtaaattgtaaaactgtaagacatgggtaagaagcaatcattttcaggggtgagactgcttgtaggacttcacatgagcaaacgccaggcagagtgtggaacctggacccttcaaagagaaacgcaggtggaagaagcagcaaggaggaacggggcttagctgggccatcgccgccgtcttctctggcactgcccctgtgttttccgttcagagaaaagcctttcctagcattcatgacccccatcctgtatcatccaggttccacacggtcctcttctgagagaccctcccgactactcctgtgcccgttgccatgccatttgttggatcacttgcaggccccgagtctcaaacacatgatttatcatcagatcgtacagtcgtcagaagggtcccaccgtttctaaccatgtgacctgggcggttgctttacttctccgcacctcaatgtccttgtctgtaaaatggggcggatcagcccacctactgtttgggattaaatgaggtgatgtgcataaagctgtcagtgccatccctgggctgcagcgggcgttctggaaatatcacagattaccatcactgtccgccgcgcggcatccgtatgcccttgattcatacacagtgccacgcgtgggggcggttctcagtcagaaaataccaagagcagccgccgcatcttagaatttgctgtgttttactcagtccttttggggtgtcagcattttgttttctgtgtgttggcagttgatcggtaatttccaccgatgcccctgtacctcctccatccccagtcttcccagtctgcatggcttcaggtgtcacttctgggttcatgtctgctaaatttatgttggtagttttagactctcctaatcccctacttggcgttcctcatcattggtaggcacatctctgaatgtgcgtctttccagacccaaattcagctcgtcttaaactgtactcctcttaaaacctatttctccttaattcaggttacagggaacactgcctcccttagtccatcatttgggcagcttcggtcaataaccctcccctgtggttcctcttctctcagatttcatcccctctgtcctgatgaagcccctgcttctagcctctcaccagctcctcttgttcatcttggctatagatgcttatcagcaaagatgttggttcttcccaatggtgaggataaagtgtgggtgctgatgaaggcaggatagtgacctgatgtagggttctctgggtaaaacacaatgtttaggattcccctctagcacaaggttgctttaggtctcggagatcagtgcaccaagagaacagcaaccagcagtgacctctcctaatgacagtggtcatactagtatgaccatattaccagaagaaagaagagaggttgttttttaaagcactggagattccatgtcagaaaatgtgctattctggccgggcgcggcggctcacacctatagtcccagcactttgggaggctgaggcaggcagatcagttgagctcaggagttcgagaccagcctggccaacatggtgaaaccctgtctctactaaaaatacaaaaattagctgggtgtgtggcacacacctgtaatttcagctactcggaaggctgagacaggagaatcgcttgaacctgggaggcggaggttgcagtgagctgagatggcaccactgcactccagcctgggtgacaaaagagagactctgactcaaacaaacaaacaaacaactgtgctattttaatagatattcaactaagaaatgggtgggtgtaagtgatttaacctgaacccatctcagcagaaacctcagttgatgaactttttcttttctttttaaacccactttaagaagaagtacatgacaataccgcagcccctggaggttatttcatgcaggtggagagtggattcaccacatcctccagctctgagaccggtgttcagtgagaggtggttgtgggctttgagtctgtgagatcttcagtcatccaagttggattttgtttatttgacttagggtagatgttggaccaatacctcgtaggaaggtttttgaatcgggagttgaagcaaagcagcatttcttgttagtcctcagttaattagaaaattaaattaactacaatcctcattcccagagctttctgggtaattgatgtcttactgtatttggattagagaaggccccaggaggcacaaggttataattgtgtagaattagagaatctagggaagaaggaatggcaggtaatttgcaaaatttcaaggcagggggccctccccaaagtcccatggcaaaggcattgcttggtgagcacgcggggctgggccagaggctgcctactcgggagacatcagctgtgggtcaagagctacttaaaagagaattcaggagatcaaagtattgtcttccaccattcatcagaagaaaatacatctagatttaaaccctggaattagactggcttgatgcttttaatttgcatttaaagtcttaaactttttcttcttccaaatatttaccattttctgtagtccttttaagtatttggactagacttatttagaaatgtacagagtgcagaacaatgtagactcttgagtggctaagagtctaaacggctgaggaatgtagatcatttttggacttaaaatgaagctttaactgcccccaaatggaggacctccttttctggaagcaaattgcaatctgaatgctctgtgctaaagcttaaagcatagcaggagaaactattagaatttgtatagtagcattgccttggacgagcctagtgcaaactgagcctggtatgtggaccaagtactgtttatgacttttctttaagcataagttactcagggaaagtattatcaaaacaaatttggttataattgtcttcagacttgtttttctgggacttgggacttaaaagaggggagtaggctgtggataagctttggagttggcccacacaatggagattgttcaatttttttttttttttgtcctctcagacccagtaactttgggatttttattgactacttttttctccaatttttaaaattatggtaaaatatatataacataaaattgtccatcttaaccattttgaggtgtataatttggtggtattaaatgcattaataatgttgtatgatgattaccaccatctatctctgcaactcttttcattttgtgtagctgaaactctgtacttactaaacaatctcttcattcctccctcccccaatcgctagcaaccaccatccaatgttctgtctccatgattttgactactcttaagtaccttgtataagaggaatcatcaagcatttttctttctggactgccttgtttcacttaatataagtcctcaaggtgcctccatgttgtagcatgtgtctgaatttccctcaatttttagtctgaatagtattccattgtatgtgtatgttacattttgctcatccatttatcagttgatagactcttggtttccatccatgttttaggtattatgaataatgctgtataccagaagtggaattgctggatcatatggttatttcatttttaatattttgaggaaccatcatactgtttgccacagcatctctatcgttttacactctcaccaacagtgcacaagggttcagtttctccacatcctcactaacttattttctgtttgtttgtttgtttgtttttaacagtagccatcctactaaagaggatctcattgtggttttgatttgcatttccctaatgattagtggtgttgagcatcatttcatatgctatttggccatttgtgtaccttttttggagaactgtctatttaaaagttctgcccattattgaattgagttgttttgttgtattttttgagttttagaagttctctatttgttaattccttattacatatatatatatgaattgcaaatattatttcctctcctgtgggttgcctttttattctattaatattgtcttttatgcaaaattttaaacaatttctcgaagtcctatttgtttatttttcctggttgcctatgcctttggtgacaataaatcaatgccaagaaatcatggacaaaccaaatgtcatgaagttttgccctgtcttttcttttaagagtttcatagttttagatcttacatttaggtctttgatccattttgagttaatttttgtatatagtgtaaggtaagggtctagctttattcttttgtatgccaatatccacttttcctaatcatttgttgaaagaactgacatttcctcactgaatgattttaggacttttaacaaaagtcatttgtccatatatgcaagtttcttggctctctacttaatgcattgggattgcgatagagatggtgttgagtctgtatatcactttgtgtggtgccttacttcatttgggctgctatgacgtaataccatggactaggtagcctctaaacaacagacatttatttctcaccattctggagtctgaaaagtctaagattaaggcactggcagatttcacatctgatgagggtgtgtttatcatagatggtgccttctctctgtgtcctcaaatgatgaaagggacaaacaggctctttcaggccttttgtaaggtctctaatcttatccgtgaacattctgccttcttgacctaatcaactcccaaagtccctcacctcttaataccatcaggttggaggttaggtttcaacatacaaattttggggggaaacaaactttcatattgtagcgggtagcattgacatcttaacaacattaagtcttcccatccatgaacatgggatgtgtttccatttaattatgtcttctttaatttctttcagcaaggctttgtagttttcattttacaagttgttcacctccgcggctaagttaattcctaagtattttattctttttgatgctgttgtaaatggagttgtttttatcatttccttttcagattgttcattgttagcatagagaaattcaactgaatattgtgcatggactttgaaattttgcagaatgtactgattagttttaacaggattttaaaaaatgggatccttaaggtttttatatataaaattgtatcatgtgtaaacagatcattttacttttttttctgatttaaattacttttctttctttttttatttttggtctaattgttctggctagaacttctaatattctgttgaatcaaataagtggtaaaagttggcatccttacgttgttctctattttaaaggaaaatatttcagtcttttgtcattgagtatgatgttcactctgggtttttgtatggattttatttattttgaggtagttctcttctatttctaatttcttgagttttttttttttttaatcataaagcgctgttgaattctgtcaaatgctttttctgcatcaattgagattattacattgattgctttttttaaagtccttatgacttcggaagagaatatacttacgaattgttatttttgaattgacctgatttaactctccagtcactcaaataatggcacaaataaaaattataacaatgattatgtgcttactatgtgcatgacactgtgcaaaacaattcatgttcattatgtagttactactcaaaatacctcctaggtaggtactgctattctttccattctacagatgagaaaccagggctgagagatgttcagtaacatgtccaagccaccaggccaggaaatagtgggactgtgatttaaactctatttaactcctgtgcctgcacttgtgagagctgtgctacacgtgtggacaggacccttattctaatactgtggagtggaaaggaaggaagaaagggagggagggaaataagtataatgatcctcttttcctataacttcagagagagtaattgtccagctagcaccttcctgaaccaagggaatgctatctcgtgctcatattgaaagaaagataaaaagacaatcggtgaaggattgtaatgaagattaaaggagcctggagcacaactttggtttccctgatatttttcattacacagagttattacgtgttagagcacacacaaagtgtattctcggccaggcacagtggctcactttgggaggccaaggtgggtgaatcacctgaggtcaggagttcaagactagcctggccaacatgccgaaaccttgtttctactaaaaacacaaaaaattatctgggtgtggtggcatgcacctataatgccagctactcaggaggccaaggtaggagaatcacttgaacctaggaggcggaggttgcagtgagctgggatcgcgccactgcgctccagcctgggcgacagagcaacactccatctcaaaaacaaaaaaagtactctttttttgcagaggaagaacattataataaatgatgaaatctatgaaacagaatgaaatgggacctgcttttggaataatctaatgaaatagattattttaaataatctagtaagataaattagatttataagataaatttagaagataaatgtaaaattataagataaatttataatataaattagatttataagataaatctaataagattattttaaataatataaaataaggtcaaaatgaaggcacttctgatgttttttttcatgagcattaagcagtgcgcaccaactgaactctagtataaagtggcttaccagaattataaaaagactgcacatgttcaattttaatctatatcttatgaaaatggtaatggaagagacaatctgcctgagaaaggaatagaagaatcacattttagttttaatttctcattgataaacctcctttagaaacgagagagtattctagaatcgtccaattgatagaaaataatgtatttccccaaatgcaatgtctttgttatgaagtcacacctgcactattgaataaaatattatccatgttgtgtgtgacatgatttcagtagaataaattatcagtgaatgacccacaataaatcatatgcctccacttcatgctgttaacacttcatgctgttaatacttcatgctgttaacacttcatgctgttaattcacttctgatggggaagctactcaaattccgatggaaatgttgatgttgcagcatttgggatgagttctaatatgtttgttcacttttaaacactcctgagatgtggatgaagaagctgaccagcaggtgtgtgatacatttgtttgcgctgtgctgtactgggaggaaagaaagcagcaaaggtgtcttctctaataaacaccactctttccccttctagatctccaaatctttctaggtcttggtgcctttgagcctttcagtcaatcttttaaataaaatggtttccaggtgtttattcgtgtcaatttaattttccctaaaaatacatttctagatttttacccaaccactgtgatgccgtaaaatatggcagaattctgggcatggtaaaactgttaggaagaatcagagcaccaaccctagatgtacataatgcgtcagggtgtgaggttgagggtgttaatgacactatattgagacagtatattgagcatctgtgaggcacaggcagtcaccagatgttgtgcatatgtagcttgttagttttgccaatacctctgtgaggtactcatttttaagcccatccctaaaaatgaggaaaccgaggggcagataatttaaataattgcctaagatctctcaactaattagtaacagaatttggattcaatccaagatgatcttaactctaagcattagcatgctacaccatcacactgccagatttacctttgagattcatttgtaggttgtatgcagtgatagtatcgcctttgttcatttgcacatcaaagacttcgtgaccaatctgaacacccttgtatttgggcaccaatgtgatcataagaagaaaacgttatctgccatcatcctatttctttttcctttctattttatggtcatatttttttctccatttcaagtagagggacatccttcatattttctctctctctctctcctggttatgctgttttcattttgcaaagtgaaacacacacaactagcagaaaatgaggtgtgccaggtgcattcacacatcacttgtctcccagagtaccagactctggtgtctcagaggcgtgattctcttgaggggggaaattatgttttgcagaccttgttcatttatcacttctatctatctcagacgttcttttcttaaaagaagcaagactcaggcacactgaaggtcatttccatgggacacacttgattgcttagaaaaacaaatttgaaaaatactttcttcagaaggaaagatattgtttctccagggtaaaatatttctgagggcttgactctttccaatgacgcctttatgtaagctgttggagcagggctcttaattgataagcagctgtgttaataattcacaatgaatagcatatttaaaacgtcaacccagtgttgattcttatggcagtatctgaggcgagagagaccaaagcaacaatgacaatgaatctttagattctggaaactcaggagaagccacactatctctagagtcaccaccttccttttttaaagaaagagggaaggttcccctctccaaaggaaagtttgcttcccaggtaaccgtgatctttgtgacctattactgatttcgtttaaacagagtctttatgttcaaatgcaactgtgtggtaaaatggccccagaatccagacatctagatcatgcctgtaacacttttcttaatttttgtatttatattggataactcatgcaatttttcaaagactccattattatttctataaaatgaagataatcttacctacacggttaacctcgcagaattgttggaaagatgaaatgaggcagtcatatatggattagaaattggaacctcctaaactccaatgccaggtgttagtttctttacatctttcttgtagtcaaaaaaaattctgggtaattgttttgagcagttatattgagaacatcctctgagaaaagaactgtgtgcatcttgccatggaaaagaagtctgtctctgcacgtaaattacctgatagggcatgagagttactgcagagaggtggatgcatgggagaacgcaggggtgggggagggacccatcagttggtgccttctgttctgccccatttggggtgtgcactttaaatggctaagaaaggatatcatttctattcaggtggagggtaggggtgcttcatggaagagactgaattttaacttagtcttgaataatagatacaatttactgaaatatgtatatatgaaaatatccttcaagggaagagagtttgccaaggtcaaacaggccgagaagtctaggtgtgttgggggaaggctgagaggtgcaccttggagggagtgcaggtgtgtgtgggaggagcatagagtcttgctggacagagacctccaggggcatttgaatactgctggaaattatttggtgtgtcctggaggtaagagagaccagggagcagtttgtctgtgcaggaagcagtggagtgtggtctgcatgccctggagaagccaaggcctgagggctctccttgcgggagacgcctcctgactctcactggccacagcaaagagaggtaggtttgctggctggaagcataaacacagccctaagtgccacatctccccagagatggcgtggagttcctctgagggaggacatggctccacgccatgttttgagcacaggtgaggcagtgacttatgagggacaatgaaaggtcaattcaagctttaggaagtaggtttggacccaagaatctttttaggtgatctctgaaattatgatcatgaatgagatcatgaggaaaggctccttggatttcccactggggccattttagcggctgcccaccagatgccatgattgactatgttattctttttatttggtgccaaccagagaatcattttatccagttcagatctcccattagtagctgatatgagtttggtttagaataagaaaactaactcttagccagataggcaagcatggaatcacacatacacatacaaaatacacctttggagatagatatttgcaggtaattgttttgaaacaaaatttttccatatattttgtaaaattttaaatttctcattgtatgacattttattataacagaaaagaaccatgaattcctcttaatgaagacctttcttgtcttcactgttattatcctaaagatatttatttagcatttggtgtagtgtaagatgaattgcacagctaatttaaatgtattactggctgggcgcagtggctcacacctgtaataccagcactttgggaggctgaggagggcagatcacgaggtcaggagcttgagaccagcctggccaacatggcaaaacctcgtctctactaaaaatgcaaagattaggtgtggtggcatgcacctgtaatcccagctactcgggaggctgaggcaggagaatcactcgaacctgggaggtgtagggtgcagtgagccaaggtcatgccactgcactacagcctgggtgatagggtgagactccatctcagaaaaaacaaaaacaaaaacaaaaaaaaaacaggtattactggctgccccctttggaaacagtacaccaaatttactgtgcctgattctaagaatagaaaattgaaggatgccttagagaagaaatagagacattttaaaataatgacaactttggaaaatagcacccagaatcccgtggcttaactttgttcagtacaaccccaaattattgatttatgattttttgaccctgagaaaagatgcagatgcagagaaaagatgtagaaatccctccccttcccctctcctcctgggagccacatagggtatgaaagtggtagagatcctttctgctgagccaatagtcgtctttaaaactctgggatccccttccttacaccttatacaaaaatcaattcaagatggattaaagacttaaacgttaaacctaaaactataaaaaccctagaagaaaacctaggcattaccattcaggacataggcatgggcaaggacttcatgtctaaaacaccaaaagcaatggcaaccaaagccaaaattgacaaatgggatctaattaaactaaagagcttctgcacagcaaaagaaactaccatcggagtgaacaggcagcctacaaaatgggagaaaattttcgcagcctactcatctgacaaagggctaatatccagaatctacaatgaactcaaacaaatttacaagaaaaaaacaaacaaccccatcaaaaattgggcaaaggacatgaacagacacttctcagaagaagacatttatgcagccaaaaaacacatgagaaaatgctcaccatcactggccatcagagaaatgcaaatcaaaaccacaatgagatgccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccagacgactataaatcatgctgctataaagacacatgcacacgtatgtttattgaggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaatttggaaatcatcattctcagtaaactatcgcaagaacaaaaaaccaaacaccgcatattctcactcataggtgggaattgaacaatgagaacacatggacacaggaaggggaacatcacactctggggactgttgtgggttggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataatactaataaatttaaaaaaaagaaaaaaataaaaataaaaataaaaataaaactctgggatccaaaagacagactcagtgatagtttcccaatactgttattgggaaagcaataaggctgaataaaaggaaagacccttaaataaagtagaaaagatttgcatgtgacaaaactggaagcagagaaactttaaaagcacatacattttgttcaaggaacaactatagttcttagtctcagagggatttaggcatttgcccaagattatgatgtgtaaaacagagatgctaatagctaattatcagagttatttatatgactgtgtcaggtacctgcctgaaaatgctcaacactgtccatcagtaagtaagagcaccagagaatgactgtctcttttctttgtggttctaacgtgtcacccacgttagttccctggactcagcaggtcgccaccgtgaggccccagcatttgggtccatcactggcgatgtgctgctggcctcagaatgtctgcctctgactatgcaggaggttgctgtgtgatagagtgcgggggaatcaggacaccgcccaccgctgtccaaatgccaagtggcgattcaggtaccttaggaggaaaagggacatggtgaggactggagttgcggtagatgcctcctgggtgttgaagagtccgaaggatccagaatggcagagaggggaaatgggggcagccatgcatgaagacaggctggggggcgctaatgcagctttctctcctggagcctctcatctccacctgctgcggaagctcctgtgcatccaactctgggctgggaaagcaaagagcactgggcaatcacgcctttctctgctgtctgcacgtggcgaaaatgaaagcatttcatggaacctgtttggggcacgtgaagagtgggccagagtgccagggaggcagcaatctgcaggttgcgttcatgccgtgacagtccattcaggggtgcaggagctggtagctgagttccccttcctgttttacacttctggtcttttggttctcaatacctcggggtgtaaaggacagctctttatttggctgtgaatatccaccactgtcttcctacttctctttctttggaagcatttcatttccttttctagaaaatttggagctgaagtgctcggaaggccactgattttaagctcattaaactcacattcacctttgtcttttgttgaaaaaagttaatcttgttttccaaagggccacaggaggatattgtatggatgttatttattgtccttcacaaacacaccccagagattagctcattataggttttattcaacaaagtaattattgcagagaggaagctgagcttttagtgatggacttggaagtgatgggtgaccactctcactggactccagatagaaacagaaatcaaagccgctgtctaatcacacttcactcctccctctgcataggactgtaattggtactcaaggagaacactaaatcaaagatctcataaggcaaatattagcagcatgtatcatgtaaataagaataatgatcagaagctacgcagaggagggactattgtgctcaaaagcagtggaagaaatcataaaagaaagatccataaatgttccttgaagacaacaacattagactttataaaataccacacagaaaatcagaaaagagcctagagaaaatatttaccacaaataagaaggattaccatctttgagctacgggagtgcccatatgaatcaataagaagaaaattacaaaggccaaatgcataaacagccaaggacatgaagagatgaatggaagaaagagaaaataggaatgatgaccaggtcgaccagaaacattcaacttaaccagtaatgatggaaattcaaattaaggctaaaaggagacagtttgcttataaaatcagtacctatttcaatagttgtgattcgataaaatggactcctctcaatacttggtatggctgtaattggataaaagtgttctggagaggaaatcaaccttatgttgcaagagcagtaaaaatgttgatatgctctgatacagaaattccacgtctagaaatttattctaagtaacattatgtacagacccaattacaaaaaaaaatgcaccagtatgtttatgatagcaattttttaggttgtaaaaatagaaaaagacatccattaaaaattatgcttagaataagtttagtaataataacaaatgtgttttgtgcctatgtgtgccaagcgtcatacctacataaatatgtgtgtgtacacatatacgtatgcaaatgcatatatttatatgtatgtgtacatttctatgtatgtgaattttttttcatttgatttttcaccaaccctataaagtaagacccattattatcccagtttgtagatgaagaaactatgacttggagagtttattagctcaagcaacaatcatacacccattaaattacatagcgcttcctccagatcttcaggtccagatccagtgaaaaggaaatgatactaggtggaaatccctgtggtttgtttttggataaaagtttcccaatactaggtaaagatgttcaggtttaaataatgttttgtgacgtgcatgtactggtgttttgcttgtttttccttctagctacacatgaaaataaggatattttccttgttactataaaagtattacatattcctttaggagctgctttcccccccttgtttgtcgtctcttaaaaaaagcattttctaagcagactgagaaaggagtctattaacaagcaaattgcatttgtgagtaagctgaagtgtagggagtggtatttcccactggggctctggaggctcagctccccagtgcagtggctgaacagggccaggcagtgtgaggggactggagctgggcactctgctcagggggtggacagagaagggaacctgggaaggcccccggcaggcaggactcagaggctctcaaactgctctcagatctgcaggactggcttcccacaactctgttcatcctcctccatcgcaaaatgaatatgtaaaggttttccttttacctgccaaagacattttgggaaagtaatgtgaagatttgtactttgtgaatggactcatatttatgtgtacaaaagcatgcagcagtttaaggaatcctatggtgaatactctgatacagaaggaagaattatttgaaatgcgatgcgtaacataaatgacctttcaactgaagttaacttagatactggtacattaagttttctaagaaataaatataaataaatcttatattaatgctagctaaaggcaaaccgggaggcatgctgtaaagtctatgcaaaatctggatgctcatggagaagattcttgtcaaatgtcatgtattattagtataggtagtctcacccttctaaaaaaggaaaccagaagtttgccagccaacctttaaattttgaaaaggtaagtctacagtgtgcttttcatacggttttcaaaagcagataaacattctcttttattaaacacacttctcaatttagtcatggtttgtggaccaatgttttcttaaattatttcataataattttacaacactgagaactggctgtgaaatcaacctttgggaaaaattaggagtagccgggggatgcacacacgcatgcacacacacacacacacacgcacacatgcacatgcacacgcacacgcatacacacacacacatgcacacatacatgcacacacatccacgcacaaatgcacacacacacgcacctgcacacacacgtgggtttgcatgctgacttgacatccaatgctaacagttcaaccacatttatggtttcataaatacaatgaatcatgagtagacctctaggtcaatggttctcaaagtgcagtcttcagaccagcaccatcagccttctcctggaacttcttaggcaaattctgaggacccattccagactgagtcaaaaaccctggataggtcagttattccttactacctttgcaaaacaccattctgttttagctcatggtgatcaaataaagagcaggatgaatgccaagatagagtatatagaacacctgatatggtgttctttggatcatgaccacacatctgttcccagcaaaaaggaattgtgccaacaggatgcatcaatgcactcctaatcagtgtcacctgatcatccactaatagctcaggcaaacatcagcttttccatcagtacacaaatcagtcattattcttgcctctcatcttagtgacagtacttcattgccccagcctacttgtcaaatccattgtcctgttaattttctccacacactccagggagataacagaatctctgggtagcagaccccatctcatgcctctgatatttataattgtgctgccaacctcctcttccaactagaattcctccccatgtttaaatttccaatttaatttcaagattctttgagaagattcctccaagtcttccctgttctgaaccatgtataactcttctgcagctatcatttggttcatcatggttcccttcatgaaaatcattttatgcatgtaatatcttaactgcccaaatgttattgaaaaagttttgagaggaagaactacatctcacatgcctttgtatctttcagtgcctagccactgtctcaccacaagaagttatagtgttttctttgatgcctttaatgtagatgtagattttcgctacaacgattttgccaggatgtgtttaaagatattcacccttggtcccctttctgcagttccttggatcatgaaagatgtgtttggtttggttggcccttacagttcattttccttttgaatcccaatttaaaattttggatttttaaaaaatagaaataaaacttatggctttctttaaaataaaagaagacttagaccctaagtctgcatttttataggagttgatgaaagtttatgcccctttgaggagcatgtgaattccaggctgccatggttctcagcacttcctaatataccgtgtccaatatggagattgagttctggattattacctgcctgtagtactgattttcttagattggagaggattctccatcaggactgccaggtttctagcattggctttgcaacttactagctttatctaagcaaccttgtgcaagatatttaactttgggaacagtaatgatacctaactcataatgttgttatcatgagttaataaagtccttaaaaccaacctggcacttactgagtgcgcaagaggtatttgctgttgttgtcataattattgttagaaatagtagtaatagtaggaaattcaaatgtgggaagtaattctagttggaggggaaggttggcagttgtagtaatagtatttactaatgtttcaaggtagaaaaatgaaatatgaattaggaaagttacatgttccaagaaaaatgggacacatttattttcaaaaataaagaatgttcctgtattcaatgtgtaaatacagtgttttggtctcaaggagactataacttaagatgtcagctaatgtcactgattacctgcttgatttatgttgcttcattaaattcaagttagaaaagtgggttcattcttgatttcttttatccaaatcctactatcagttttatgtggttattgtttttttaaatcttttcaatatatatttttatattggaataatgttagatttacagaaaagtttcaatgatagtacagacggttcttatttaccccttacacaatttatctcttgttattaacattttacttttctgtggcacattagtcaaaactaagaaactggcattgatacacggctattaactcaactatagactttctttggatttcaccagttttcccatgaatattttctctctgttccagaccctaatgctgagttccccattgcatttgcgtgtcctatctttccagtctcctctggtctatgacagtttctcagtcttcccctgttttttttttttctgaccttgaatcatttatttatatcaacatttttatggattgaattgtattccccccaactcaaatttatatgttaaggccgggcctggtggctgatgcctgtaatcccagcactttgggaggccgaggctggtggactatttgaggtcaggagttcaagaccagcctgaccaacatggtgaaaccacatctgtactaaaaaagtaaaaaaattagccaggtggtagtggtgcatgcctgtaatcccagctgctcggaaggctgaggcaagagaatcacttgagcctgggagggggaggttgtggtgagctgagattgcaccactacactctagtctgggtgacagagtgagaccctgccaatttatatgttaaaattcccaatacctcagaatgtgactgtatttaaagattggtcctttaaagagataattaaattaaaatgaggtcatatgaatggaccctaattccatatgactggtgtccttataggaagagattaggacacagccatgcacagagaaaagaccatgaaagtatagagggagaggccaccatctataagccaagggcagaggccgcagatgaaaagagtcctgctgacaccttcatcttggacttctagtccctagaactgtgaggaggtaaattactgttgtttaagtctccaagtctgtggaatttattatggtagccttagaaactaattcaagtatggactcatataagtcatctttgaacttttcattacaatccaattctatgttgtttatatcgtggctcaaatgattccagctttgacgtggtctccctctcatgttggttcctctgtcctcttagcatgtacctacacttgtgatttttgggcacttttctgatactacaagatgttccaggtttgttttgttttttccttgccctggcgctaaaatcagttatttctccaaagagtgaggttccttttacttgtgaatggcattaaaaaaccaagacctatggtaccaggttttgatccctgacctgtggcaccactttcaacataccatggttctgtagcagtgctggctgggaggcttaattcttgcctgttaagcatggccttcagtttggaagcccagtcgctctccaaggtcctgattttgaaaggcttttctttattgtgtgccaggaaagacagaggagaaaatagacaagaacataacatttaagcacaggtacagtcattctctgttcttttcacatttatgatgctaataaaagaaggaagatatattacatgagttaaagaaatttagaaatgttagaatttaagaagtagtgcctgtctctttgcaaatccatttcttgaagaggacaagtgagcctctttaaggagaaaattcaataagatacgtggaaacagagcttacataacttcagattttcctaacatcgtgtcttagggatgacagttcaagagaaaatgtgctaaagctgtgacttgaagggtttatttagatatgtgcatttcctgacaggcgagattagtggattctggaaaaagcaataaaaaggtttacagaattttcttctaattctgctgataaacagatgcaaactggcttaaactctgctgggattaaaatatttccgattcagtatttcatcaggtataaatgtggtttttcatccacatttcatttatgaggcagatgaaacattgagatctttttgattctgtgcatgcatttgatagtacacctccttggataaccaatattatgatatgcaatactttttttctacatttctctaacatgctgatctgtggagataggtggaggaggtagtgcttgttataattaaataatcacacattagttttcactaaggatctttcatcgaaggatgttaagagcaaaatggattctgcattattgctgcagtagatttttaattttactgttaataagcattaaagtcccacagcatgcaatattttgtttcttcccttttaaagaattaaatttggtgttttcccttagagcttgattgatttgctagattaaaaagcatttaaaatcattgtttaacacatggaaaaacatattgattgttgcagttctttataaagaaaaaagtacagtttggttccctgaaaaatacatgaattcttttagctgactcttagaaattaagacacatgtatctacaagtaggtttgggccaagaatgttccctgccccaactccgtgaaaaatttccattacatcagatacttctaggattgtatattcccttggaagatcacaaaggacatccgtctccacctttgcttaaacctaagtgatctttataaagaaaagactctttaatgtttagtagagatgtcacagaagtagacatatattagcatctttaaatgtctgctcagatttttcgtaactctcattgcattcatcctcctcttcaattgttaaaaattatagtcaattttctaaatttcaagacaggatctcactcccattgcccaggctgaagtacagtgtcgtgatcatggcacttgacctcctgggttcaggtgaccctcccacctcaccctcccaagtagctgggaccacaggcatacaccaccatgcccagctaattttttatatttttagtagagaagggatctcactatgtggccaaggctggtctcaaactcctaggtttaagcagtctgcccttcttggcctctctaagtgcggagattacaggcatgagccacagtgcttggcctcaatttttatctccctagaatatttatgattctttctgaatatcagttgcaaacccaaatctatatgataactaatcttccagaaattctaccccacaagacagagtcaactgtatacatgaagacatttatgaactctgttttcttttaggctcaacgatacttcttggcatatttttaacttttgtttataggccgttattaattttgaagtacctggtattgcttgtgtggaaataaatctgcattcgagtaattttaactctatgatttgggcgctaataatacttattgcaagagcatcctgaagtagtctcgggctaggtaattcatctagttcatcctcttcgtttcaggaaagtggatttcctagcctattcaagcagctatcacaaaataccccaagcagggtgtggcttagaaacagcagaacttgacttctcaccattctggagaccgagaagtccaagatgaaaatgtatttggtgtctgctgaggggtcactctccaacttcaatagcacctccttgtcaagtcctcgaatagtggaaggggtgagagagctctgtggggtctcttttatcagggcactcatcccattcaggagggttctgccctcatgccctcatcacctcccaaaggccccacctcctaatcttgggggttaggattttgacacgtgggaaacaaaaacatttgcccatagcaggctgctgggacagaatacagttcaggggctgcaagtccaaagccaggtgccagcaaagtcaaagtccaaaggcaaatgaacccagcagggctaatctccagcaaagcttctctgcttggcttgcagaggccagcttctggctgggtcctcacctgtcctttctgaatgcacgcactcttttggggtctcttcctcttcttttaagaacagtgccctattggatcaggcctccccacctcatttaaccttaattgccttcttagaggccccatctctaatgcaatcacaatggcagtgggggctagtgcttcagcatatgaattttggagacacaattctgtccataactgtaggtttttggttatctctggaaatggaaatgctttactttctaatttcccacaatccagagaagcaatatctttttttttcaactttagaaatcttttgaagttttgcattgttatacagcacttattcaatgccgcccaatccgagtgacttcatctcactcgacgacctcacctgactattccctggcctctgccctgcccagggcacacactgtggcaggtgagtgcttgtgcatgggcacacaaggcagatgcctgggtgttctgggcgtgctttttgcctgagatgttccatgacctggtctggtgtctcacaaagcctcctcatgagaaacacctttcttagggaaataccttgtgttgctcttttagaagattccacatgtggtccaagaggcatcagcatcccctgggagttcatgagaaatgcagctcagacccccatcccagccctcctgagggagaacctgcacttcttgagattcccccactgacctccaggcttaggaaagtgagagacacgctgccctaaagtggtcctcggtatagattcaaggcagctgcccaccccagtcatccaattccttgggctatcttaaattcttttccagtctcttctacttagtttaaataaatcaagtcacactttttctccagggactcatttccctcaaacactatatctgatgtttctgcacctactgggtttttatgcagttatgcagagatcacaggctgtttctatggatctttgcatattgcaggaatctttttgatagtgaggtaatttgtgctgaatcaaaaggctgacatgcaaagagagtatggtggcgtgtactaaaggctttatggtaatttttgttccatttcaccatcttttattcatatgccattttgatttttctagagcgaatatataggatattatctgaatccattttctcaaagctacgttttaacaacatttagtttgggacatttatttcgtattgaacacacaaaatgtttgctaaataaaggcttcaaatagcaacccctcccctgtttggtattttttcattgtttatcattggacttttagaagtgtaaataagatgtgtgagtcaaattctttctttgtaactgcttgaaaaattcagtaaccaattatttataataattggaaattaaatgagaatcaaaattcccagtgagtatatggcaagtttgttatttcctttctaccaataatgaatgataatgagtcaaataaaagcaatttgctttttcatgaaaagtagtgatgattattttaacaatcacaaaatgctttcctgaacatgttcttttatcatttctgtagtattgaactttaaaaaaagatatcattgagaataagtgaagcatggaacctgtaaattgcctgtttttgaagccatcgtgtccatcatttttagtgagagaataatgttctgatatctccacttgacatcttagactctattgtgttataacttcccacaacttgccaaagggccattctaaacttttgctcttcaatcggccatcattacgggaatattggcttccaatttttgtgtactaatatgaatttggctcatgaatgttactactccgaccaacaaaattcaaatgctccacaaaaagagaagagcctgtctagcacaaagatcttttcagcttttgagtttcctcttccctatcaatcatggggtttaatttaaattaaaaaggaaacattctttcaagatacatagtgtgaatcaatcaatcaatcgtacagtcttcctttacctaaattaatcacctttataatccttttagtggttcttgatctcttataggatacaatcaaaattccccatcttgatatctaaagcttcttaagctgaatcccatctcccttatcacttctttttatcatctctctctctactttcctttacacatattctattccaaataacctacatgttataccccaagccttactcagtcattcctcagagctgcgtttttatctgtggttacaaaacagatctgctgtcagaccagtcctgacttgacctttctgtgaggttgccatcaggtgtcggctggggctgtgtcttctgaaggatagggctggatagggctggaggagcctccacctaactgtcccccttgtgtggctgtcaagttagtgctggccccacacaggttgccgaagggtgctcacggcatggtgcctggtgtcttccatagagatacacgagtccaaatctgaagctctggtggctttggtaatccagcctctgaagtcacacactgtcacttccagtatgttctgcaggccacttgtagccagccctgatggagtttggaagggagtgagtagcaagaggcctgggtcccaagggtcatcttgaaggctggccactgcagggcctttgtccataccaacaaagctcaccctggcccatctctgcatgcttccttccacaccctgatagatccttcttcctctaggagccttcctgacccactctagattgaagcaactcaccacacacctgaaaccctttagcacatactatctagaccaagcaggtggtacatgttatattcacatgtagaagactcatccctggttgagtgacactctagataaatcactcaaggttccagctcttaaaagattaccttccatatggtggtatgaacagagattccctaatgaccactactcagaattaagaaggtaaaatatgccgcatataatatattcaattccttcaacactgtgtggctttggctaaagttaacttgccttcctcaagcatgcttaaatttggtgtgagtagtaggtctgtggcaactttgcagagttttgtggagaatttcctattacaaattctctaggttgtgagctctgcggtacaagtggctatgtgagactaatgagacattaagatcctgtttaaaggtgcctgtgggtccctgagctatcttgggctcccttctgaataagcaaaagggattaacttgggctcagtatgatgtaggttaaattttgacccagcagttgaactcttttagaagaataaatctattgatagtagcgttgggcagtactctgtcatctagaatgccccattttctggccaggctggagaagtgcattttcagtactggaaagctgagtcattttccccgttacagattgagttggacacctcctttgaggcatccaaaaatgacagggatttcagatgaagcaaggctagaattgtactcgatggacttgaacttgaacctgcagcttctcaccctccctgctacaacccttgtgttggagttgcataacttctgggagaaccatgccagagagttatagtagtccccacttatcctcagtttcactttctgcagtctcaattacctgtggtcaactgagatccaaaagtattaaatagaaaattccagagataaacaattcataggttttaaattgcacactgttctgagtagcattatgaaatctcacaccgtcctgctccatcctgctccgtcctgttctgggacatgaatcagtcctgtgtccagcatctcaggctgtgtacaccaccctcccattagtcagcaacatcatcttctgacagccaaccatggacatcatcatgccgatgattcaggatcacccaagcagatgatcctgcttctaacctattgtcagaaggtcagtagtaagctaacacaacacgatgcctgtgtcattccccagacttcatctcatataggcattgtatcatctcagatcatcacaagaagaaaggtgagtacagtacaggaagatattttgtgacagtgagagagagagaaaccacagtcacataacttgcattgcagtacattgttatacatgttctattttattattaattctaaaaataaaatctcttactgtgcctcacttataaatgacactgtatcatagctatgtatgtataggaaaaacagcacatatcaggttcagtgacatctgcagtttcaggcatccactgggggcatccccttggcgtgtattctcccccaccaaggatcaggggagcaattgtaattctctgctaaattctagtctgtcaggatacttagtgtttacgaatttgaataaatatgagtaaaaacgaattatagaaatgcggttttcctgctttcaagtgcaaacattgacctcagtggacaactcaggaaacgtttctagatccagcttctaggaggcctgtggctagctggctccctctgtatgcaaaccattcacatgcaaaatctcttgagcaattcctgtctaaaaggggctcataggctccgtgaaatcatgtttacagtttcaccttgcttaccaaggcctttttggttctagacaaaaagtctattacaacccatgtcaagctgtgatattattcaaatcactggagtctgatttcaatgatcgttttctatgcacagcttcaggatactcagcctatcacccaggaggtgaatgaagcaagtctgaggtgtctgggctacttgactttcgggtgatctcagggaacatctccccaccaattactttcaagactgactcgctgacatggaaattccttatctggaatggtttctgtctgtggttgcaatgcttttccaattttcatctacatgaaactctcccagaaatcttaaaatgtagtttttgttgcagtaggtttggggtgatggccccccatgctgctagtccacgtaccaagcactggaggtatttaaatgcacaagcccctagaaaaataatgcctgagactttctaaacggaagtcctatctgtagctcaggccattcccgtaagccccagcctgtgaaggctccctaggcacctgaggtgggctaggccctgacctgatttcatgacttctcccttgggtttttccctccccacctcccaccccgctcccagaagcgaagagatggcttcaccttctttactccctgccttgggcagtggctccaacatcttcacactctctcaagtcggacagttcattcatcttatttcctcactcccaccacaagtcagttactctgtcctttggatggtgatcatgtgcatgatggctgtgtcatgtttcccatctgcatttagtcctccccatcttcatggctactctgtgccagctactctgtgccaccctcatcgcctcttgcctaaactcttcaaaccagtgcaaaagcgacctcttatttgcttttgtaattcattcttcactgttttgccaaagggccattacaatacattgacagaatattattacccttcctcaaaatcatttgtgtctctccatggccaaaaccctttcacaagagatcactttgataaacaattaccacctgctcatagcctataatccaaccatactgggaaatgtatcctttagtagataggacctgcatttgcaggagtctttgtctcctaattttccttcagccagaaaccatctcctcctccagcatgccatagcagaacctaaaaagtctgcttcccttctaaacttctgtgtcaatttcactttctgcaggaagccaaccccaattccaccagccctgttccaaatcaggaaaacctgccccaccttgcctgccactagctctggctttggtagcatccttttgttctgttagtgttgttcacttaagttcttcttacaagattgtaaattttgaattacaaaaactttgttttattaatctttgtttctcctaagtcagccagcaaagaaccttgtttacagtaggtgcttaataaatatttaatccatttatcaattgaatgcaagcgtttcttgagtgttttttcttagattgtgcgaaaggaaagtgtgaaagatgaaaggaaatcccataatgaaataatgaaagagagtggacaggggacggctggaatagctgatgtcaaatgtacctgaaacacagctctatctgtgagtcctagagggtaggaaataacagtgacctcataagaaaccattcctctccctgctccctactttacaaccagattatattacttctgccctccttgggaaatgctatgttaaatgttatttttctgcaatttgtaatgacctttatatctgaaagacagttcctataaaaacatgagattgagaacccatcaaacaagtatctctaccatcaactaaaataagcaccatggacccttcttaagaagtgagggtctcatgtttcaggacaagcgtgttcaagtaccaccagccaggaaggccaaccagggcaaggctgtgcattccagaccctccagggctatggcgtcaggcacttgacctgtgttttaggcaattgtgagttaatggaaatgatattagcaatcataggcaatgactaatatttaccaagcatttagggaattggatcagtgactgctggaaatggaatacaagaattaatgttccaggaattaataatgatcctcagaaaagcttatggcttcatccacaggcttttgtcattttagtattaaaggcaaagcaatgaagagactgtggctcattcctctttccttgaatgggcgtttgcatgtttcaacacgctggaaggttaccttcttaaaatgccagctcattattcgtgtgaaagtgatcatacattggtattaaatgaagagtagaggcttatcattttagacatgatgggtatgctttatttacagatagtcatccttccaggagttaaattcacattgactattttttaaaatagtgctcacagcttagttctggatatgtttgcgttttccatctctcttggctgcttgagaacagagcgtccttaggaaaggacaagtcctgtgcagaatgcgttctcctttctcccacatttgcatttgcggggagaggcgtgcctgctgttgtgcacttcaccagcgacctcccacacccttggttctgccctgggcttgtcttcctttttctttccttctcttgaaggggttacagcccgaagcctgaaggaaaccagtctataaaactggtgaacgctgtctggatagagagaacagccctcgaattttgaagcgcagtttgtgtaagagtttatgggctctggatcatctgatagttctatttttagttttttgaggaacctctatactctttttctcataacagcagcaccgttttgaattcccaccagcagtgtgctccagggtgtttccaaaataagtgaaatcaggatgtcaaagagacaccagcacccccatgcccatctgcagcaccattcacggcagccgaggtgtggaaacaatgtaaacgtccattgaaatgtggaaacaatgtaaatgcctttgacggatggttgggtaaagaaaatgtgttatgtacatacaatggaatattattcagccttacaagagaaggagaaggccggcacggtggcttttgcctgtaatcccaacactttgggaggctgaggcaggcggaccacctgaggtcaggagtttgagactagcctggccaaaatggtgaaaccctgtctctactaaaagcacaaaaattagctgggcgtggtggcgggcacctgtaatcccagctactcgggatgctgaggcagagaattgcttgaacccaagaggcggaggttgtagtcagccgagatggagccactgcactccagcctgggcaacaacagctagaagagagaaggagatcctgccacttgtgacaacatggatgaatctggaaaatgtaatgctaagtcaaataagccagtcacggagggacaaataccgtgtgattccactcataggaggtatctaaagtagtcagactcatggaaggagagaatagaattgtggttgccaggcactgggaggagggaaatgaggagttattaatgaacaggtataaaatttcagcgatgggggtgggtagggcatgaggaaatacagtcaaaaaatgcaaagtttccatttgacaggaggaataagttttggagatctattgcacggcatggtaactatagttaataataatgtgtatttcaaaattgctaaaagagtagattttaaatgttctcacaacaaaaaataagtatgagatgatgaatatgttaatcagcttggtttaatcattccacaatgtatacatccatcaaaacattccactgtagcccgtaagcatattcatttactatttgtcaattttttttccaaaaaatcattatgcaaaatgagtaagttctacaaatctgctctacaacattgtgcctatagataacaatgctggcattttgcacttaaatctgttaagagagatgatcttatatgaagtgttcttaccacaataaaactttaaaaaataaaaataataaaataaggcaaagtttaaaaaaaaatgttcgtgagctctggaactaagcataccaggattcgaagtctgagtctcccaattactaagtgtgtgactttgggcacccacgtcacgtctgacactcagttctacatctgtaagtgaatataacaatgcctaattttcagcatcattacaagaagtatagatcctgccgcagggtcttgcatggggcagtaaccagaaacttgtagctactgttgtgtgactgccatactgtctttggcccttgtaagctatgtgattttagacaaataatttgcatgtcagtttctttttttttttttttcctttttttgagatggggtgttgctcttcttacccaggctggaatgcaatggtacaatctcagctcactgcaacctccgcctcccaggttcaaccaattctcttgcatcatcctcctcagtagctgggattacaggcgtgcaccaccacgcccagctaactttttgtgtttttagtagagacagggtttcaccatgttggccaggctggtcttgaactcctgacctcaggtgatctgcccacctcggcctcccaaaacgctgggattacgggcatgagccactgcgcctggcctttgagtgtcagtttctatgccttagaaagaggggattggagactggatgatctatggggagggtggtctaagactttgatgtgtatgagttgtaaagtaacataatagatccaaatgacaccaaaagcttttgctgaacccagtcagttgagtcaaacaagtcattagtggagaacggaaccagctatttaaattaaacactggcatgtgcctggtttattacagtggccccagtgcccagcatgttgtaggcactcaggagacatttatttaatgattgaaaagcatcagtcagagctacaggacatagaaagcacatttgaaacagttgagaagatgtaatgaagtaacaacttagtaaagaatggacagggtcaggaaagcaggaaaacgtggtgaaacattctgggattagaatcgcaagaagttgctaccaccctttggcccaagggagcagttagtgaaactcagcaaatgtctgtagttacagagaaagaggaaggacaggatctgtgggaataaatacctgaattctctcctgactttttgatctcttggtcaagcctcaaatctattggccaaacctaactaaaagctggagcacaaggaaatcaggttgaggctggtctgcagaggtcactcttcctagacaaagagcagatggaaaagggagcaaaaaggatctgcagggacaagtgaagaacatacagcactctaaagaagcttcccatagaagcaaatttgtgtatgtgggtgggaactaggatattttatttgtttggggatgcttttattacaggtaaaagcaataactgcatattttggtctgagatgtattttttctactaataaaattaataggctaataagggcaatgatcaccttcaaaaaacacacaattttcgctagttaatgccaggtctgatcagcacattttagatggatggatggttgaatgggtcaatgggtagatggatggttggatggatggatggatgaggaggaggtggtagatggataggtgaatgggtaggtggatgggtgggtggatgggtggatggatggatggtgagtgggtgggtagatggatgggtgagtggatgaaaggttgagtggatgggtgggtgggaggtgggtggcttggctaagttaggattgctacctttaaaagcatagcaatggtaacatagagtatcggccaggcaacaacatttagccagaaaagacagatccagagcagggtctcccagctggcttgcaataaataaattactttttcgtaattttgtcaaaaacgttcaatgtgcttggttttaatgaccaggaaatatctagctgtgttgaagccccccatctcagggggaggtattacctgctgatggttctcggcttgttgaaagttcacatcctaagagtgtgtgttgttgttagtgtgattacagaaaatctgcgccctctttctaacctgtgtcaaagataaacaaggcatgacacaaggtggtaagaacagattttaatcagcaacaactattgcaatagggaaaagaatacaacgtgaactaaattcaacttccatttgtacagcagtgactgggcatttataaaaggagaaggaaggagtggagagagttaagcaggatttagtagagtcagggaggtgaaaaactccgagggttagtcatgtgataatgtcggtggtgtctgcgaactggcaattatggaagttaggattccatcctcccacagagaccagacacagaggctctgtcctcaggtgtcagctggaacaagtcataagctcttttggcaggtgtgacttttctctggcaggcacttctggttgggggacagccagggccatcctaggaatgtgaccttgttctgttagaaactgtgctagtgtttgttcaagtctttatagaccgagcttaaggcctagttaaaaaaggattcagagaaatctgactcaagtttggtcaaagagagagtccttgccaattgttattctttaggcatttagatatctctgaatacccaaacagagaatacagacaaaaaggaataagcaaactatgttgtcaaggaacagttttattgtcaaaatgtatctcagtgatgattaatgaattggaaagttataagatgcctctattaatcacttttctaaatgagttgagttttgcagcacagctgaaaattttgatttcattgtttaaagcaaattttggaaagaactattgagtgcaagttaaagccggaaactcacagaggcaaagaaacatagaggatggtctgttcccctactgccatagactctataaagagcttgtttcacggcctttgttttcaatgttcctcctatggaaaaaataattgccagttttcccaccaatgtggacacatatatgaaaattttttgactcttcccaatcatttgtaaaaatgatactatcctctcctgtttttgcacgccattagagagatgaggtgcaagtgtaccataggcctagaaaccttgcaatgtcagctacgcactgtttatctcaactcacatacgcagatatttgttgcagattagggtgttgtctgtaaagaaagaaaagtgttcaaagaaaacctgctaggtgatgtatttgttttcgcttattgctgttacaaattaccacaaacttagtgacttaaaacaacataaatttattatcatatgagatccaaagtctgaaatgggcttcaagtagctcaaatcaaagtgtctgcagggctaattccttctggaggctccagcagggaatctgtttcctgcttctagaggcttctacatgtcttggctcacggctctttcctccgccttcagagccagcaatcgctgcctgtgtttttctaatatcatattacttgacaccgactcttctccctccctcttccacatttaagtacccttataattaaaattgagcccacgtggataattcaggataatctcctgttttcaagccaaccaattaggaatactaactccatctgctgcccagttcacgtaacgtagccacaggttctgggaattaggatttagatgtctttgggcggccttgttcattacaatgaagcaatttccatctgctgcagattctagatctagaagttgccacttgacaactgcgtgactttaggtaaatctcctgacacttaaatgcttccctggctcttctcatttgcaagttgaaggcactgtgttaggtaacctctgccatctctttcagagccctccaagtttgaggaatccttttgatcaaaggtgaaggtcatgaagtgtaatttgctttgccgtggttattgcattctcgttgattgattttttggattggatacccatgaagtcttatgcacatttaaagttaattatttcttcattatataattaaatgtagatgagtcccagtgtaaagtgtcagacggataacttattctttccaaaagaagaacagactcactcagcagcagcttttctgctctctctggaaaggaggtattgagtcgtcttagattaactcatggtcttcctgacaggattgggtatggattttaacagattacagtcatcttggatgccttccagaaactgattctaaactgcttttatttttcataggaaacacccaacaacactgcatagaaattagatactcctaaagtggatttgaaccagtaaaattagctgtaaatatcgaagcataactaaggtttagtgtcttctctttgtaggtaatttgtgcagccctaacatttctcccctctggagcttagctgtacaattctaatcactactgtggtctctgctcagtgggccatcgctcatgttttgaaagcactggctttgtccctatgtgagcttgctagttagttgatacatgcaggagtgtggtggcctcaggggaatggaatttctttcttctgtttataggttagtttggggaaaaaaatgtgtgtgtgtgtgtgggtgtgtgtgtgtgtgtgtgtgtgtgtgtgtgtgtttactgagatggagtctcattctgaatcctaggctggagtgcagtggcatgatcatagctcactgcagccttgaccttctgggctcaagcaatcctcccacctcagcctcccaagtagctgggcctacaggcacacaccactatgcctggctaatttttaaatgttttgtagagatggggtctctctatgttgcccaggctgattttgaactcttggtctcaagtgatcctcccacctcaatctcccaaagtcctggaattacaggtgtgagccactgtgcctagccaaaaatattgtgcatatttttaagcactggttggcattaagtttgagggttacagggctaaaacaaaagatgagattttactacaaaaagaacttggaggctcttttagaattggattcaactttcttcctgctatagagactatagattgcttgatttatgatgcgagatttgattcttcatgtcatcttgccaacacagccgctgcagttgtcttgttactccagctctttacccagcatactgtttgccagttgaatgttattcaagccagaagtttggcaaaacactttggtacaataaaaatatatttaagaatttaacattttggctttttattgtagtattgagtagggaatgggaaattagccaatgataggactactagggtctacattcgaaagaacttttatagcacaatcttttggtaacttatttggttgaggacgtactaaatacaaataatcatgtgggaatttggtgagctatggtaatgaatatgacgtgagatgacttcagaggagtttgcagttccgtagtagagacagacacgtgtagaaaatcctgtattggtcttcttccttgttgaccgtagtgctttcagtggggtgcatctcattagaacgttgtgattgggacatacaagtggaaggtttctttaatgtctggttcccatatcggtgagacatagccttaatgtattattctccagaggggcaaaccatccaagactattttagaattaaggacttgctgctctggttacttggtcactgttgagaggatgtgttggaatgacatagcaaaccatgagatgatggttttggaaaaacatcagccgagtaagttatttggtactctgccttaaaaaaaaaaaaaaaaaaaaaaactgagccataaatattcaaaaaagtttgtatgcacagaacacaaaattccaagagaattatttgtttcctaccctaggagtcaaaagtgtttgtttagaataatgtgtaagagtttcttaccccgcccccaggattaccaattcctttaacaatgccctttatttgtgcatcagtgctagtaggtttttcttttaatcagaaataattttggtgagcgtgtctatgcacacagaaatagctactaagatcattaatattttattgttgaaagcagttttatcttataatcacattttcatttgatgtttttagttttctgcttctctcacataaatgcatggtgtcgagagaggcacaagtatttttgtctctaatatcttaaaaattaggattaagtgcattctgtattgttttgtattcacaaaatagttttgaaaaagcttgagattaagtgaaatttgtatgtttttaaccatagtttttgtgggacaaatttacgctttatctctttggtttagatgtggttgacatattgatgcatgtattctctttattctgtaggctttctttttccttagaaatgaagtcacattcagtagttaaataatactttactcaaaagtacagtgatttgaaaataaccttcaactgtcagaagaggctgaacttgactgaaatgtggcctcctaactgaatattgcacatgaatcttaacagaagttatcataaacatttaaatatttgcacttggtatttagacattgattttcaccaataactgaatagatataaagcctatttttcttctttagccctcatgaatatcaattcagtttgttttttgtttcttctgggtgattcatagatgaatgcctagtgtcttcatttgcaagctgttcatggaaggaagccacttttctgttgcctctgtaaccattgcagggccttcaatagcagccttcagacactaggcatgcattcagcattggaataaataggatagccaagggtagctaattattttcaggttaattcctaaagagttaatttgcactgccttgcccaaaatcaaaccagcagaacattttattaagcaaggcttttgtgtgagtggtatggaagcactgaatcagttgctgtttcttttaatctaaattatcgtcattttgagctttatattaatacactggctgagtaactttgtttaaaagaaacctaggtaaattgatagttctatgttctaaattcttctgaataagaaaacagtgatctgccagatgaaaaaggcaattcagaatgtgacataacttctgttgagagatttttgttgaaaattgggaagtatgaattcttcacagactttcataaaatatttcaatactcttatttttaaaaaaccttgaaaagtcagaaatcagttagaataattgacttctaggcatagaaaaattcatttaaattttatttatcctggatgtcttcttttttagcataatacacctaaaacagatattccactaatatagagtgattgaagtattcagaggaagattgcattttaaagctataaagaacatttaagagtaaatgtggaaaacagtatgcagatttcttaaaagaactaaaaggatacctgccattcaatccagcaaccccactatttggtatctacccaaaggaagagaagtcgttatatcaaaaacacacctgcacgcataggcttactgcaaaaaaaattcacaactgcaaagatatggaatcgacctaagtgtccatcaaccaatgagtggataaggaagatgtggtatatatgcaccatggaatactactcagccataaaaataacgaaataatgtcttttgcagcaacttggatggagctggaggccattgtcctaagtgatataactcaggaatggaaaacctaatattgttatgttctcacttacaagtggcagctaagctatgggtatgcaaggcatacagagtggtataatagatttggagactcgcaagtggggagagcggaaggggtatgagggataaaaagacacatattgggtacaacgtacagtgttaagatgatgggtgcactaaacgctcagacttcagcactgtacgcttcatccacgtaaccaaaaaccacttgtacctcaaaagctattaaaataaaataaaacataaaacaaaataaagagaatatatagcctacttccttaggttttatagtcaaagcaccactgatttagaatctaaaggcctggcctcaggtctgattctgctactttacatctgtgtgaccttgggcaagtctcttaacctctctgagcttctgcttcttaatctgttaaaaaaaaaaaaagcataatttgtcttatccttgttttgatcaaatgaatgagttctgggaaatccatccagctggtcagtggaatccacgtgcgagcacagcaaggcctaacgaatttgctgacgctcctctgaccacctagcttcacagatgggtgggcagccagacctacaacccaacccacgtctgccaagtcccagcctttccattcacctttcaagggaagaaaacttctcatgtattggaaagcacagtgcctctagtgcctctctttcttgattgttggagttgggtctctcagcattgtggttcactacgacagagcatcgcttttaacagccacataaaataaccctcttgggtaacacactcaagaggcttcgtgaactcgggaggcaatctgggcaggcttacagctgtgtgacaacacaaacgctgtttatttgagtgttatcaggaagatgtgtcactgtcatggttgaatatggagaaacaggtgcccgcctcggaatggctacccaagtcaaggaggacccaaggctaatgtggagaccacgttcctccctggagtaccggggttaggcagggcttgaatgaggtgcagcgaggccggtgaaacacagcagtaccacgtgtcttatgtcacatcagcaatgcaggtcgcgctcgtcacagacatttcagatggagctgggtattatattccagtcctggcatttattatggtcaccaccagcacagagcgttcctggcctggtgctgtctggtttctggaatacaggccatccttcctgatattctaaagcctgcctcccaccctcaaagagtcagacggcaagtttccatccaccctcccagttctcagcctttgaaggtgagaagctcctcttctaggggccgctgtcagaatctcagggtttggcactgttgcgctcgcctccattccccaggctcctcgacggccttagatgcttaaacacgctgctgcctctcatctctggaccaaggctttcgtttccctgtgagtagacagcactaaggcacggggttagtttaatgatgcaagtcaactggggagccttgctgctatagagataccctttgtatgtttactttaacttcttgcatcagtcaattcaggctgttgtagcagaataccacagactgcacagcttaagcagcagcaatgtattccttatgattctggaggctggggaatctgaagtcagtgtgctggcgtggtcaggtctggtttgtagatggctattttcttgtatcctcacatggcagagagcacagagcaggctcttgagtctccttagaagggcactaagcccattcaccctcatgacctaattacctcctgaaggcccccctcctagtgctgtcacattggggagttaggatttcattgtatgaatctggggagacacaaacattcagcccatagcacttccccagccgtgcaacacaggtgccctttggtggtgtttgcataggtcatggctgctgatagccaccgtgtgttgactgcccactctgtgcttgacgctctgctagaggctctttatgttgtctttaatcctcacttcagtgctgcaagggctgtgttattcccagctgacatatgagcttccaggagtttaatggatggaagctcagctggcacatggtggaggcaaacccagggatgtctgactcattcgaatgtttctttcgttaagttaagtcttccattcaggaaaccaatattgcaagttcaacgtgtgaaaatgtcactaggctccacggtgctagagaggtggatcctgatgatgtcctgtgctcacggcgcttactttgattggcacccagagagaagacatgagcaacactggttgtgttcagatgagagacagtgcacctcaagggaagtgttggtgaagtcctcagaggaaggaggaacgcaaaggcctgtgttcagaacaccgtggtgccctgagaacagctgccaaggatgctcgctgggagccacaggccaccagggggaagcgccaaggccgtctttcaagatgcagttacatcatcactgagcagcaccagctcagggctgctccagcaagcctagacccaccctgcttccctgcgccactccccagggcctgctccacaccacccacaaaaggcaggcggacagtggaagaacactccaggcccccagctccaaaggctcagatagccgctgtcgtcaaaacctcatgtcaggctctgtttttctttcctttcttttcttttcttttcttttcttttcttttcttttcttttcttttcttttcttttcttttctttcttttattatttctttctttctttctttttttttttttttttgagatggaatcttgctcttgttgcccaggctggagtacagtggcatgatctcagttcaccacaacctctacctcccaagctcaagcaattttcctgcctcagcttcccgagtagctgggatgacaggtgcatgccaccacgcctggctaatttttgtatttttagtagagacagggtttctccatgttggtcaggctggtctcaaactcctgacctcgtgatccgcccacctcagcctcccaaagtgctgggattacaggcgagagccaccgcacccagcctttccttctccctttcttacccgacttccttggaattggtattcaggaccttccttttctcctggtatctgcccagtgatccaggacagcgctcagctcctggtagccctgggctctgtggtttcaggctgggtgcatctgttcctgtgccctgatctcagcctggcccagctccttggcctctccaccctccacttcccttggaagaaaaaatgggggtaacggtaaggaggtgctctgagtaaagcagtttccgggtccaaaataattcaaagaaatgaagagcaaaaatcacagtacaagtagtttagcttttcctcagttaatctgccataatattaagtaaagctagttttaagtatttaggctctaatgaattccatgtactaagttgcctggctgttttctaatacatgttatttgaagattctcttgaaaattgcttatatcatgctgctatgttacaagaacatggttttcacgcattctggtatggaatgtgtatgttgctgtcacttatttaataataatagtcacaattaatcagtacaaatatttatggccctaagtaccctgagatctgttgcttgatacatgtctgaacattttggacaaaaagaggccagtgtgggacaatgagatagccttttaatagagagattcttttctcttaacaatgatctaggggttttcggggggaaacacacacccccttctccatcgggaccgaaactgctcttgtccgtgtgttctgtcacacgtagatgaacaggctttcaacacctgcactggattttataatgcattgggtttggttattgtcattattgtttttaccagtttatttattcattatggtgctagccacaaagcttatgcatgctgagcgtgggtttcaaattttgagtttttttgaaacattcaagacacggaagtgggcatcacaggtcatgagttctgttcgataatgatgtcactggtcacccatgttgcttttgacttggtaaaagaaaaattgtacttaggaaaagctgccctcatataatgtgtactcatatggtagttaaataagtccagtcaagggctgtaagacagccaatcagaatcttgtttctaaatgggcatgtttctaaactggtctatgatgtgctaatggacagaattttgcatttggaaaattgccatcacaaactcttgagccttccattcttaaaccagttgcaaggggctttaccaaactgacttatccaggttacagatataacaagttcctgtaggtaatggctctcatactagactgcaagtttttttttttttttttttttttttttgagacagagtctcactctgttgcccaggctggagtgcagtggcacaatctcagcccactgcaacctctgcctcccaggttcaagcaattctcctgtctcagcctcccaagtagctgagacagggactacaggtgcatgccaccgtgcctgactaatttttgcattttttttgtttttgtttttttagtagagatggggtttcaacctattggccaggctggtcttgaactcctgacctcaggtgatccggccgcctcagcctcccgaagtgctgtgattacaggcatgagccccctcgcccggcctcatacttcattgtttataagcgtgtactgggcacattgtgaaacacaaacgttctcccaccctgtccccagagactccagttcagagggtccaggaatctgcatttgacgtgcacacccgggggttctaaggctatttttgtaccatcattttgagaaatacatgaagctatttcaaacactcctcataatgtcaattagtcttctccttctgtcctaggaactagataattattatttcttttgtccaaaatcctttggattatacaaatgcattatatctggaggcagtaattaagctctggcctggcccacttttctccagataagtacactgattaccttcgcgtttccttacaggtccaactttccaacaaaatcatcactgtttgctttcctttaggcctacacgttcttttcctctgttacacaatgtctgaagtaaaacaaagatttctgtctttcctttcatgttgtacatgttgtgactaaaacacatgcctcaggtctcagtctatcttaaactgtggttatttctttaaaatccattttacctataagaacaataaaggcgtcttcaggctttttaaacctgtaacaatttaaagacattgggtcataaaataatgtttaacctggactgatacaattaaaataaaacattaacagtctgaattttgtttaagatagaaacttagccctcttgttcctggtatgtgcgacttcatgaaaacccaagtttcgctacttaaagtgcagactatgtttctatagtttcaggtagaaattatttggaaatgtaccatgctgctgtaaaacaaacaaaaagccaccctaagcccgtattttctccttttgtgacactgcagagttatagtttccacacagatatcgtgcctgcagggcctttagaagcatgtggctgctggctttcaccctgaaggtccagactgctggactcttcagccgccgcttcacccttccctctctgcttgctgctggctttggggttgggatctgcttcccactctcctgcatctgacgtgctcttccatttttctcccagtccatcatggtaaattcttgtcttcatattccttctcttctcccacctttgtttctgagctgctcacctgagctgtgggagtgcaactgggatcatcagcattttccaatcaaagtgctcttatcttctgatcagcaaaataacccatcacagaaatgactgaattaatgactctctagacagttgagtctcttccacgtttttgatcagggcctgctcatactcagacatttcttgtttgttgttgttgcttttatgttcatggctgttcccaagcagagagaatttattttattctatttttatttttattttttgagatggagtctcgctctggtcacccaggctaaagtgcagtggtgcaatctcggctcactgcaacctctgcctcccaggttctcaagcaattctcctgcctcagcctcccaagtagctgggattacaggcacacgcccttatgccccattactttttgtatttttagtagagatagtgtttcaccatgttggccaggctggtgttgaactcctgacctcaggtgatccacctgtctcagcctcccaaagtgctggaattacaggcatgagccaccattcctggctgagaatttcatttaaattgtggattactaggcattaattatgtttgtgtgagagagagtggcagagggacattgaaagagcaacagggacagagagacagagagagaacaaggagaaggaggacgagagagaaagaaagagggaggaatgggagggggtactgagagatcacaccaaattcattgcacgttcctgtgagttgctgccacacgctgcactgggccaacgctttcccaccagtttcactagtggagatgacctcatcggatcctctttgccatcttctgtgaggttggaaccatgcagagtcctgcattttcctccatctacccctaagtccttgtgttaattatgatctgtgttggcttttatcacctttgtggaaagagaagagccaccaataatgaagactgagtaaatgagccagtgaaacagagacggggatgtgcaccccccaggctcctggatgattattgacggacacgtgtcagctgctaaatgttatttaaaacttgttcttgccatcctatcatcatttgctgtcctcctgaatatggaaatacaatgattagaaggctgttttaccatcctgagatatgtgcaccattgattttgtaatttgttgctaccttctacttatagtaaatggtccatgatacataaaagaaatttatgtcagagcttttcacagtgaataaatattaggaagaaaatacatttagacaatagaaggaagcagtgtaatgggagatcctgcagtcatgtatgtgtcgtttattttctcccaatattttttatagtagctgtgtgaatatcttactttttacggtgctcaattccacattggcctgatatttgacatattttaaggcacagtgggagaaggaaccaatcctgacctttctctaggcacttttctgatgtcagtagatgaactgaataattaatatctgacttcttctggaacttatttgaggtggcttacagaatcctcccctggcttcctattgtgttttggataaaaggcaagaccagtggcacggtccacgaggctgggcctggttttctttgtgcctgtctgtccagcttcatctcggatgcttcacgcctcactcctgacatgtagccacacatgcaccaggttacaaccgctccattgcatgggaaacctgccccagctggtcaccacctccttcctgtatactcttcaactctcagctcaaattctcttcctcagagcacccttgcttgccccaacacctcagtaaaaatcagcacatgccccatcattatacgccctcttgacacatggaattcctgcccactgccccacctcacagtgtcactgggtttgcctgaggtctctcccaccgcgtgcaagtgtagggatgtctcttcagttcagcacgttaggccaatgctcactgtcacaacattggtatccagtacacgtggttaaccattgctattgtgaaatattataatgcaaaaactatggaacatgtaaactcacagcttaatgggtgagtgtaacctgaatttcctaatgtgaaatagcccattcaggtctagaaacagaggacagccagtaccccgcagctcctgtaccttgacttcctctttccagtggcaacttctctctccccgttgagttatgcagcatcctggatttcatggaaatgtctttctggcttgtcttcatgaacttacgtgtgaaccactcacttagtgtagtttgcccactgtggaactttttacaaaaagaaatattcatcttatattctttactgtctgatctatgtcacttaaaattatatttgtgaggttcattcatgctgtgcatgtagtcagaggttgtgatttgcatggctatatggcattctgttacatggaatacaccactctggtagacagaccaatgacaccccatgaagatgtccgtatcccattccctggtacctgtgactatgttagcttccctgacaaaggagactaaggttacaggtgaataaagatagtaagattactcatcaattgcctctctgcagccaatcatttctctgatgctatttgtttttccattatactggattatgtgaaaattctgatactaggctaatagctgtttaacatggatctaatgaatagattccattctaggccagctatagtttaaaaatactacagctttctttttgagtaatttgatacctaaaatagtgaagacctcaggaagagcccatcctctttgagacccgtgaacattctgccgtgccaactgtcttggctggcatttgcttccccttaaattagcttcctcctgtcacagaggggcccatactacaaggctggtggatgatgacaaatttgattcttgaaaatctgttaaggtaattgcaaaattccactcagtttccctgggaaaataactctacctgctagtagaatcaccagccttttcaaagaaaatgtatacatcaaattagcaaattagttattttaaaattgtaaaccaaaggccaggtgtggtggttcatgcctgtaattccagcactttgagaggctgaggtgggcggatcccttgagtccaggagttcaagatcagcctggccaacatggcgaaacccagtctctgctaaaaatacaaaaattagctggacacggtggtggacgcctgtaatccgtgttacttgggaggctgaggcagggagaaatgtttgaacccaggaggcagagattgtagtgagccaagatcacgccactgcactccagcctggatgacagtgagactccatctgaaaaaataacataaaaataaaataaaactaaattaaattgtaaaccaagagtgttgttggaatttccacctagtcttcgagtgtaagtgtagctagaatatgccgcagacacaggagcatacccctcaggaaccagggagcaggcgctggatgaagcatcaatgcttgctgtacattcggcttttgtttttgagtttcagaaacccactcaaattagtttaagtaaaatggaaaatgaaatatctcctaaaggctgggcactgtggcaaatgcctgtaatcccagaactttgggaggccaaggagggtggatcacaaggtcaggagatcgagaccatcctggctgacacggtgaaaccccgtctcgactaaaaaaatacaaaaaaattagccgggcgtggtggcgggagcctgtagtcccagctactcaggaggctgagtcaggagaacggcgtgaacccaggaggcggagcttgcagtgagtcgagatagcaccactgcactccagcctgggtgacagagtgagactccaactcaaaaaaaaaaaaaaaaaaaaaaaaaaaagaaaagaaaaaaagaaatatctcctaaagtaacaggagtgcattattaaatccaagggaaaaatgcatccaggcctcaggaggaaaagtacatcaaaaatggaaagccaagaggagctcattctgtctctttgagcttcttacctttttgcctttgtctctttgcttttcattctctttggttctgaacctctctacttcattcctctcattctgtaaatctgctttatttcctttggaatctttacaccatatggcagcaggcacttaacttccctccccaccttccgttctcatggtttgtgacagcagccaagaacgacttggaatattttaatctcacaccacaaatcctggagcagacttttgacctaggttaggccaattaattgtctctggctgaggaggagaggagggggctcacagactagaaatgtggcttccagggcccatgggtggaggaggagggcagctccgatcattctgactgggatgctcttcacaatgcctctgtaccgtgctggaacattgtaccagggtggcaagccctttttaaaaagtgagctccaattactttagtctctgccattcaattgctggtggttcttgcctttgaggctagtttgttagttacttaatatttattgagtgcctgcagggatttttgacattgagaagtgatgtgttgagcgtgccaaaaatctacccagtatagaaaactcatctcaaaatcgcctgtgggtttcagagagtctatgcaaaaacagccattatctaaacatgctttaagacgctgttatcatacacagcaaggtgaaagatacaaatgctcaattttaaattctgcagcttacttcatagccatcttttcactgaaagggatttctcttgggcctgatgtgttgtgacatttttttctgtggatgatcaggtcacagtgctgctgcttttggaaatatatagaacaacttgatacctttaaaacattatatcaaaatagaaccaaagtagactgagcccagaaagcaagactaacttacattttgaactaatttcataaaagaatctatcagacccagtcaattaaactgaagagcctaaaataatttgaacctgatgttggaatttgcaggtaaaaataatcaagaagaaatgttaacagatagctattgcatcaataatttgcctgtttgttttctagaaggattgatagggcagaagttaattctgaaaacacagttttgctgaccttcaagtagagggctgacagctgctttagcaagggtggtgggtaggatttcaaactgctgtgccctcaggcagcaacatcaagtcatgttatgtaaaataggcaacttcagaagttcccaaatgtatttgagaaaagtagggtggatcccaggtgagtccatgaggcgcatacggaaagggtgtgggagagccctgggagagcctgagcagtgagacgtcccttctccacatggaggacgtggtggacactgcccaggggaagaggggcacccgcaggtttgtgtctggatgtaccggaaacattggctcctctgcttccactaagatgatgatgatgatgtataattaattgccagtcctcgaaagttgggcaggttaaccaaaattaacttctaattaatgaaataaacggaggtgttggggaaggtgggatgacatcgtcttccaccaccaccacatcccattcccgcattggttgcttcagtctttctgaaagggctgctcagctgcccacgcctgcagtctctgcagttattcacatggaggcggcattaattcataccttgcggccatatccattatccctccctcacccccactactagcaaaagcaccccggaagtactcacaagaaacaaagtgacagtcacaaggaaaggagcatctcggggagtgggaaagcttcccctgctaagtacatgcaatgctttattggacgatgagttagggtcctcttgctccaacaagactggcttgcgtttccacctccagccagcattgtgaatcccaagtagctgctgatttatatgtatcctctggaattatttaaagctatcaattacctaaccatgggtatagttatatcgtagaaaaggccactttccattttgggagcgagacattgtcttctagtcttaatatacttctgcaggctgcctgatagaagaagagattgattggtttaaagatagattgttatgagagaaataatttacttcacttcctccttccctagtgagaaggccatctggttgacccctctgcctttagctaagggacatagaatgcacaattgccagctgtccccaatgtggctggcaaggctggacctcagctgtccccggggtccctgctgtgctgcccccgattgctccagtcttctcctgcaggggtgtgtctttaggaggaggctttggttgatcgtgaaatcatcctccaatctcacttctgctggaggtgactccttctgtccctttagctgcgtaaggccagacttacattacatgaaacaaacacgtcatgggatgtgtacccggaacattcacagtggttattggctgcttgaggtatgcatcactttactgtggagtcacaattatggatccaataacctggatcactctgctttgaggacccaaaacaaattaaatttctgatttcccctcattaaagctcaggatgcaacaagaagttggaggatcacaagtggaatgtgaccactctagccccttccctttctttataaagagtaggaaatgcaatgcactttcgagttctttctctattacatatcatatgttgctaaaacattacttggtggtgatagcaataaatagtaaattagtatcttgtgtttctataatttttataaattatagtgtgctttcaaatacatttacatttaatcctgataacacctatgcaatcagttccttttgtgtcccactcctttcctccttgcagcgttcaaaaatcgtctccaacttagagttctcatttgaatcttctcctcttcataaggcacaaagtctgataaaggtagcaagcaaggcaaatccatgagagatacgaagctcaggccaagatgagacgtgtcagattttaacagagaggagagaacagggatgcataacctgacagagaggcgtgggctctatcagctgtagctggggagaaaattaaagcggcctgcattagggtcctccttgaatcagttcatagacattgtggtgtctacaattattatcttaatctgggtttcttgcactcgagatacaaaattggcacacacaaaagtcaagctgtaatcacaagttactaagataataacattggataaaggtgaattttatgtttaaaatgaccaaacgactcagaaaaggtatagcttggttttagttcgttgtttgttttatttttgcctgagttaaaaataagtatgagcagcagtgatgtcgcaaaggacaggattgccaactatgcgtgtcagtttgcattacatcttgcagaatccattgctgcttatggcctcattcacgcaactgggcttgcattaaccctttgctttctgcatccatcaatgattgcctttctgttacttctaaaggcatttatccatccattcatccactcaacacagtctctgtgcactatgttgtcccaagttttgtacgagacattgagacgttgaacacagtaaggtaactgtgtccttaagtagtttgcccccctggtaatgacacatgcattatgataatatattaatactcatactaagataatatatattaaagagataaattaatagtggaacagtgttacagaaaggcactcacagagtgttgtgattgtgtccagggggaaagaataatgccggtgaaaccaggcaagacttcctacgatgtcagaggtgatattttagctgataagtaaagaatgcaaagggatttgcctggcaaaatgaagatgaagggaaattccaggaaacagaaaagttgtagggcgtgttgaggaaaggggacatggaagggaatgacttgctccaggaacaatagggtatgagcggagtagggtagaacttagatttggcctagaggtagaaagaggacagacttgccatgtcacaggggcaaagggtgtttttttcttgaaaacagaaggctagagccccagagagggctttacatgcaaaagggatacataaatatatcccgacacctaggtctgtatgaccttctcagaataacactgttggctaatatctttctattgtatgcccagaattcagctacttcccagcatacccaccactgccacccaggacagacctccattacccctgtgccttgttggccgctcctgttcccaccctggtttctgcaagtgtttcctctaagcagctcccctggccaccttccttagtgggagccttatttacacactgctgtgctcacacccctttcactcagaggtaagccgaagcctgcacctggccctcaggctctgcactccctggccccttactgcccccactcctcagaacagtcaccttgctctcccactctggccactgcctccttgctgtctccactgaagcctatgctgtctcacaggccaggcacctgccactccctctgtctggattgtcttctcggatgtcagctctgcagattccttcagttctattcagatgtcactttgctagagatctctctgatgcaaacagctcccagagctccattgtcctgcttttctcttctcttagtgagctgatctgcttattgtttgtcccttcccccattcctgcactagattacaagaaaaaaaatgaaaaaaaaaatgaaagccattcaacttctgttgataacagtgtcagtatctgttttattcattcttgtattcaaggttctcaaaacctaacctggcatagtaagccctagataaacatgtgttggatggatggatgtggattgacagatacatggatggatggatggatggatggatggatggatgagtgaatggatggacggatgtggatgaatagatggatggatggatgagtggatggatgggtgaatggatggatggatatgtcgatgaatgtggatggatggatggatgtggatgaatagatggatggatggatgagtggatggatgggtgaatggatggatggatacgtcgacgaatgtggatggatggatggatgtggatcactgggtagaaaacttattcttcttagagcaaatggttaattgtgaacatgcttttccattttaatggatctccaaagtatgcatgtggtaacggaatagggaatatgttatagcctcactttcaccatgctaggcaaaaaatgtctcattctactgagaaatgcactactgacactcagtgtgccgggggacaacctagtgacttctcttgactttcatggaaagcagaatcaatcctactcgaattttcaacagttcaactcctgcaagttaggaggaagtctgaatgtggggagccaaattagatgttcaaagaagcacatattagcttgcattctaacttgaaaactgcatctatgctgtggttgtacccatttaaaaattaaatgtgcatatagaccagaaatagaaaacaatatgaaaaaggcttggccaggcgcggtggctcacgcctgtaatcccagcactttgggaggccgaggcgggcggatcgcaaggtcaggagattaagaccattctggctaacatggtgaaaccctgtctctactaaatagacaaaaaaaaaaaaaattagccaggtgtgattgtgggcgcctgtggtcccagctactctggaggctgaggcaggagaatggcgtgaacctgggaggcagagcttgcagtgagccgagatcgcaccactgtactccagcctgggctggaaaaaaataaaaataattaaaaatgaaatagaaacaatactcaaaagatatcaattatttgagctaatgaagataacattaattttatcattctggttcatgaataagatttggtcttgatgttctgtttttaatggtttccttggaatttcatcttaacagcgtttgaggaatgtcaactgggctgtgagaaattgcgtgcactaggttgcttgtatgaatagtaccactgaaagattcctgctagtcacagacttgatgaaaagggcttattttctttctgaattcaggtgaaatgaaaagctgctgaattagcaagatctaattacttatccttggccctggccagtgattttctcccaaagaaaatactacctaataggaaatgagattgaatcagtgtaactttctgtagctgttttgttgctcacggatagtcttactttttaagttctaaaaagctactctctgtagatgaattaagttatagatggcaaatatgaagacttgtagaaattctaaaccactgtagaactctttcctactaagcctataatggccccatgaatttttcttaatttaataacaaatatagccaatattaaatattttggatgatattgcatattgtctattttagtttgtagcaatttgacacattctaaagaacttttaatctttgatgaaaatatatttatgtattgcattgtctactttttaaggccgtcttcattctacctcattttggcttggttactaagttgcagttatgtgcactataagagtgtattctccagactatacatggacagaagtggtccctttgcagtgtgaccatctgtccttatttgttcctgtataattaataataatccatgtgtaactattatatttattacttattatcaagcattcatatgatcctttttgtctctcaaagaatcacagtttcgactaaaagttatatgattcctctaatttgcacggaactgaaaacttggtctcagcagccagtacgcgtgatgaatttcctagacttatgtagtctttagcaccctttagcagtgtctccagagtccctctctcacctgccactcttgctgcagtgcaagagggttctctggaagggactgaaacctagaataaggataggtgagttgcccagtgaagagagaccaggaaaatcttgaaaccttgaatgaggagctatggaaaaaagaaaagcctgaaggcagtgcgatgggcagaagttggtgaaaattggcacatagcatgtgctaaataaatatttaaatttggtaccctgaaatagaagttgatcacatggatgtaaaaaaaaaaaaagggaatgatgacagaggacttggagctgaaaagtttaatcctagttgggttggattcaatgagggtaaggaatttagctgtgaagaaggaaagctccaagatgaccctatactgcagagtctggtttattgggaggaggagcattaggtttgcacaaaagctgcaaacataataatatcagattctttcttgaggtaacatttggccatagtacaggaaaatgacagccgaaggctttgggccactgaaggcagaagggtgcagaagggtacaaaagggaactaatagtagcttcaagaatgggaagatgcctctttcactgttttgtatcttggttcttgatttaaatgaaatatgtctatttggcttattttatttccttatttcactcactggggttttctttgttgttgctgtttttaggagctggtggggagtaaccctccgcagaggaattggaaaggaatagcaattgcactgcttgtcattctggtcatctgctccttgatcgtcacctcggtcatacttctgacaccaggtactgtattcattcttggaaaagcaagtcgctgtcagagagaaagagcataattttaccttgcaatttttttctaagtaactacctattacataatttatttttcccaagttctaattctcactatgccatatgatataatatggtttcaattttaaaaattcattttatatgttttggatttgttcacaaagttgtttactacgtggaaatgcttggcatatattaaaattacttatacaatcacttattcatgcttgatcaacttaaagacagtggcataaatataatgattttatatatttcatagaattcctggacattatatcaagggtgaattaagaaaattattaaaacaacatatgttgagtgtgaactaaggagaaggtgctaaataggtactactgaatattacataaagtataaaccagtgtcataaatctctcaggaaagaaaagacactaaaatccacagaagaaacctacaacaaatacagatatatacatgcactattgagtaagccaaagagaagtgctattggagttgagaggagaaagagaaatctttcaaaagaaagttcatggagaaggtagtacgtaaagtgggcttaatggagtaatggtaggaatttagtagccagagagtggtaggattagggagagaagaaagcctttgcctataaaataataatatagagctggacatggtggcttatgcctgtaatcccagtactttgggggactgaggcgggtagatcgcctgacatcaggagttcgagaccatcctggccaacagggtgaaacctcgtctctactaaaaatacaaaaattagccaggcgtggtggcaagtgcctgtaatcccagctactcaggaggctgagacaggagaatcgcttgaacctgggaggcagaggttgcagtgagccatgattgcgccattgcactccagcctgggcaacagagcaagactccaactaaaaaataataatgataatataggagttatcatagaaaaacattgtggccatagataaaacagtatgtaactgttttatccgttctcatgatcatagtagatgcctatttgtgcaggcaaaaaagttttaattctcagtaaatacatacacaagcattagaccttaagatgaaaaaaagtagatattataatataaaacctttttccacaggtacaacaaatgtgggcaaattataatccaggcttaaactattaccccaaaatctaaatgagaaaaggacgatctgtaccctgataccaaactagataaagatatcacaaggaaacaacatgccaataccccttatgaaaatagatataaaactcttcaacaaaatagtagcaaactgaatctaactacatgtagaaagattatacaccatgaccaaataggatatattccaggaaaaacaaattggcttgtatgaaaatcaatcaatgtattatacctacattaatagaataaagggcaaaaagcacatgatcatctgaacagacacagaataagcatgtgacaaaatccaaaaaccatttcctgacaaaagactcaacaagctaggaacaggaagaaacatcttcaacttgacaagtatctgtgaaaaacccaatagctagcatcatactgaagagcagaagactgaaatcagtccgcctaagaccaggagatggtagacaaggatgttcattcccagcatggctatttaacattatattggagggtctagccagggctattaggtaggaaaaacaaaaacaaaaacaaggacaaccagataggaaagaaagaagtaaacctgtctctattcatagaagacataatgttgtatatagaaaatcttaaggaatccacaaaaaaacctattataataataaatgagttcagcaggaaggaagatttcagaccaaaatgcaaaaatcatttgcatttttagccactagctatgaacaatcccaaaataaaattaagaaaatgattccacttaaaatagtttcaaacggaataagatacttaagaataaatttaacaaaataaagaagtataagacttgtgtactaaaactacaaaacaaaatggaaagaaattaagacctaagtaaatggaagtatatcttatatgaattgattgaaagacttcatatcattaacatgacaatactccctaaactgatgtgcagattcaaccaaatctctatcaaaatccctctttctttcttaaagaaactacaagttgattctgaaattcatatgaaaatgcaaaggactcataatagtcaaaacaatctcaaaaaacaattcaaagacttatacctcctgattttaaaacttactgtaaagctacagaaatcaaaacaatatggtactaggataggtatagacatatggatcaatggaatagaattgagagttcaaaaataaacccatacatctatagtcaattattttttgacaagggagtcaagaccattcaatgaggaaagaatagtctttccaccaaatggtggtggtacaactagatattcacctgcaaaagagtgcagttggacccccaactcgtaccatatacaaagatgaactcaatgtggaccaaagacccaaaatataagagctaaagctataaaacttttagaagaaaacatagggataaatctttgtgactttgaattaggcaatggtttcttacatgtgacaacaaaagtgcaagcaatcaaataaaaaatagataaattggacttcatcaaacttaaaacattttgtgtatcaaaaacactatcaagaaagtgaaaagacaacccaccgaatgggagaaaatatttgcaaatcaggtatctagtaaaggtctagtatctagaatatatcaacaactcttgcttctcaaaacaaacaaacaaaaaaacaaataattcaatttaaaaataggcaaaggatttaaagagacatttctccaaagaaagacaaatggccaaaaagcatatgaaaagatgctcaacatcattcagcctcagggtgaatgaaaatcaaatcacaatgaaataccacttcacatccactaggatgattataagaaccaaacacaaacaaaaaatggaaaatagtaagtattcccaggatatagagaaatgggaaccttcttacattactagtagaaagataaattgtgtggcctctgtggaaaatagttcagtagttctcctaaaagttaaacacagagttaccatattacctagtaattctactcctaggtatagactcacgaaaactggaaacatatgttcatatagaaactagtacatgaggttcataacagcattaatgataatagccaaaaaagtgaaaacaacccaaatatctatttcccagagaatggataaataaatgtgatgtggcggggcgcggtggctcacacccataatcccagcactttgggaggccaaggagggtggatcatgaggtcaggaagccgagaccatactggctaacacattgaaaccccatctctactaaaaataaaaaaaaactagccaggagtggtaacacatgcctgtagtcccagctacttgggaggctgaggcaggagaatcacttgaacgtgggatggtggaggttgcagtgagttgagatcgtgccattgcattccagcctgggtgacagagctagactccatctctaaataaataaataaataaataaataaataaataaataaataaataaatgtgatgtaaccatacaatggaatactcctccactgtaaaaaggaatgaagagctgatccatgctgtaacatgaattaaccctggaaacttcacactaagtgaaggaaggctggcataaaaggccacatattgtatgatttcagaataggcagatccctagagataggaaatagatttgtggctgctgtaaggtagaggtagggagaaaatgaaatgattgctaataggtatgaaatttctttgaagggggatgaagaaattattctggaatttgatagtggtgatacatgtatgactctgttaatattatatattttaaaaacactgaattgtatacattaaaaagatgaactttatgatatgtgaatttcatctctattaagctatgagtttgataaaaagatgggaaagctgttgggggagaaaagtgtaacctggccacaaaagtgccagacatactaaattgccttaaaaacttgtgtaactccaaagaggcttcaggagcagttccgggagagagagcgttgcagtctcctgcgtgagcgagcttcgtgaatggagcacagttgcctggaacaatcaggctgaggattcaatccagtgcttcaatgcccaggaaacagatccctgcacctgctgaaatcagatgaccagggtttagaggggctgggggaggaactgcaaagccaatccttgttttgttttatggtggtggtgctgatgatctcacacagctggggactttaaccactacatatttctaacgaatatagaggaagtcaagttttcctcagggtctgtggagcatgtgtttctgcctctacttttctttgagcagaattgtgctttgtgtaagaacatgattactgcagattcgatcttgtggttgtctggcactccctttgggacttgaaagcagtggtgtctaggggtttgcagttactcccaccttccaaggtgcatgtgaactttcatgtcaccccggtccaagggctgtcacgagtgtcactcaagagtggaataaggccggtgtggtggctcatgcctgtaatcccagcactttaggagggcgaggtgggcagatcacgaggtcaggagatcgagaccagcctggccaacacagtgaaaccccatctctactaaaaatacaaaaattagctgggcttggtggcaggtgcctgtaatctcagctactcaggaggctgagcaggagaatggcttgaacccaggaggcagaggttgcagtgagccgagatcgcgccactgcactccagcctggcaacagagcaagagcctgtctcaccaaaaaaaaaaaaaaaaaaagtggaattaaatggctgcccggagcttcttacaccgaaatgtccacagcagcaaagcgggttgagaaccaggtcctgggaccctgtcctccaagctcaactccaggcctggcaagcagtagccctgcgtcttctccacgcacagggagtggcggcaggcctcctccctccagcacagcagctgaccctgccagcatctacattcagttcttttgcagccaaggcaaccacagcagcctcccctctgcagtaaacagaggatgcagttgctgggaactcttctccctccatgctgacggccagttgtcaggggcaactgctcctggagaagctctagtgaatggctgaattccagagaaggctttggaggggaatttgcttttcttgttccatcacaatacacatgcagctgagccttgcttcaccttttggttctgctgggctttcatgggtgctgtttgtttctctgggctgtgctgccctgggatggggtgtccaaggtttaggcctctcccacagggctgcacagcaaatgttgcaccgctgctcccgcaccgaggcctgactgcatccactctcctgcaatacagcaatggcttgtgttttggcataaaattccatcaggcagaggaggtatcaaatcattcaacctgccactagctccagagcagtgtcaaattcactaatgtacagagcagtgtcacctcgacagagaatgcctgccaacagagccagcatgaatgatcccggctaggagctgagaactccatgctaagtgccagacagaatgtggaaagagaagatgccagtacttcccatgaagcttagagtccacgtaaagacaatgcatgtgcaaggagaattccacagtagtgttatcattaagtaaaaataaaagtcaaaggcagggtgtggtggaggcctgttgagttgtgtagatagtggaaatgctgacctagagggctgagatcctcgccaaggcaggagtggcttccaccggtgaaagtgaaagatgacagtcagtcttcaacagtggagaatccaagtcgtaaccgtcacacttcgcatatgtttgcacacagtgttgagtgcgttcctacccaacattgcttccattttggtagatttagttagaaattgtaatatgtgcttttttaaaaaaatagtatttttcaagtactaccagtcttgtattctggtttattgcaactcagagtacagtatctgctttctacttaattagaaaatccattctgaactcacttgattcagtcgttttgtgaaagtggttcctggtacccaggggccccttgccacccctgtgagaagaatctcatgcgcatggtggagtgccctcctgatgacgcagacctggaagggcctcatggtaatcactctgaacaacaaggcatcttgtcctggagtacagtctaattatcaccagttatgcacaattgatgttttagaaatcaaattaaaagtgttcaaggtgatcttagttccaaagggatttaccaagtgagaatatgtccctttcaatgttgtcattcatatctcccttgctggtccatgctcttttctaaatttcttctctttggaataataggctcaacgttacattttttattttcaatattaaatatgtatctgtctacaataggccatgcacagcgtatgccttttgttagcagctacagttcccgcattctgatggaaacaccgtgaccttctccggtgccacaatcgctgacgtgggggtcggaaactccagcaggatcggatttgcatgaaaacatccctgacaattggcttttatggaatctcacattagagcaggtggacagtggtttatgccggaaacactagaacacttttaggtggtacatcaatgagaagccttgaataattcaaagtcatagtgaatggaggttctgggttaaggccaagcacaggttatcagaacacaagactcgtcagtcttttgggtagaaacgtaacatagagattacttttacggaattaaaatgtcatcactgtttaatgtctgtgaccgcattgccaaccctcaccttatctttttaaaattcttgaacaaataatttcaaaacattttattgaagaaggatatacatataggatatatattatatatttaacataaatattatatagatattaaatatataaatataaacacatgtgagtaagctattgttgaattttgatgaattttaaaaccaaacttgattctgtaatcagcatccaggccaaaaaagcagaatgcagccagcatccggaaagccccccaggcccttcctatcattaatcctctcaagggcaacctcatttctgacatcacagagtagtattatgagtttttatattctttgcatttatggcataaatgtaatcatctggtatgtctacttttatgcctgcttttgttctatatgtttgtgagattcatagttgtattttagattgtactgctacccaatttttaacctatattggattatcttatcataaagtcccacataatctcaatgaaaattgcaaaatagcttaacagtcatttaatagcttttgtgtgtatcataaaaagtaatgcatacctcctaatttttttttgtcttgtagaaatagatggcttgctccgtatcttttgggcattttctctctgttagggctcctatattaaattcattccacaaattcaatcttgttatattccatctactaacactgaccatggcccaacccatttcatcatgggaagcacaggtggcttgagtgggttctggtattgttcatttgccctggggcatctgctctgtgagtcctgggctcctccgtgcctgctcacacccatctgcagcggactgactggattggggatggtgtctactctgatcatgaaacacagagttgttttggctgctgccgatgctaccactgttaatgtttctgcccaaagttaacttgttaatactaatcgagactgggtgctataaatagaggctgcagatgatattcattatgatggtccaaaacatgggagaggccattgagaacaggatacattcctggaaggcttcgtggagaatgagcaattagggactttaaaagatagatccagtagagatggaagaaaactgagagggaaagccatgagccctcgggggacagaggacagtctggccaggaagttgtggaggggccaggtgtggtcaagagttaagggagaaggaaagggatggtagccaatggggagagcctggagcgcacagggcctggatttgagactgaactctaacttctcataccgtttacaccagtgtcctaaccagtttcagaatctgatgaaaactgtaagtcatcttatcgttggaaggaaagaaagggcattgtgtgcacataaacatttggatatgttgtattaatataacgtttgcaaacctagtcagtccatcccagggccatctcagggatctgcttgagcgtttatccaaggtccaggtgttaaagtttgtcagccaaaatatttttgtctgtgagtaacagaacagccaactaaaactgttccaattgcaggtgtccgtattgtttcacaagacaagtttagacatagccagtccaaggcagattcagtgctcgtggatattgtcaaagtccaggtgggctccatctctctgctgccatcagtatgtcgacaacatggttgtgacggcttcatgcttcactcgcccacacgcacaggaagggatggacacatagaacttagcttgtgcatctcacttcctctgtcatggaggaaatagttttctgagtagttcctttcggttccccggagctgcgaggagacagcttatttgctgtaaccatattgcatggctaccttcactggagggggttggcaaagcccgccatttgtaggagtcaggctctgctgagtcagaagaaggcagagaggcactggctcttggggaagcagccttcagtgtccaccaccacgagcaagaccccttgatttgtgaaatccttgaggaatgtggtctacattccttgaacatgaccagtgaatttgagtcattctttaaattgaaacaaatcttctccctccaaaaggagggagttctgacagattctcatagaagaaataattaggttacattgctactaaccctatagtgagttgcaaacttgcaaactactgaaaagtgggtcgctgggaccatcttaaccgtctctcttttgatttcccatcattaattctagaaggactactaggtgcatctcgcttatttatggagtccttacactaaagagccatttttctaaaggatggcagtagatgcttattattcacactcgtgttaagactataagctaaggcaaatgggtctacatatttatctataaatggacacttttcaagtgttgctgcattttgcatcctattttaaaggcaaccatgaaaatgagtaaatcttatgctgggaccctggtttcctctggagtctcttgcctgctatagatgagtgcctcctggtcagcttcaaattaattttggtggccttaaggaccatatttttacaagcagctggctcctatattagttgctagtttagtgaagactctggcagtccagaaccaaaggcagcaattcaggagtttaagcagagttaccataccatgtcagggtcaggaacacagaaagctgtgatataataaaatcggagaactggagagcaattctgtaaaatgaactaagcaggtcggggaactaggaagatgaaattccagattgaaatggttccaaattctctgaactcttcaccttaagccctgcttggacaaccattgatcacttctgcagaaacagtatatccatgcactttctcagattgctacttcataatcctcaaatcccagatattctaaattgactctgtgcatttaagtatggtattaaaatcaccagaagttcagttaagtgataatttgcaggacctcccatttaatcagtctctttcttgcttttcccctactcagattcttcatgtctttctttttcattcagtaaatgtatgatcattgcagcctcagaggatgccttctaaagtggtgggttggttggaaatgggagaaaggccttgaaggatgcggtaggctaaaaaatgcgccccccccaccaaaaaaaaagtccaagttgtaatccttggatcctgttaatgttttcttttatggccaaaagggggccttttgtggctacattaagcatctgaaatggaggattacccttagttatccaatggaacctcaatgtgatcacatgtgttcttataagaaggaaataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactagcctgcacaatgtgcacatgtaccctaaaacttagagtataataaaaaaaaaaaaaaagaaggaaatagagggagatttgacacagacgaaggaggaaatggcaaagtgaccacagaggtggagatgggagggatgtggccacaagcccaggaatactggcagcccccagaggctggaagagacaaagaacagatgtgatatggcttggctgtatcctcacccaaatctcatcttgaattgtagctcccataattcccatatgtcatgggagggacccagtgggaggtaattgaatcatgggggtgggttttttgtgctattctcatgatagtgaataagtctcatgagacctgatggttttataaaaggcagttcccctgcacatgccctcttgcctgctgccatgtaagatgtgcctttgctcctcctttgccttccaccatgattgtgaggcctccccagccatgtggaactgtgagctcattaaacctctttttctttataaattacccagtctcaggtatttcttcatagcagtatgaaaatggactaatacaagatgcttccccagaacctccaagagcgtgcagccctgctgacacttgtatttgggcccagtgaagctgattttagacttccagtctccagaactgggagagcatactcttctgttgtttgaagccatcaagtttgtggtcatttgtcacagcagccacaggaggctaaaataaagggagataaatggcattgccacttttacggtggccatgtcttacaggcaggcaaaagaatgcacttgtggagagatcagaactagaatgcttagaagccatgtgccagcccttggaagaccatgaactggacaacaactgtgccacgcactgccctgtctgctccttcctgccattcacaatgggagtccatgctgggctcctagctcagctctctaggggacaaccctgagtttcaaaaggtggttctttaccatcttcaccacaaagaaaggaaatgaaattctttcaaattgagatgtattttgatgtttttcaaaatttgagagaaagaggaaggaagaggagaggaagaggaataggaatctccagtattgacttaattcttcttattttacatacattcaattaaacagatttaagctccacttacagtctatgttattaaatttgtcgagatgggagatgaaatgcagattaaaaaaaagaagccaatgaaattcagattaaaaatatacattgtatgtgacagataatgataatttctgagactaagtaaccccttacaatgtgtaaaggtgtttgctacgtgtcacaggtattttgggtttagcatgcctattctcgtaggcatcgggtgaagaattgttccacccattatttccctattgggagcacactacacctgtgtttacacagcaagccagtcatttgggaaggttaaattattaatagctgaccttggtgttggtacatcatgaagacacataccgattcaggctctcaattcaggtatgagtatatgtttatgatcagaacatgattttattaattttattgaacaagtaatatgtataaatagaaaaacagtagaaatatattaaattggctgggcatggtggctcatcctgtaatctcagcactttgggaggccgaggcaggcagatcacctgaggtcaggtgtttgagaccaccctggtctccgtatctgctaaaaatacaaaaattagacaggcgtcatggcgcgtgcctgtaatcccagctacttgggaggctgaggcaggagaattgcttgaatccgggaggctgagccgagatcataccactgcactccagcctgggtgacagagtgagattccatctcaaaaaaaaaaaaaaaaaaagaaaagaaaaagaaaagaaaagaaatattaaatgaacaataataatccttttataattattttctcatactgtcagttctacaaccagtccctagatactgtcactttccaccatttctgatttaagtcttctgatatttattcatgtgctttttttttttttttttttttttttgagacagagtctcattctgtcatccaggctggagtgcaatggcatgatcctagctcaccacaacctctgcctcctggattcaagtgattctcctgcctcagcctcccaggtagctggtattacagacgtgtaccaccacacctggctaacttttgtatttttaatagagacggggtttcgcgatgttggccaggctagtcttgaactcctgacctcaggtgatccacccgccttggcctcccaaagtgctgggattataggcatgagccaccgtgcctggccttattcatgtactttttaatatcatgctgatatgtcaatgtccacagactaccgactacgaaggtcaaaatttagctgctttacattttctcccacttccgtctcttcactctgagttacaaaacctataatgctatttcaagtcctctatagatgtgtttcataaccacgtgggaaaattttttcatgtataaatttcttgttccattgattctaaatgcgcctcttgacttgtcactagataatatgggaaagaagcatgcttaaaagactttcttctcaatcccagcttcctactctttctcttccctttaagtaatatttgcaatatttttttcactttaataaaatctctcatcaaataataagttggtttttaaaatcaaaaacacatttacaacattcactatttcattttttaatttttaatttctgtgggtacatagtaggtatgtatatttatgggacacatgacacattttgatacaggcatgcatgaaatgataaacacaccagggtaaatagagtatccatccccttaagcatttgtcctttctttgtgttgcaaacaatccaattatactcttttagttatttaaaaatgcataataaagtattattgactgtagtcacattgttatgctatcaaatagtaaatcttactctttctaactctatttttgtacccattaaccatccccctctgcccacccccaccatccaccactacccttcccaacctctgataaccatttttctactccctagctccatgaattgtttaatttttggctcccacaaataaatgagaacatgccaagtatgtctttctgtgccaagtttgtctttcttagattatttcacttaacataatgacctccagtttcattcatgttgttgcaaatgacaaatctcattcatttttttgtggctgaatagtactccattgtgtatacgtaccatattttctttatccattcatctgttgatggacactagggttgcttccaaatcttgggtattgtaaacaggtctgcaactaacaaaggagtgcaggtgtctgtttgatacactgatttcctttcttttgggtacatacctagcactgggattactggatcatatggtaactctgtttttagttttctgaggaacttccaaactcttctccatggtggttgtactaatttgcatttttatcaacagtgtatgagggtttccttttctgcatatcattgtcagcatttgttattgaatgtcttttggatatgagcctttttaactggggtgagatggtgtctcattatagctttgatttgcatttttctgatgatcaatgatgttgagcaccttttcatatacctgtttaccatttgtatgtcttcttttgagaaatgtctactcagatcttttgcccatttttaattggattattagatgttttcctatagagttgtttgagctccatatatattctgcttgttaatcccttgtcagatggatagtttgcaaatatttactccattctgtgggttgtcttttaactttgttgattgtttcctttgctgtgcattttaactcaatgtgattccaattgtccatttttgctttggttgcctttgctaaatagggtattactcaagaaatttttacctagtacagtgtcctggagagtttccccaatttttttttaagtagtttcattgtttgaggtcttacatgtagtcctttaatccattttgatttgatttttgtatatggtgagagggaagggtctagttttattctcctgcatatggatatccagttttcccttcaacatttattgaagagactgtcctttccccaatatatgttcttggcaattttgctgaagatgagttcactgtaggtatatggatttgtttctaggttctctattctgttccattgctctatgtgtctgtttttatgccagtaccatgctgtttggattactatagttctgtagtataatttgaagtcagataatatgattcatccagttttgttcattttacttagaataactttggttattgtggatcttttgtgattccatgtaaattttaggatagttatttctatttttgtgaagaatgtcatcagtattttgatagagatttcattgaacctgtagactgctttagatagtatggaaattttaacaatattgattcttataatccattaacatagaatatatttttattttttatgtctgcttccatttctttcatcaatcttttatagttttcattgtagagatcttttacttctttagtaaggttaattcctgggtattttattttatttgcagtgattataaattgaattactttctttttttaaattttattattattatactttaagttttagggtacatgtgcacaacgtgcaggtttgttacatatgtatacatgtgccatgctggtgtgttgcacccatcaacccgtcatttagcattaggtatatctcctaacgctatccctcccccctccccccaccccacaacagtccccggtgtgtgatgttccccttcctgtgtccatgtgctctcattgttcaattcccacctatgagtgttttcagattgttcactgctggcatatagaaatactactgatttttgtaggttgatttttgtaacctgcaactttgctgaatttttttatcagttctaattttttttagtgaaatccttaggtttttccaaatataagatcatattatctgcaaacaaggataatatgggcaggtcgagaaatatcatccaagaaccaaggcctagaattggggaccccaagagcccacttagtaccctgccgctttgtggctgagctggtacctaagttgcaacacaaagtgctttttacctttacttctccttttcttttttttttttttttttttttttttttttgagacggagtctcgctctgtcgcccaggctggagtgcagtggcacgatctcgactcactgcaagctccgcctcccgggttcacgccattctcctgcctcagcctcccgtgtagctgggactacaggcgcgcgccaccacgcccggctaattttttgtgtttttagtagagacggggtttcaccgtgttagccaggatggtctcgatctcctgacctcgtgatccgcccgtctcggcctcccaaagtgctgggattacaggcgtgagccaccgcgcccagcctacttctccttttcttaagcagaagaagtctctccctgtagccccacagctgggaatgtcctgggtcacacctgaagccagcctgtctctgagtcttacccaagaccctgagcaagtactgcctgagtaccactgctactgattatttagggcccaagggctccttagtcagcaggtgaggaatcctgccagattgggtttttccattcaaggcaggcacagggtatgtttagaaatgtcatcccagagctaggacctggaatgagggcctcatgactcttcctggtgctctattctactgtggctgagctggtatccaagttgcaagacaatttcctcttttctcttccctctcctctcctcaagcagagggaaagagtctctcctagagctgcaagctgtgctgccttgggtttgtgaagaggtgatgcaagcactcccttggccaccccagctgctgtctcactaggttgtgtgtcccccaagtgtactggctctgagccaagaacagcaccaagacttgcgcaggaattgcagttcttgcggcctagactgcctttcaagttattttaggaccccagaccactttagcccacagtggtgaggcttgctggagctcaggttcccactgctgggatatgcagttcccgaatggctagggctggtctcagtgctccgtccgtgggaattgactgagttctgcctagcgttgctttactctgtgacaaagcaacactgagtttcaatgcaaagtcccacagtcactgcattctccctgccccaagcaagcagattctctgccacacaactgctgccaggggatgaggaaggggaaactcaagactgtctttcccactctcttcagtgctacttcagtgatatgaagtcaaaaccagatactgtgatcattaatctgatttttggttctttacgagctgctttttcctgtgaatagttgttcaattggtgttcctatagagaggatgatcagtgaaggcttttatttggccatcttgctctgcctcctttcaaaattcacaattttatacttaaacaaatatttctgttgtaaatctgaagccatagagagaggaaaaaatatataatcctgtgtaactgaacaacttttcttgaggcattccagtcaagtggacttttcttaaaattcattaatagttacaattggtctattgatattgggaccatgacttacttaaataaattgggttttctcaataattttattggattatttctacttgaaataaactgtccttgttacagacaaaatgaatgcctgcacaaaatatgccaaaataatatatgtatagtagttccccttatctacagagtatccattccaagaaccccagtggatgcctgaaaccatggatagtgctgaatcctacttatactatggggttttattgcacatgtatacctacgataaaatttaacttataaattaggtgcagtcagaaattaataatgataactagaaataaaggagaaaaattataccaatatactgtaacaaaagttacatgaatgtgttatctctcactctctttcaaaataatctcaatatttctagaccatggtcaactgatggtaactgaaactgtggaaagcaaaaccatgggtaaggaggggcctactgtaagtaagtttagaaaggttacagaatgcaaggtctatttacacatattaattgcatttctatgtactagcaacacacagttgaaaaatttttgaaaatacaaattttattagtcagcttgagctgtcaacaaaatatgcagactgggtgatttagaaaacagaaatgcaacaaaagccaaaattggcaagtgggatctaattaaactaaagagcttctgcacaacaaaagaaactatcttcaagagtgaacaggcaacctacagaatgggagaaaatttttgcaatctatccatctgacaaagggctaatatccagaacctacaaaaaacttaaacaaatttacaagaaaaaaacaactctatcaaaaagtgggcaaaggatatgaacagacacttttcaaaagaagacatttatgtgaccaagaaacatatgaaaaaaagttcatcatcacaggtcattaaagaaatgcaaatcaaaaccacaatgagatactatctcactgcagttagaatgatgattattaaaaagtcaggaaacaacagattctggagaggatgtggagaaataggaacacttttgcactgttggtgggaatgtaaatgagttcaaccattatggaagacagtgtgttgattcctcaaggatctagaactagaaataccatttgacccagccatcccattactgggtatatacccaaagggttataaatcattctactataaggacacatgcacttgtatgtttattgcaggactattcacaatagcaaagacttggaaccaacccaaatgcccatcaatgttagactggataaaaaaatgtggcacatatataccatggaatactatgcagtcataaaaaaaatgagttcatgtcctttgcagggacatggatgaagctgtaaactatcattctcagcaaactaacacaggaacaagaaaacaaatactgcatgttctcactcataagtgggagttgaacaaggagaacatatgggcacagggaggggaacatcacacactggggcctgtcgaggggtggggggcaagggaagggatagcattaggagaaatatctaatgtagatgatgggttgatgggtgtggcaaaccaccatggcacatgtatacctatataacacacctgcacattctgcacatgtatcccagaacttaaagtgtactaaaaaaataaataaatgcagaatttcatttctcacacttctggaggctggaagtccaagatcaaggtgtcagcagggttggtttatggtgaagtctcccttcctggcctgcagaccgcaccttcttgctgtatcctctccctgctttttctctgtgagtgcacatatgtgtgcctgaagagaggaaaatagagctcttgtttctcttcctcttttttaagtacagtagtcctaccagattagagcttcaccctctgatctcatttaacttcagtttcttccttaaaggcgctatctccaaatagaatcacattgggggttagggtgtcaacatatggatttgttggtacgtacaattcagtacataataccagtgcacgtggacgtctttgggatggccctgtcttacctaacacagtctgttctctgacccgcaaagattcacatccttctcatatataaagcacattcattcactctaccccaaggtccccagaaatctcaacctattatagtatcaactcaaagtctgtgatctcatcagttcagaactcccaaattttaacactgaaatcatctgaatgagttttgagtaggcctcagggcatactccacccaaagcacaattcatctgtactgtggctctgagaaactggagaggtaaacacagtagtgggacgggtataggatgacagttatagacattcttgttcaaaaagggagaaaaaggagtcactagttccaaacaacttctaaattcagttggggaaactgcattaggtttataggcttgggaatagtatcctagggctctcaggtctgccctctgggagtcatctttcttcttcatgaatggcagcttgagattgtagctgagtagttttataagcatgttttctgcctgagaattttgggggtctgatatggtttggctctgtgttcccacccaaatctcatgtcaaattgtaatcctaacgtgttgaatgagaggctggtgggaggtgattggatcatggggctggtttctaatggttcagcaccatccccctagtgctgtcttgtgatagagttctcacaagatctggttgtttaaaagtgcgtagcacctccctctttgctttctttctctcctgtcaccatgtcacaaagggtgcttgcttccccttttccttctaccatgattgtaagtttcctgaggcctccccagccatgcagaactgtgagtcaattaaacctcgtttcattataaattacccagtctcaggtagttctttacagcagtgtgagaatgggctaatacagcgtccaacagcctttatttgtttcatactccctctctccttttcagtccaagctggcaatgtttctacagatataaattcttaagaatctgcggatcttctatgtatgtcatgggaattcattccattagacaagtggctcttcctaggattcttctagatactttcatctctatgtttgccttctgctgagagaggtttggggtctgtgaatcacacatttaagctcttcaaagggccttttgtgtgactgaatacttaccttttgatctttcaaggtattagcaaaggtttttcagccatgctctcaggatggcagtatctttctcgacagtgaatctcttaatttcagcattttttataatctgaataaagtgacacatttctccaaagaagatataaaaataaccagtcagtgcatgaaaagatgctcaacatcattagcttgtaatattattcatctataaaaaggaatgaagtagtggtacattctgtacgtattacaacatggatgaactttgaaaacacaatactatctgaaataagccagtcacaacaaaatgcatattgtatgattccatctacattaaatgtccagaatagccaaatgtttagagacagaaagaagatttttggttgcgaagagctgaagagagatgtgggagaatagagagtggctgctaattgttatgctaatcttttgggggtaataaaaatgttccaaatttaggtcagtaatggtgcacaactctgaacatactaaaaccattgtgttgtagactttaaatggctaagttttatggtatgtgaattttatctctaataaaggtgtcaagaaaggaataaactaggtagggaaacatatcaacctatccgcatataatcatgtgaagtcacaggtgcctaatgcggtaactcactaaagaaaacaggctgctgaatatattttaaggtttcagtttatttcctggatctaaaagaatggaggtaaggacatgaagagggaatgtatacctttgatgtatttgatttagaagcttaaaataaagcataactacaatttcttagttcataagatgtgctgaataatgctgatgacttagtttctaccatttcaataaaaagtattatgtgactaattttgatgttatgctactagttttcttagactatttgaagacatgtgaatttgtaaggagaagcttttaagataaattagtatctctgtgagactttttatagacataagtctggagtataaccataaataatatactttagtaacacaaagactgcattacaaaaaagtaagcgaaaatacaagcaaaggcacagatttttaaaacaaatgctctcttcattcaaaagaaatgaactgaacatctgtttgctgggccccttagagacatgaagttgcgattcctaactaaaacagaaaaggaaaatatcaagctagtatgggaaatagacttgaaagcaaataactagttcattgatagtagctcctggtagcagaaaagaaagcatgatcaactttgagaaagtaaaacacacacacacacattgtaaagaggtactgactgtacattttcttgtagctcctctagcatcactcaggtaagattatttaatgcaattctcatcccaacaatagttattttgtttcttacatttggggttggatgactctagagagatttcttcagagaaatatgtttttgtgtattttgagtaaatctcacttttgtaaagagagagagtgttcccctgactcacagctgctgccacggcttccttccgtctctagggtttttgtgtatggatgagatgttaccatctcagctctgacctatggattcatatggtgaacaatctgccagtgggacagtttaattcaggaataggtcaaaatccccaaggttcatatggtgatttgcagacgtgctacctggttttaaatttcattgtttctaatctcttgatggtacagcatgatataaatttattctttcattatgataagaatctaccgaggaaataggagtagcacctgcaacacatagcatggattctacctcttttactttaagaaaaaagaaagaaatataattggaagtcttgttcaagcatctgcagtgcctgactcagggcactcaatcaataaatatgctggcagaactaaatgatgtgtttcctgcattctcattgagctttttccttgttactaagcagcatctgtgttaggtccatcgctgacggaacaggctgcagtggtttatttttaagcaaaagtgatctcattggaatttgtgaattaatggtaccgacgttggaaaatggacagcttctttgatttccacctgtttttgtgaagtgttggtaaggaagcaaacaaatagtatccattttgtaggaataacatacaaattgttctaaatacaaagactgctttactctgagcctcagcttgggggtctgtctcccctgtgaagctagccctccataacccttgtctcctttgagttttgaaaacacctagtgcttgacatctgccaaccgattcctcacacatctttggaggagtcatttcacctctcagcagctcagtagctcaatgtaactttccttcctcctcattatggtggggatcaggagagataataaatatcattgcactcggaagactataaagcactttagagttgtcagttattccaaattgctcacaaaagcagaatctcacagaaagtcttggactcttctgggtagattttctttgttaccaagctgagtttgtcagtagcttacctctacctgcagggattgcatgcccctccagcagctatgctcgggtgatgggatttatttctagttttctggtatttaaaatatttagagaaggagttccaaatggttctccaggaattttactatttaacaaatatctgaggaagggaaaggaggctgagaaatttgcattacacattggccaccgtaaagagtaactacatcactgcagatttcagcatgcctttacatgctggtgagctaaccaggccaagtcaatttgaagtgccatggagttttctatagtatatcaagctaaagggctggaaggaactttatttttcagtgatccctgaattgcctttgggatgaaatccaaacagtgaaagccactgccccttcttgcatcgccacctttatgttgccttccagtttaagaaggaagattgagcacagaaatgttccttgttttgatggcaaaagcatgtggaagtgacagcaaaataaataacgaaaaacacagctgcagccgggcatggtagctcacacctgtaatcccagcactttgggaggctgaggtgggcggatcacctgaggtcaggagttcgagaccagcctggccaatatagtgaaaccctgtctctactagaaatacaaaaattagccgggctcggtggcaggtgcctgtgatcccagctactcgggaggctgaggcaggagaatcgtttgaatgttggaggcggaggttgcagtgagccaagattgcgccaccacactcccgcctgggtgacagagcaagactccgtctcaaaaaacaaacaaacaaaagcatagctgcttctttctcaaaaacaagaacaggagttcttcacatacctggattgaaagggaagacatcctcataagaaggaacaggtaaaaacctatggcaggagggaaggccaaatttccatcatcctcaagtcatagagactgaagtcaggcacaacaggagggcttggaaggttggttttcatgagagaccaggggtacatggagtccctgcctgaaaactgggttcatggtcagaaggcctcagatcacatcacccatttgggggaaagggctccagcctaaatgaccaccaagacttagtttagagctgttacctagacagaatctcaaaactgcctgaggaccacccaaccaggggcctctcaagacccagaacacttgtaagacagaagcttacaaccaagaaccacaaagcatcttcagaaaacatccccccataaagcagaaaccaacccaacacacatgaaaaccaaaatccaaagaaatttaaatcaatagggaaaagagaaaatgacattttagatttttgaaataactatcactatgctaaagaagcatgaaactataaaatatgagtagatgatcttgaaaaaagttatttagatatattagatattaaaatgtaattattttaaatttaaatccttagttgggtaatagaacagtctaggtgtattaaaatattgacaagtaggagattgaactgaagaaatcatccaaatactcccaaagtcaaaaaggaaaaacttaagaaaaagcccgaggtgtggggattgacctagaagctccagcacagtccagatgggattctggaaggaggggatcaaatgctgcaggagccatattgtatgagataattactggtagtattcctgatgtgaagaaaaatagtctttaagctgaaaatattactgactgttaagcagaatttttaaagaaaatccacaagtggacattttttctaatggaatttcagaatatcaaatacaatgagagaatctcccttcccctctaggatttcctgttcacattgtctgccacgccaatgccaacacacacaatctcttgaaaatactgcatccaccgacaactttctgcccttatgagccttcctagcttgaatgtttttctctctcctttatcttggctagcagcctctttccttcagcaagtcctcctggaatcaatccctcccactttcttatttaatagtctgcttccatattagcaggacaagccctgttcctctcagccccgtccctgctatgttctgatcattcattctgctttggttccactgctctgtgagcttgtataaggcctttctcttcttcagggctcagcatggtttgtggaatgtggcagtctcctgtgcctgtcattatctcagatgattttgggaatgaatcaaatgataaaccaatgaattagatatcagttgaatgtgcaaatgagccatctaggtacagagaggccagcagtgagtttcttaaggagacagagctaattaaggacagagtcatgtcctggcttgaatggagcaattttgatagcatatatcataatgcctccaccacatactttccctatatagaagtcttaagtgttttaaaaatacctttaaaaaacaaataaaattacagtttttaaaataaaatacatgtatagaaagaaagattttcagaaagtgaatacattgccttttcatcttttatttccaacgtttgtttaaatggcagtcttacatgttttttcttatgaggcacatagataccttaagttgcatggctagaatcattcttgaatagtgaagtttaatcagataaaatgtaaatttcaacatgattattattttctgaccacgtacttaagaatgtctcaggaagttttagacttcttaattgcaagatcagagtgtaactttattagattaatgtctagtaatttttaaaattctcatttattgtcgtgtatatggaagtgtgtcatgtttgaagccatgtgccttttcctgaggctgcttcagccacacctagaaagctcctagagcgaagaaagaacttggtttggtttaatgcactatgttcagcgcccgggatagctccatatacagtcatgtttcacaataaggccaccttgagtcacagcattctgtaattttcaaaagactgctacacacagtaaccctatttgatattcaagagatcagtcaatgcacaaaggaatacatgacttttctgacaatttcagtaatttgtcaacaaccagacccaaaaggaagaaaccaaaagtgacgtaataaaacccatgcaatgcactggggtcctagaagctttgaaaattttatttagagattatttattcctatttgtttatgtaatcctaacagaatttctttctgtttttctaacctgccacagagtttaaaacacaaaattaaaagaggcaaatggttctgtcaaggtcaagaacaacagtccaaaaagcgtaacagccagaaattgaaacaagaaacagacataccaccagacattgaaatacaaaaacacacagctctagagccactgaatgtggaatgcacacagacatatgcacctcagttagcaccaagatcaccccacatagcagcacaacaggaaactgttgaaatgagaaaactgggagtctttgaaaaaaatgtgcaatgatatttagcatcttctatttaagagggcagggaagtaaataagcatcctaggtagataatgtccatcagatgtggtcaagtcaatatacagaggagtttcttattagtatcacagaagtgaaggtggtggaatggactggcctgtaggctcacaggtcaggcatgctgacagccctgtgtcttttcaaagtcaataagtggatttttgtgcctctaatggagagagcctcttctgaggaggagcaaaaactctagaagctttgatctctggaaatacaggataaaagctctcagatttttaaagtctcacccactgacgccattaactaaacatctcatcttgggatgaacattagctgagtgtgttcacaggcttatcccaagtgctttctcctaagccttgtaacagagatgcggcaaggcagaatctggtagtctgtgtacagataattggggtttgatcctgtctgagcaagaactaacccacaacccagagacagccagggacaagtgaagcttatggagaatgaagacctaaggaatattttctgtgtctttgaattctcagcagctaaaatgctgcacttaatgaatgcttcatgattgaccaattacatcatatgactgaggtccattctggatatccgtatcttcctctcgactattcccaccctattgttcataaatcaatcctgaaagaattatttacctctgtgctgagaaatatgatcacttacatgctgcaggtgtgggtgagaaggcgtgatgccgttctactgaatcatgatttccttagcataggttttgatagtttaattaaaaacagaatgcaagactggcttttatccccattcacttatggacgtcatgtgtgttcccatccatactatttataaatgacaatcagaatgtttatggtcctctcattttactaattatgaaacaagcttaactctttgctttttatttttttctagcggaagataatagtctgtctcaaaagaagaaggtcactgtagaagatctcttcagtgaagacttcaaaattcatgaccccgaggctaagtggataagtggtgagtccaggtccttcgtgcacaagacatcgcttccccatgcctcacccccactttcaataggttgggtctagtaatttgcctctcggatttccccctttggccacagaaggggatctacagagcttttgctgtagtcatcatcagattatcattctatgaaaatgtgtatctggtaaaatcaggcttttgtaatggtgttgcctcccgagcatccacacagccttcacttaatgagaaatgggtctgctgaagacgtgtcctttgtgtgccacctcccagagacatcatttctccgggggagctgtggggtgttgcttagcaacaggaacagtgcagggcacggtgagctttccttccttctccacaatcttcattcccctttgttctcttgctctctttccgttaggcagaaggaccaaaagcaactcatggagttcttgtagaatagcttccaaatgaaacttggagtgctgtacacagatgcagattcatttattttccctgttgaactttaatttggattaaatctactttccttgtatgggggattttttttttaaaacaacagaacaaaatacagttgggggcagaaggcatatgttcacaatgcctgtgttggttcataacataatctatttcttctaattgggtctgaaataattcaagtgcatccatggaagatgtacccatccctccacaggccaagttgccagcacctccctgttgcctccattgctgttgcttacatttcatctttgcttcagtggaatacacttgaaggtttatcctcaggccagagaactttatagtgatcaaagtctagttcagatccttgcttttataataaatgaggtccagagaggtcaagtgacttttctgaggtcacagagctgatgagtgcgagctgtggctagcagcccgtcccctgacttccaattcagtgctcttcccaccatcctcttttgctgagtgatcgagtgtcgttgtatgtttttctgtcaaactgcttctaaaatgcttttcatgcttcacaaactctcagaaatcaattaacaatgactcttggctgttagtctcctgcttaggggcaatcacttttctttcgtcctctattgtggcttcagtattcatttctgacccttagattagcttatttaaaagtgaaaaaagtaggtggatctcagagggaatgtattttagaaaactggggagaaattagagcagcagtatatcatgaataccaagggcacacagaaattaaaaaacaaaacaaaacagcacagaggtctttttgtttggtggaggaattgactttgcctttgttttcggctgacctgctgaaatgttcgtgttcgtgttcactgtatgttcgtgtacacccgctgcatcagcaaatgcaagcacttgtgggatgccacaggtagaccttgggaggaaaacatgacaactctccttgaggagctcaaagttgtgttggagacgtatctatgagcagccagtgggaatcctaacacacaagactcagagaggaggatcggaagttctcatccttctcaaaggatgtcccagagacagtgcacaaactcagtcttaaagcgatggctaggagcttgttagagaaagctaagaatagagccctggaagaatgttaggtctagaatgttagtcttgctaaaccctggttgggggaaccaaaaccaagctgagaaacaatgcccagcagttacaaaaacaaaacaaaacacttagacttgtggtatttaagaaaatgagtgagcacagtggctcacacctgtattccagcactttgggaagccgaggcaggcagatcgcttgaatccaggaatttgaggccagcctgggaaacatgttgaaacgtcacctttataaaaaactagccagccatgtgggacctctggtcccagctacgtgggaggctgaggtgagaggatggcttcagcctgggaggtccaggctgcggttaactgtaatcatgccattgcactccaacctgggtgacagagcgagaccctgtcaaaaaaaaaagagtgaactctttggtatttgtcaaaaaccaattataaaggctcagttaatcattgcagagttacttcattcactttaagctattacgtctttagggagcaggtttgtccatggaactgtttctcagtggtatacatgggagtcacaccacccaccaccatgatctcccaccaccaccaccagcagcaccagcaccacaggcttctctttctgctccttctctgcttctccttctccttctcgtggagaggcagaattcaaggatgaatcaagaggccagaaacaagggacaccaaacctgagctctagggttcagagtaggttggaggagggcctgggaagacgccatgatatgttgaaataaagtgtattcatacctataaggtatatatttttattagaaagcccatggcatcagacttggcctaaagcagcattccatgccaaaaaaaaaaagtatatgtagagatgtggagacacaagagcacagatgtttctggaggaacgtgtgccagttcatggtataaggagtttgatttttatgagcaaatgaatggagtctgcccagagaggcactggctttctggccagaggagaccagccggattttctttatatccgcaaagctgggagttaatacacgcaattgagacgtggctatgtgcccagcagaaaatgcccagcctgcctgtatcatcaggttatgcctattcataatgaccacctgcagttctaaatggacctgcctttggtgttgaggagctttcttaggatgattctccctctgtaaatgtacacactgaagaaactttgctgtgaagtaaccaagtggttgggtccccaaatacaggtttgatttggagtgttttggaacctaataattccactcacacatgaccctcagcttccccttacctttttttttttatcttattcctcttcctaaacattctctctcttcccgctccctaaagaggcaatagcttaaagtgaatgaagtaactttgcaatgatgaacggagtctttataattggtttttgacaaatactatagagttcacccatttttttttaataccacaagtctaagtgttaagatctgggaaaagattactacaaatccataggattatctcatgttgtagagctgggatgagccttagaaattattagaacattaattcattcagtaagagatttttgagtgcccacagtgtagcagacaaattgctgggcccaaaagcggtgagcgatttgttcatggaactgtttcttagtgatagacataagaattattacccaccaccaccatctatcaccactaccaccatcacagtctcctcttcctcctcctcttcctcacatcaccgtcatcatcataacatcatcatcaagatcatattatcatcttcattatcttctgggtgtttactgtgtcttaagctctaggctaaatgatctatatacatatatatatatatagacatttaattaccacaactacaatgattcccattttacagatgaagaaactgagtctcagggtattgaaataacttgatcaatatcacaaagtttgtaagtagcaaaattctgatttgaacctaggtctgtctggtttttataaactaccctattctggataaaattcaggtctcctgccaatttcttttgcaaccttagtagttacattgtgtattttaaccaaaattataggttccgaacagttcagaataattgccactttttgaagtctctattctagctttctattcccatagtgaccatgtcaaagttacaaaatacgcaagagatgaagaaaaatggtgtaattctctacagaggaagagacttgattttgttttttgtttgtttgtttgtttgttttttagtacacattaactgctgaagttaacaagtgtaccttgggtttaatattggagttaacagtctggaactaatacgctttatttatcaggaggaaatgtgttaggttggaattgaatttcccttccctcatttttatactgtatgcttaattttttaaatctaccttgtctgaaaatgattggtacaacagcctcacattctctaacatcctgaagaccttgtagacttccttacttgtttgttgcaactactggggcaagccaaatgaggtgtgtaaagccatgaaaaggcccactctgggccaggtgtggtggctcacgcctgtaatcccagcactttgggaggccaaggtgggtggatcatttgaggtaaggagttcgagaccagcctggccaacatggtgaaaccctgtctctactaaaaatacaaaaattagccaggcgtggtagggcacacctgtagtcccagctactcgggaggctaaggcagcagaatcactcaaacctgggaggtgcaggtggcagtgagccgacattgcgccacagcactccagcctgggtgacagagcaagactccatctcaaaaaaaaaaaaaaaaagaaaagaaaagaaaaagaaaaggctcactctgggctccctctcaaagaggtgcacactcccagaagtggtcacagcattgcctctccaagtatttgctccattgagtaaattcttatacctgttataacaaccgcattgcacttcttaaccttttggagcccctttgtgccattctgggactccactctaggggctgtgatgagatattttggttactctttgtttacatggaccaatcatcctgggctcccctggcccattccctctttctcatttctagatgatgataattgcaaatctcaccttctctgcccaaccctgcaaactccctccccatcctccttctcagctgaaactgccagaagagagcttaggaacactcccactgtcctgtcaactggcctcaacactgccgctggctcttcctgcaccactcccaccccgcccctgccccgccccacaggtgacctgtctgctgtctgcactcaatctaaaggaaccacagatgcactcgcttcacttacctgaggaatcattacagcaggcccctcctttctcccctaaatttttgttctgtattggctgattcctatcatgaacgaaatgtggtcttccttctcttaccttaacacaaacacctcatctcaagtccacatgccctgcctggctcggcctggcttccctgttcccctttgcagcctgaagcagtcttctatctgtaacatctccaggtactcttcttccactctccctaaatccactcccgttaggctaccacgcccagcactctccgaaactcctcttgtcaaggtcagagatgacctccaggttgctaaatgcaacaggcatttctcagaccccaacttattttacctgccagcagcattggacaccattgattcctcctctgccctggatacacttttttctttcttgtcagctcatgggcatctcctttgcaggagggttggccggttctccctcttctccctgacgtttaatattgctgcaagactcaggacttgttcctctccttttcatggctgcacgccctcccttggtgtctccctccagtcttatagttttaaatatcctccatttactgatgattcctaaacatatgtcatcagacaaaccttctctcaaatctctcagatgtctgagagacatttcaattttaaccttaatatctccaagtctcagtccttgatttccccccaaaaccaaaaatacaaaagaaaaaaaatccaccctatccacaacctttctgatgtcagttgatggaaaaatttgtagaacaagctaaggaccttcaagtcatcttttattctactttttctctaacatcccacatccgatccatcaagaaatcctgccagctctgccttcagaacacacgtgcccatcctagcctccacgtgatgtttgggtgcatgaataccatggcagacttggcatcagtccactcggagggttggagggctggactcaagcccagcagcagcaggaaggaccgaggctctactccggcacctcaggtactagctcaggtgcaaggagaaggggatgcttgggtgactggggtggaattttaatgtttctaactttaaaagtctgaattcctcaagtttctcacttatcctcactttgtactccctgaggggaaataattcacccccacaatgttaggtattgtctatatgatgatgagtttcaattctctagctcaaatgctcttccgagctatacacttggagagagagagagaggggtgtgtgtgtgtgtgtgtgtgtgtgtgtctgtgtgtgtgtgcatgtcagtcactggctaatttccatgtccactgcagtatcttacattcacctcacatcctcatgcccagcactacatcatcctcccccaacctcttcacagaccccccgctgcccactgtgcgagcacagccctggccccccgaccctccatgtctcagactctacatgatctgtttactctcctgactcatcattggccatctccccagttttctcttaaactttgcctacgtgaacttctttggattgcttcagaagtccatcttcttttcccccagagtggctcttacataggatgttccttctgtccagcccactcgctctcctctccgcgtccacttgtgatcactcctagtcaccaccctgcatgttatctttttcctttaagttgctccctaattcttgctctgccccacattgactcttctggttttggattctcctatatcctgcactgacccttttgttacataggttaagtataattatttatgaatgtaaactccacaaggatgggactcgcatctctgtttactgtggtatccccagcaccagcaaagtccccagtttgtggccgtccacgaagacttcttgggcattttctcatttgatacttaaacagcctagttttaaagataaggaaacttacaagcatgtgatttcacatagaatggtggaaatcttttctgatcatgtgatttgggggcagggacctgaaggtgaggatcatgcagatgagttctctgggggaaagccttccaggcagggtggaacaaccaacgcaaaggtcttggtgcaggaggctgcttggcatattcatgaacagtgttgagcctgagggagaagagccagagataagatcagagtggaggctgggaccaacacctacaggctctgtggcaatgaagggggcaaagggagtatgggggagaatttagagaagctgagaagttgggtttaacttattggcactgaaggttttagaataacaatgacatggtgcaagcttaggctgatatatcaacttcttgtattatatatactacacatttgttatatgtatgtatttattacagtaaattagaaatcagagattaacacaaatttaaaagatactaaaaattacctgtaacccctctaactgaaaatggccactattaaattttcatagctctccttccagataataacatatattgaataatactaagtgtattaagtaggaaaatattcataacctatacatacatatattctcatggcagtaagtatacatcgtcattatctttttaacatcttaatagtatttcacgatattaatgtgccttaatttgcgccatcttctgatattgaaagtttaggctgtgacaggaaaggaagtggcaggtgtaaaaagccatggtgagtgacaaatcagcaggaggtggtagtgtatagaaatggaacaccagggaagagagcactgtcaaggctgacttgaggatctcaggcctgggcagctggaatggtgattctctattcttgacagggagtcagtttctgtgactggatgaagagtttggagtggaagtctatgagcaataactcggtggaaatgttcgttaggtattgagaactggggatgaagccaggtgagaggttggagccatctggaggaccatggaaagcgtgggttgtggaggtactgctcagagcctctcggagggaagaggggaagagggacacggaggtgtctgaggaagtgtggtcagggaggcaggaggagaacttctaccacgccacgtcaaagtcaaggcaggagaaaatgctctaggcgagttagtgtgctgccgattttgtaacggcagatgtaaatgaaaaaccaccccacggtggccacgcacctcttcctggctcacagccccagggacgtgtttgtgtagacaatagtggtgatcatttgagtcatatttaaattgtttatttctttctgttaaaggtaaactgaggcacaatacaatttttttttttttaaaagcatttatttgagcaaacagtgattcatgaattgggcagctccaaaccagaagtggttctggggttctaccaagggaacaagggagaaggcttttacagaacaaagacagaagcaaagcaactatctgattggttacagttatggagttgccttatttggtcaatcctgttggaaagttcttagttacagaagttagttgggagcttctgactggttagtctttaagtttcacttttctttaatataggcatttatgagaaaaagcccaggtgaagtttttgtttcgttttgttttgctttgcttttgagacggagtctcgctctgtcgcccaggctggagtgcagtggcacaatcttggctcactgcaacctccacctcccgggttcaagcgattctcctgcctcagcctccctagtagctgggattacaggtgcacaccatcacgcctagctaatttttgtatttttagcagagacagggtttccccatattgctcaggctggtcttgaactcctgacctcgtgatctgcccgcctcagcctcccaaagtgttgggattacagatgtgagccaccacgcccggcccaggttaaattttatttatgtttgcaattcacacaaggtcaaggttacttacacttacaaggccaactggctttgtctccttgaggattctttaggccttttaacttacttttaacatcactaaccacactaatttatatggcaaataccctcttattgacactgttgcagactatagtaggggaaaggttaattccagaagcagggtgaaagacgcttacatgcagacagctttccaccctctcctcaccgcatctgtgaccaacagaaagtgtctcctctgtcttaacagaatttgtcactctgctcaggtagctgatgccactgcacctggtgagccacctagctcaacaaacatatttgcttttacagatctgccttttatgaaggcagcctgggctaaaccttggaaatggtttgataagccccatgccctgtgctctgagcaaatcgaagcctcctgcatccttcaaggggtcccctctcctcccgtctcctcccagtatctcttggatgcaggcaggcctggagctgattgacagaagctgctcgctgggcctgattaacttgtctgctagctccaggcagagcttggcctcacagcccatccggctcctgcctcctccccgccccctgcagcatgttcaactttagtctgaatatggtgatagaccatgtggctggcaccagcatctctccactgtctgtgtttgtttacgctcattttcattaatccagccacttgttagcagagagccctctgtgtctctaggatgcggtactagagagactgtaaaattgaagaaaattgcttcctttgaatggaggaaaatatcagctggctggttgatactggaaaagtatatgtttcagaagataaaattggagttagtgcacagggctcaaagcaacttgatttccatatgtgctttatcctcttctcttttgttatgctgaaaaaacagatgggttttttttttaaataaagcttatggggttaggtagaggggggaattcaagtttaaaatggtttgggtatttccactgctttttggaggccacatttttcaatcaaaaccattaagccttagaattgcagagagtaataaagtcccctcgagggcacttggtacagcagcctgtatcccatggccagcagggacttcagggaagtacccaggaagggcaggcttcgtaagagggactgtgttctcccacggctctgagagtgtttggagagcataacagtgatcatttgaagtcattacataaaaatacacactgaagcacatcgttgtaccttaatgaagtccttaagaaataaacaaaatgtaattatggtttacattggtgtaaaccaccagtttattttttctctcttttgttgtcatgctcaaggtcgcacctttccttaagagaagagagcctcagttgtctggcattaggaacccaatcatgtctctgactattttcgtgcagtaaaatctgtccatgccatcactcccattttttctgcctaacacagtttcaacagtatcctgtctgcacggccaggcttatccttaaatgcatcttccccatttctggtctctgagctaagacaattatttgcttaaacttctgcaaaagtttcctattggagttttctataggacctacgggaagaactcaaaagacagtatcatttagcgccagcagcagcggaagcaataattgcaacaggaattgaaaggataacagtagctgcatgaaatatctcagttacttcagttcagtcttcactgaaacccatggaggcaggaattttttttttattatactttaacttttagggtacatgtgcacaacgtgcaggtttgttacatatgtatacatgtgccatgttggtgtgctgcacccattaactcttcatttaacattaggtatatctcctaatgctatccctcccccctccccccaccccacaacagtgctggagaggatgtggaatttttacctttactttagaaataagaaaactatgagtcaaagacactaaatcactttttcaaagttaccaagatggctttagagaatccagggtgttcctgcctcagtgtaccttgcctccccggtctcctcaccacccctactcatggcctctattttgttttttttttgagatggagtctcactctatcgcccaggctggagtgcagtggcacgatctcagctcactgcaacctccgcctccctgattcaagcgattcttccgcttcagcctcctgagtagctgggactacaggtgtgtgccaccacgcccagctaatttttgtatttttagaagagacagggttgcaccatgttggtcaggctggtctcgaactactgacctcgtgatctgcctacctcgaccacctaaagtgctgggattacgggtgtgagccaccatgcccggccactcatggcctctattaccacgttcctggccatattaggttctttggcagctttgtgactttattgctcttctctttttctgaaaataccgttgctcatcacttctctgcttcagaaagtctcattaatcctcatggcttgacccaaaatacattctctctgattttccaaattagaattagttgtgtactccacgataccgcagtagaactttacaaaacttcagtcagagcatcagcttgtgaaccagctagggttggaccaccttggggatgcagcccacttcgcagaggctggatgcacttcctccgtctgaaagcagagagaggtgtgtcttggggcagggcagccgatttcttccacaccacgctggtcccttccagaggtgctgtaggtcctctgcctgtaggtcctctgggcggactctagttcctaactgatggatgatgctgggccccgctgttgatgctgcttaattcataatttggggactcaagtctctgcaggctccactgggccaacttgcttcctgcagagatacatgttcagactctactaattacttttccttggcaaacgttgcatccctgggaaatttaaatacaacttccatctttgttgactccagtttagaccccggccaagactgaaatcgcgtttcaactttatttgtttgcagtatacagagggacaggctcttctttttttgtttttgcttttttgatttagggaaataaatatttgattttgtgtgtatatacgtgtatacgtacatatttttttctcttaagtaaagggatctcatgtgagatgttcatgtttttttcctactctgataagtagacagatattctccaggtcattatacggttgtttccagggctccaaggatctcaagaaataatcctgaagaccccgccgtactcagcccctccatcctcctacctaatagagcagatgacaggatacgccgtgcagcgtgccttgtggccagcctggtctttcttcaaggtcaagctcaaaatcaaagcctggggcaggcggttttctgcctggcaacgcagctcagccccagcagcccacagaccaggatgcaggagtttgttttactttagttccgttccaattaaaagagtctgagagctcaggtgaatcccaatgcactgtagctgtttggcccaagggtgagattctgccgcgtcctctttttagagtgaagcgcattcagaagacccattaattagagactattcatccttcaacacgatgatattcacatgagcactgacaccaccatttattgtctcagttaaattacttcacagagtccttaaccatggtaacctgctagggtctaattaattatcattgacatcttttcaaacatcgatcaccttcttaattaataaaaaagactcacttgatctcttcggtaactgagcaccgtcccctgtgactcatcaatcttttgcccacagcatgtctcacttcacattcaggtgtctgtctgcatctctgtctggctcttgacagcaaacatcttgggggtcacaggtatgttgtagtaattatcatagttccctcataggtcacagtatctggggtgggataaagtctcaataaatattaactgattgaatgattcagcaaatgggcaaattgagtctccagagaagaggcctctgggaactgaatttttggttaattgagggctggccaggctctttattgtaactcttcgtgttttaagaaagtagacacacgtgggcggggcgggacgcagtagctcacgcaagcctgtaatcccagcactttgggaggccgaggctggcggatcatgaggtcaggagatcgagaccatcctggctgacacagtgaaaccccgtctctactaaaaatacaaaaaaagttagccgggcgtggtggcgggtgcctgtagtcccagctactcgggaggcagtgagccaagattgcgtcactgcactccagcctgggtgattgatagagcgagactctgtctcaaaaaaaaaaagaaagcagacacacccttgtaataagaaacgcacatctgattctattttcttgctttaactgggactctctaacagatgaaagagatagctcctgctactcctcatactagatgtgttctccatcgtaagtttgatacttgccacttattgatcatgtgcagaatgtgccagacatgatgctaagttcttaatcacttagcatcccgtgaaagacaggcgaggccatcgtctctacacagcccacatatttacaaatcttccaactggatggggccatccagaaacacaggcatgaagctatgtcctatggaaggtactgtggccttttaaatatttggggtgtgatatcatcctggtctcttttccacctaaatccccgtccctcctccatcctccatcctgtgcatcactgggacctcatgacgtgtttatctctcagcgatactttgctaccagcactgcatcttctctgttttccaaaatacactaacacaaacatgcttcataacagacatttacaaaaagtgacaggatgacaaaggagaactgtgggtaccacagaagatgaagcaacaccgatatgaacagcacggcttgctcttcttaaagcccctagacattcttgcttaagagaacctttccttgactgcccctttttctcttgtttatggggtcttccaacaactgcatggcctggttgtgctgcggttgcttctatcacagaacttttccgtagcccccattgccctaaactgttgccaataaagaccaagttgggattcagggatatcgaagtgaatcagagttctcttcaaacttagtgtgaatctcatgttcacatttaaaatgctttaggggcccttttgtgcagggctgacacccatatcctatgctcccttcgcaagctgagtatttgcaggacgctgttctgagattggtgtagacctttctaatatccggcactttgcagttgaaatggaattcgtgctttgtggtgtcttttctcatatctctttagtgtaaaagtggtagaaatgtgtagaaatagatatagcatctggatattgtgatgctgagcaggttctgggcttttaaacccagatttccaaaataagtgccaacctcacatctgatgcttctgccgagtgctccctggaacccagcctagaccgtctcttgggtcaggatcttctgttctctctcaagaccccttattcattccccctcttctctgaatattttgggatcctctgaaatgtcctccctccagaaaaaaaaacaggtgatagctctcagattccagcaatttatgaagcagattaatctagctgtgctggtcaggcctctctcctgtgctcctgcctcaggtacctttctcaaggatcaacaaaaagccaaatgcaggaatttccccaaacgaaagatacgtttctggaatttctaccctttgcgaggcaaggaaccgacatgtgcattcattttcttaacttctcccagatcacattcttacacaggacaacccaaagaagggaaagatggaataaacctcggaagttcaaagtagcagaatgtttcttatttacaccagtgttacagatcaggggccctagaatcagagaagttaagtcacttaccttaggccacacagctaataggtgacagagctagtctttactttgaaaatgcttctgacaattctgaaaacatgcccaaagtccagtggaaagttatgttcactaaatacaacggtaccaattaagtcttcatagggttgaacttgaatctgcaatggaaatctggaagtatctgtgaaggatgagacaacacccccaggtgtctcttcccccggctccctcgtgctctctcaagatcagcccagctcattagtgcagcccgtggctacatccaaagcacgcagccctccttgctgcagtcttttgcaagccaggcatcctgaaggtcacagcagaagtgctgtggggtaaaggatgagtttgtcagcagtgccccgtggctgcctggggctctgaagggcagccagatggagtgtgagctttgccttttccaccagatgttatttacttatttttgctgttagcttctcactcccatctcaaacacctctgggcaccaaatacttgaaagtagtttgtgatccgcaaagacaaattcctaataaaagtctgaaaataaaataatgttgctggagaattatttgggatacttaaaagtgttgtgtgttgtatctaacgtgttgctggtgttttccatacatccatgctagctgcttgggaattgccgagttctgagtcaggaattttaatgggcacatttattcagaccctgagcctctgctgcttagttctcaccagtgataacatagtttacagagtgacagccggagaccaggaatgaagctttataagtcattttaattatttgatattacttgtaagttgccgaaggaaggagactcctgtatgactatactgtaggtgtctatttgcgacacaccagtgaacacgcacgtgcgatatacaaaggacaaaatgcatgtgtgatggtcagcgactgagaatgcccctttctggctgacatcagaggggtgcatggcaacaaaatgtcatcccaatctctcatgggatgttttcttttccaactttcttctcaatggcttctgacattaaaataggtttttactgaatataaagtacttatgttcctcaataaaacccaaattgttgggttttaaaaacttaatgttggattaagatctcctaataagcaaggttaaacaaacaagggggttggaaataaaattagggagtgccaatttaccagctgctgtgcgttagcaacaatggccctgttagcgctcccccaggttcttcattaagctcggaaaatccttactccctgattgctcagatcccacagatgagcctagaagaaagtattaaatgtctaagaaaagacacaacatattcaagtctaaaaagatgtttctatttcactttgaggctcaagtaaacccatcccccgccccttgttctcttcccatcatcttcctttgccattggagcctacaattcgtccagaatcctttcctcctccctcttttgaatcagtccttgagacagcataaaagaagaacaaaagctccaccttatcccatcgccatccacctgtcttacatacttgaagaacaggagaagataaataagatggcccagcatggtcattttctaatttttatggagggacttgaatttgaaaccgacaccactgactgtgatcatgcccccagcatacgaaggaggattttcctttgggctcccaggcagatttaggcaagttcctcttctctgcctgccgtgacctttagaaatcatccactaatgtgtcttttcatgacttcccttccagcgttaagttccaggaacttaatctctttaagtgatttctgtccaagctcagtagctcaaggatcccataatgttaccaaaaaagactaagatctccatggttctagctgcatccaacaatgtaaacaggtaaagtagcatccttggagcatcttttattcactttataaatatgataaaagtgctgctaggtgcctaaagctctgatttgttagatgacttgggatcacaaaggcaaataagacaagctttgtaccttgtatttagagcagaaggtatattttaaatgttaaaagccatcgctttatttttatttgattatgctgggggctgaatctgtaacaccttgtatagcacccaggaagtattagttaagtgaatgcatgcagacgcacaccacatggttccagaaaggattctgggcaactcagtgcaaacatcagatagcaatatcccaaatcccaacaactgcaacagaaagaaaataggagaaaagatgagatttgtgcccgcagtgcatgttgatttaataggaatttcaaaagaaaaaaggacgtctgtggccaggtatatatccaaagcctgctttctccttctcgcctcacctctgctggcttctggagctcacactcgttcacctcgtccttccctcgttccacccattccctattctggtgggataccgcaccgggtgttatgagtacatcagctcatttgatattcacaaccattcctgctggctggtggtatctccattttacatatgaggaaactgaaggttagaaaggctaatgaggatcacaagtctcatggctagtgtcataagagagcagatatgacttcaggcttgtctgtctccaaaagccttcgatgtggaccctacaccatcctacaaggaggtggttctctaatccgggatgaagctcttgttcttcctgtttttccttttcctcaacatatgaggatttgttctgaagatcagcagtaaaatctcactgaagggttgaggcttgttttaaacgagtccagaactaagatgtaacccaaatagaaaaacagtcagtaaaaatccacgaagctcccgcatccctcttcttaaacatggcccagtgacccccgtgtgcgggttaaactcgagattcctttagaagatcgtgcttcttatataactaggactaatgaaagcagcctggaaatgagtgcacagtttgatatgggacccatcaaagatgtcattcagcctgaggataatgacccccaaggctgctgcaagagccatgtttgagctagagccagatctccttgaagtttatgcttcaataacttcgttaagcctccttggtgcttttgggtcaagcatgactttagtaaatgaattatacgttggataagggtcattttgtaagtgaaccaaatgatgataggaaagtcattctctgcccatacttatggtgtcatctgtaagcacagacctgcaactttccgtggttcagtgagactgagaccctgggtaggtgcactcatcacaggcctcacagggagattttatttaaattgacacaaagaattgaggattggtggcccatcgttttatttgaagatgtagacagcaaaactaaaatatttggatttcttttgttctgtaaaagatttatttttatgttttgaatgcctaaagagagaaaatagttattgtatgatgatggtcatcttacataaatgaaaataccatttaatgacatgaatcttattcattctaagaaattaaaatgcctgtaatcattcatttatattgttgccttgttatttggctttcgtgaactgtgtaaaaagttgtgaatttttaaagaattcaagagcaggattccgtttctggaattcaatatcggtcacactgtgattgcgaaacctctgtatacggatgcaggcagggagttttgttttgatttggtttggtttatgtgtgagcaaaatgtgtcatagatctgtagaaactatccaattttatagatcctttcaaacatggagttgccagacttctcctaggaattgtagcaggtaagataagccaagaagtaagaggaccatctgatagttcttatcttacttagatggaaagtggaaagctcatggaaactagaaatttttgtgtgtgttggttcttatttattaaaagatatattgccggatattgtggcttacacctgtaatcccagccctttgggaggccaaagccgaaacatcgcttaaactcaggagtttgagaccagtctgggcaataaagtgagaaatcatttctacaaaaaatttgtaaaaattagccaagcctggtggtggacacctgtagtcccagctactcaggaggctgaggcaggaggatcacttgagcctgcgagggacaggctgtggtgggctgacatcgcaccactgcactccaccctaggcaacagagaaggaccctgtctcaaaaaaatatatattatacatattttttattatatataaatatataatatatgataacatatatttatatatatatgtatatcacttgtaagcctcagtagtttaatattactaacaaacttcacagtgacacatcacacaaatgatctcagcatcctagaacttaaaatctaggatgaatatgttcttataatttttgtttctttctatatttcagataaaactcagatacctaaatttcatgatagctttctccctgggaaattatattctcttcttattgcaagcaccacattattgatttccctgatacctcattaccaagactcttttctgcaagagaaaagacgctgagtactttatccaagtttcacatcaggcccagtgatccccaacccactgtctttccatcaatttgcctcctccaagtcaaccaaatgcattcagttaataattgaaaaaatggtataaaaataaatcaggcatgtatagacgttgtcctcaggtacttgcagattaagggagggagtcaggtaaatggttaaagacataacaaagcatgggtgctttctcgagatacagacagaggagggagaatacagagaaatggcagcttcctgctgtaggagcttagagagagtctcgtggaggtgacatttgaaccaaagtaacatttgcacataactaggacattgccatgtagaggcgtctggtatgaggagggagcagggaatttctctaaatattgcaggtaaaaaggtttaggaaaagagttgtggcatatccagaaactgatcagaatatggatttggcttaagcctgcaacattcagtatctggtaggaaatggggccatgagtgtgaggagaagacagaccctcagggcgtttctgcaggcccctctctagcagctggggccatggtgggctctgagtgatgagagctttttatttcttaaatgatgagggtggagtgtagatagtgggctaggagaaagacatgtatatgtgtttggctttggggggtttgttgtggtttttttttttttgttgttgttgttgtttgagacagagtcttgctcagttgcccaggctaaagtgcagtggctcactgcaacctccacttcccaggttcaaacaattctcatgcctcagcctcctgagtagctgggactacaggcatgcgccaccatgcccggctaatttttgtatttttagtagacactggatttccccatgttggccaggctggtctccaactcctgacctcaagtgatccatccaccttgatctcccaaagtgctgggattacaggtgtgagccactgcggccggcctgtatatatgttttaatgagtcactttctacataaaaagttatttgcaggaaccagtgcggggaggtaagaatgacttaggcaaatctccttcttttaataagcttggagtccaacaacaagtgggcgagtcacaaacaccaacagctgtgtgtgtacccagatgcaggaagggacacagaaggaaaaagacacactgaacatttggcacagcagtgcattgagccagggactgtcagagctgagtgctgtgggcctctggtaatgaccattaaacaaacacctgccagaaagaacttctcctccactgggattcaacaatagggaatacctcatccagtctacctattcgtaatagacaatttagtaggcaaaatcttaaattttcataaagaagaatatcttaagagttggaggtttcacacatattgtatatcttaattttcaaggagatgcctatgatatgtttctaagatctttttttttcctctctggaataaatactagtgaacttaatttatttcaagaagaatacagatgcacctcttaaacatactacatacactccatagtctcagaatccaagactgcaaatctcctgtctaaaaggaatgagttaatttttgaaaagcagagtgaagatgttatgacataaaagctataaaaattcacttaatttaattaacttgacccgaaggggagctatgtgagtccagagacttaagattttttttactatgtgagaatatcccattaccaagtgtcatatatttatcccataattttcagcatgttttactgtggggttactcctcaatggcaaatgttccctgagcacaatgaatggcatgcgcccgtggctagaccccacaagaaagtcaagctcctttgaacccacagtgtgctgggggtcttcgactctctggaagaggttttgtgaaggggcctcttcaacagaaaggggaaggagtccttttggatctgccccatcgttaccatccagcctgctgtggaacaaaggagaacagacctaacgcctgtgcttggaagaacttggaaatgtgtgctgggaaacaggatcgaggccttccttagtgtcacttcataacatagaagtgttcacgtgacacctgcttgtttagatgactggtgtagctcaatcttccatgattacagctacagaattttggatatgcttttattgtttagcctagaatacatttagagaatataaaaaatttactcccatctttaaggaggttacattctggctcatccattcactcatgcagcattgtgttgaggacctactatgtgacagggactatttcagccactgggataaaaaggtaaagaaagcaaactccctccctccccccatgaaccattgtaggttaaaatagcccagtggtatttttcagagctcaataccaggcagaactggatgtaaccttcacaaacttggaattccatctcacatctgacagactaaaaaactaaaatcactcaagtaacctgcccaattagagtctcttctagtttgtactataccttcaacctggagttgagactgaggaaggcggaggaaggtgagaagaagggagtgttggtcaatcctcagaaaaagaactaggacaggctgggcatggtggctcatgcctgtaatctcagcactttgggaggcccagttggttggatcacttgaggtcaggagtttgaaaccagcctggccaacatggtgaaacccccatctctactaaaaatacaaaaattagcaggatgtggtggcgggcatctgtaatcccagctacttgggaggttgaggcaggacaatcatttgaactcgggaggtagaggttgcagtaagccaggattaaaccactgcactccagcctgggagacagagtgagactccatctccaaaaaaagaaaaaaaaaaagaaaagaaaaaagagctaggataaattagatcatcattcacagcagcatattcacaatagtatcaaataaaaaattttgaaaatagaataaatgtatgcccattttttaaaattggcatgcatttcctgaatatgcttagaggaaaaagcctgggaaggaataaaacaaagggtcgtcaatatttatcttctaggatcaggcatgctttttttctttcatctcacttatctccttacagcatccctgacaactggacttacctgttttatctttataccagaaaccagcccactctaccaggccatgcaaggtctttcctgctcagcaggatgatgggggaggacgcgttgtgtctctatcatggcaatcagaagaaggagaagatattctgtcatcagggaaggggtgaaaccgagcatgggagagaataatatcagaggcagttgcctgcttcatagatagttacagaaaaacatctgaactgacatggtgcttacatgagattgccacagttgatacagctcagaatacagccttttgaaaagtctaagcttagaagcagtcgagaacacaaaaggaaagaaaggagagtgaggtacttggactgagcgaggtggaaggtaatagaatcccaaataattgggttaaccaaatacgcaatgaattttcctcacatacaagcaatcagagatagaccatctttttattattttttattttattttttgagatggagtctcgctctctcacctaggctggagcgcagtggcatgatctcgggttactgcaacctccacctcccaggttcaagcgattctctgcctcagcttcctgagtagctgggactacaggcacatgccaccacacctgattaatttttgtatttttagtagagatggggtttcaccatgttggccaggctggtctcgaactcctgacctcaagtcatccaccctcctcagcctcccaaagtgctgagattacaggcgtgagccaccaagcccagccagatagaccatctattatggctagtgtcattgccctcaaatatcaaggacccaggcttctagagtagggtgttccaacctcagcactattgacattcggaccagatgattctttgttgcagcagctgccctgtgcactgtaggatacatgcctgccctctacccactcaatgccagcagcacccaccacctacgctgtaaaaatcagaaagtctccagacattcccaaatgtcccctgagagggcaaaatcagcccttgttgagaaattactattctatatccctgctctgccatcagtaacatatggcttttatctttagattcacaaaagaaaagtaggcaggtgagtttgttggcagtcacagctctacagaagccttgtggtagctttcagctcacatctgtctcgtggccctgagcttggccacgtgactaaccctttgttacttgcacagaagtcggggaggagaatatttttatctggacatattgaatccctagccaacattagggttctgaggaggacagaatgggtttggggcaggtgactggcaggctctacaagaagacattagagaagaaaggagtaaaacagatatttcactgacctcaatgataaggcatttcatggatacaaaaggagggcccccctgcggtacaaagcatggccattctagcactgcccccctgccttctaggagcacagagtgtctgtgagcactgcagcagcccattcccaaagaaactgggctcctgttcatattccacgaggcaagtcttagaccataggtgtgcctgcagtcactccaaattgcatgtccctgcagtgtgaggccaacattaagtcttgagatggagcagcgttaattggccattgcttaagagtctcttcattttctcatctcatgggttttaaatattttttaatgttttataggtcctttaggacaccacaccttttcatttattttagtatattttggttaaaaaaattctgtgatgtttaaaattagggaataataaaaaaattccctatgaaacctcacccttagcttgaagaagtaacaagtcatagtgaatctctgtttcctctatatccccaccacccaccaacccccccagatcccatacactatatcattccatctacagatatttcagtatgtgtgtgggggtcctaaagacaaccaggtttcatgagtcactgggaggactcataagagtcagcatttagacacaattacagctgtgagttattatcgtgaaaggatacagaacaaaattatcaaaaggaaaaggcacatggggtgacatccagaggaaaccaggcacaaacatctaagggccctctctaaacacaatacatgcttagtgcccctggcgagttgtatagcatgggcatgggcggactgtcatctaccagagaacctcactagagactcagttcccgtgggttttataggtggctcgtcacactacattctagactttcagaaggaaagcaggtgaccagccaaagccacagggaacaaaatagtttaggcacagaaagccactttgatcagtgatcagtttgaagaaaaatgtccaggaattattatagatagtggtgatggttgcacagctgtgtgaccattctaaaaaacattgaattgcacactgtaaaatagttaaaatgatgacttttgttatgggaattttgtctaagagaaatacatcccagttggcaccatttctataaaaaggaatagtgagagataaagcttataatatggtttcgctgtgtcactacccaaatctcattttgaatggtaattcccacaatttccatgtgttgtggcaggaacctggtgggaggtgactgaattatgggggcggatctttcctgcgttgttctcctgatagcgaatgagtctcatgagatctgatggttttaaaaaggggagtttccttgcaccagttctgttctcttgaccgctgccatatgagacatgccttttaccttccaccaggattgtgaggcctccccagccacgtggaactgtaagtccaataaacctctttcttttgtcaactgcgcagtcttgggtatgtctttatcagcagcctgaaaatggactaatacagtaaattggtaccagtagagtggggcactgctgaaaagatccctgaaaatgtggaaatgactttggaactgggtaacaggcagaggttggaacagtttggagagctcagaagaaggaaaatgtgggaaagtttggaacttcctagagacttgttgaatgttgaatggcttttcccaaaatgctgatagtgctatggacaatgaaatccaggctgaggtggtctcagacagagatgagaaactagttgggaactgcagcaaagatgacttttgttatgttttagcaatgagactggtggcattttgcccctgccctagagatttgtggaactttgaacttgagagagatgatttaggttatctgcttgaagagatttctaagtagcaaggcattcaagaggtgacctgggtgctattaaaggcattcagttttataagggaagcagagcatgaaagtttggacaatttgcagtctgacaacatgatagaaaaaaaaaatcccattttctgaggtgaaattcaagccagctgcagacatttgcataagtaatgaggagtaaaatgttaattcccaagatcctggggaaaaatgtctccaggccatgtcagagtcatcacagcagcccctctcatcacagacctggaagcctaggaggacaaagtggtttggtggactgggcccagggttcatgtgctgtgtgcagcctagggacttggtgccctgtgtcccagtgactccagctgtggctgaaatggcccaagttagagtttgggctgtagcttcagagggtgcaagccccaagtcttggctgcttccacatggtattgagcctgtgggtgcacagaagtcaagaattggggtttgggaacctctgcctagatttcagaagatgtatggaaacacctggatgcccaggcagaagtttgctgcaggggtggggccctcatggagaacctctgctagggcagtgtggaaggaaaatgtggggttggagccccgacacagaatccctactggggcactgcctagcggagctataagaagagggccactgttctccagaccccagaatggtagatcccttgaaagcttgcaccacacatgtttgaaaagctacagacactcaaggccagtccatgaaagcagcctgaagggaggctgtcccctgcagagccacaggagtggagctgcccaaaaccataagaacccacctcttgcatcaacatgaccgaaatgtgagacatggagtcaaaaaagatcattttggagctttaagattttactgccctgctagattttggacttgcatgggtcctgtagccccttggttttggccaatttctcacatttggaatggccgtatttacccaatgcctgtacccccattgtatttaggaagtaactaacttgcttttgattttacacgctaatagacagaagggacttgccttgtctcatatgagacattggactgtggactttggagttaatgctgaaatgagttaagactttgggggactgctgggaaggcatgattggttttgaaatgtgagcacatgagatttgggaggggctaggggtggaatgatatgatttggctctgtccccacccaaatctcatcttgaattgtaattcccacaatccccatgtgtcatgggaggaacttagtgggaggtgatgaattatgggggtgggtctttcctgcgctgttctagtgatagcaaataagtctcatgggatctgagggttttaaaaaggggagtttccctgcaccagctctcttctcttgtctgctgccatgtgagacgtgcctttcaccttctgctgtgactgtgaggcctccccagccacatggaactgtaagtccaataaaccacctactttttaaaattgcccagtctcgagtatgtctttatcagcagtgtgaaaatggactaatacaacttatgagttgaatttggggtgaatttacattatattgaatgtcaggtaaggagactgaactctattttgtagttcgtaggaaggccagcctagggagttttcatggagggaaaagttaatggagactgctctgttgacaggatgtaaatagcagctgggaaggaaaatgacaacatgcaaaagagtcttttaaagactctagtgaaaatgtttcacatgcctgtgactcagttctgatgatggctgtgatgctcatcatcaaaaaacttgaacttgtcttttaaggtctctatctggtcaacagcagaataacggctaccatggacggttctatgtgtggtcctggatttcctaagaattctcctgatccttgcttcctctgtttctgctctagaagggaaaattggagatcagagagttgaagctacaccttgcaatacagtacagcctttatttacactattaaaaccccttggccaaatggacaaagtgacaggcttagccctttgtatgtttgtccttatatttgcttattcaacaagtattcacagagcatcttcacttgccaggccaggtgattcataaggaaacagagcctcaaggtaaaatccaaagagcatgtggtttgaagccaatagacaggtactccagtcccaggttccatgcttactacccaattgattgctgcctctcagccattcctttcttcacctacacgatgtacctgaccaggcttttcttatgtaactactggaggcaaggtgggctctcttgactgaaagcactctgggaacacacaattttggccaccataaatgacattaaagaatacaacttttgctttagaatctgcgattattgtttgactttagctaagtaagcattttgtcaaatctaacagcaaaagcttctcagtaaaggagcatttcaagaaacctgtgaccctcatagccacaacatttaagatcagcatcaaatattttgtgtaaaggttccacagatgtttgattttttggggtaaggaaactgaggcttacagatgtttttgagacttaaagaattgacacgtcagtctctaaatgaaaaactgcgattaaaacccaatgcttctgcatcaggaggactagctaatggttgctgggcttaatatctgggtaatgggttgatctgtgcagcaaatcaccatggcacatgtttacccatgtaacaaagctgcacatcctgcacatgtaccctgaaacttaaaagttgatgaaaaaaaaccaatgttcctgatttatagataagtaataaaaacaacaaagtatccttttagctgaatgatccctgcttgctaacattgatgaatttagaaatgtgtcttcagttgacctctactcactattatttttaattagttttcttaacagccttaatagtgtttagagcattttatgaaacagtgccctctagtggctaaggatacacttttaaattgcaataacaggtgctatttttagctagctggagaattgatggcgaggctggcatttaaagagatgtattatcttgtggcagatgtgtatattgtacatgtgtagcaaataagcatgaagacagttactgtctggcttgttaactaggtgtatgatttcttgatcaccgacctattaaatcacttattaatatataatcttatcgtgagtgtaaatttagctgcctgtcatttataataacattagcgatgtgacgtatgatcatttgagcaagagcactgctttctgccaaagccaagagcctcaataattatttttaaactgtagttaggtatgatttaaaagagatgtgagtacaagaatagataactcaaggatcaacgtatgggacctaatttttatgaaaaattactcctgtctcattcttcttttcttgtccaacagatcattacaacccaaaagctcaataccatattcctcaaaatgcaaattaaatactgcctctcaaaatagcctttcttaactaaaaatatccaagtttatcttttacaaatttaggcagtttttggttaaaaagacaaaacggtaatggaaaatatacagtatcagggtgttttttttttttgctgtggaatgctattaaaattacatgtttttgaaacttgtcgtttgtggttttaaatcctcaatcatgcattacctaatatatgcatatctgggtccatgcagtcaaagttaccatgttgaaagagattttgcagtttaggaaagtaaggatcataaatgtttagtgaattaagctgacaaaaactattccattttgtaattgcagaatcagaactaggagactgtctcttgactacctggaatgtatgatttacacttgtgttctggacagcagcatctggaaagtctaaatactgtagtctcttcagagacttccaactcagattcctgggattccagagctggcaggatcccctgtagtctggcacagacctctcagcccatactaatccttggcttaattttattctgaaagactttttaaaataaactttttatgttttagaatagatttacatatatagcaaagttgcaaaggtagtacagaaagtttccacatgccccaaacccattttcccctattattatcatcttatatattatgcaacgtttgacacaatgaattaatagtattgatataatgcatcactgttagacaaaatttatgcttaattcagattttcttagctttcacctaatgtcccctttatctcccaaggatcccatccgggacaccgcagtgcatctctttcagttcctcttgctgtgacagcttcgcagaagttcctgtttcttgatttgggtgaccttgacaaaagggtacttgaggaacatgggtcacgtcttttatagaatattcttcaattgcatcatttctgttttgttttgtttcattttccctcctaagtagactgggtttatagggctttgggaggaagactacagaagtaaaatgcctttctcatcacatatctaaggaacaggctatcaacatgatttatggccattggtgttgaccttgatcacctggctaaagtcgtacttgtcattttctctactgtaactacatttttttacccctctttctatactgtgctctttggaaggaagtcactatgcatagccctcacttggagtggaaggcaatgctctttcttcttgagagcagggtatctgtagaaattacctggaattcttccatatggaagatttgtctactctcccccatttatttatatttatttatctataaattatgtatttattatttatttattgaatcatttattaatatcagtatagacttagagatacttatttaagactgttggaagtcattgtttaattgccaagatttgaaaaagttgattttgacaatgtttgcaatctcattgcttttctggaagagatttttggagatcttaactctgctatttggatgtagctcctttttttgtaggattttacacacagttttttttttctcagtttttgttgtgttcagaatggcctgaactctgacacagttgatattggatgatattcttatccctttcaatgctctcaagaattttcagtaaagattttttaagtttcacaattttttgtgctaccaggagaaatgtgtctttagagggtgactattgaatatatagaaacccacattcctgagatttttttgtgtttaatggtatatttcataataatacaactatcttaaaaagaatcacattggcatatttactctgcattattcaaatggctaatgctttgagaaggaacatcctctttataataaaatgagtgctgtcttgtttggcttatttagtatcaaattaatgtgatactcagtgtttcattaagttcctccaaataaccaattttaaagcaacttcttcattctttcatggatataatgctaaaggcgtaaaaagatgatgacccatattatctgaaagagaaaaacatgatttctcctttctctcttaaaattaagatctatatttatgatagcaaaagtcaggtgcttctctccccaccttttagaagctgcttagtgtgatcaggggataactacagagaagcgctatcaaacatttctttctgcactttcagttaggaggatgatgaatgcatacatacacattttccctttctagtagcaatagattaacactgttgggaataattcccctagaaagttttccgagagcctggaaatttcacatcatacttttctagccctgggtcactgtgagtttgccaaagcctccagcagatagataaattggtttccaagtgaacaaagtatattagtcaatctcctgaggcattttttctttgatggccattgagtgtgttaagcagcaactgtatgcccttcataataaaaagcactttaagttgagtgatggaaggctcttgatacttgtggaatgacagagaagttttgaagaaatgaacattagtgcaagtagacaatatttagaaagcataatcaaataaagagttttaagaaaccataatttttttttttactttaagttctgggataaatgtgcagaatgtgcatgtttgttacataggtttacatgtgccatagtggtttgctgcacccatcaacccgtcatctatgttttaagccctgcatgcattaggcatttgtcctaatgctctccctccccttgctccccgccctgatatgccccagtaagaaaccataataagttttaagtcaaagtgagatggaaaatacagagaagggttagtctttgaagactttggagaggtgatttgaaaatcagatgttaaaggaatgcatgggcataaattagcaggacattccaaaccagggctttgatgtgaacataagtcagttatgtgaggaagcagcaggcaagagcaggactggagagggtttgatgtcatctcaccaatcatccacccaataaagaaatctctcagcaacccctggcctgtggtcagccaatctgtgtctgaatgtatcgatcaagtaataatagttcagtgctcttagtgaggaagccagtgatgattgttacatggctctataatattaagataaaatttgtccccagaatgttctatgcttgggttcaattattccttttggagcaactcagaatcaatctaatattttggggaagtgacagtttttcagatcttggaggaagaacttattattaatctctctcccccattcaacttaattgaaagagtctccgattagaaatttgagaaaagatgttctagccccaactctgctatgtattatttgctttgtaagcaaagaacagttaaactgtctcaactatatatagcgtctatttccctctgttccttccctatccagggcttggctctatgaaaagcaactcgaactcttgccttccagcttgggatactgctccaagatagcccccctttagtgaactcctgtctcctatgcagttccatcttgttatcttatacctggattctccatctctgcccagacactacactaatttggatagttttatttctttctcacgttgcaattaatgaggatgagcctggaggtgggggttcctccatggagtccttcagggactggggttccctccagctggtgactgtggtatctataagggctcaaattcctccatcggatactctgtatcttgatggcagactcaagaagagaatggtgaggctgtcacaggaagttttcaggggctgggcatgaaagaggtatgcatctcttctgcatatatttcccattaattcacagtcagtcacttgaccccatctaactgccagagagcaggggaaatgtagcctagttgagtgcctaggaggaaaaagaccaaatgtagaaccagtgcatgtcacttctgcctccacttgtgctagaattcaggcacacagtccccaactaacctcagaggaatttggaaaatgtagtctggttgaaggctaagaaagaaaaggcactaattagactttccaagcttatcagctttagagaagagaaaatagcatagattttctatgttatggagtaaagttgtataatataataatgcatgtgaaaatgcttataatctggtaatgtggcataaaaatgaatgttaatatctttttttacaaataattctggacaattagacagccatgtgcaaaataatgaagttggacccttacctcacaccatagataaaaattaactcaaaatggatcaaaaacctaaatgtaagagctaaaactaaataatttttaggagaaaacagagggataaagctttataactttggatttggcaagattcttagatatagtacaaaaagcaaaaacaacaaaagaaaaaatagataaactgaagtttatcaaaattaaaagcttttgtgtttcaaaggataccatgaagaaagggaaaaggcaatctatcaagtgggagaaaatatttacaaataatttacctgttgaggaacttatatccagactatataagaatgcttaaacccaataataaaaagacaattattccaatttaaaaatgggcacaaaatctgaggagacatatctccaagaaagatttacaaatagcaatatgtacatgaaaagatatttgacgtcatcgttcagcaggaaaatgcaaatcaaaagcacaatgagacactactcccctcttcctagaatggctacagtaaaaagtcagataacaagtgttggtgagaatttggaaaaaacagaaccttcacgtcctgctggtggtaatggaaaatggtgtaaccactttggaaaatagctgggcattttcccagacaaataaacatagagttatcctttgacccaacaatttcattcccagctatatacccaagaaaaatgaaaacatataaccatatacaactaattacactaatgtttgtaataatattcataatagccaaaaagtgcaaacaacccaaatgtacatttgtgtaatggaacattatttggccataaaaagcaataaaatactgattcctgctacatgctacgtactgattaagtttgaaaactgtaagacagtcacaaatgactacaatatacatgattccttttatatgaactattcagagcagagaactctatacagacagaaaatgggatagtggttgcttagaatgggggtgaggggcatgggggcaaagaaagtgatagatcaaagttaagggattcctttttgagattctgagaatattctaaaattaattatgatggtgggtgcacatgtctgtgaatacgttaaagaccattaaattgtgcactttaaattgatgaattgtatggtgcgaattctatctcaatgaagctgttaaaaatgaaaggtaatatatgcattattgttaataagatactggcctacccagatgaaagactgtgcaacactcatggcaggtccttagaaaccaagttctgaccactcaaccatgagaaatactaatgaggaagaaatagaacaagcatctccagcaaccagtgtactagtctggacagctttctgatgatcttgactttaagaaaaatgtatatacaaatggagctaacctcagaacttaaaaatcatgccaagatgaccaagatccaagatgatgtaaagcttgtaagaagtgtaaagggaccaggcacggtggctcatgcctgtaatcccagcaccttgggaggctgaggcaggtggatcatgaggtcaggagttcaagaccagcctggccaacatagtgaaaccccatctctattaaaaatacaaaaaattagccgggtgtgatagcaggtgcctgtaatcccagcgacttgggaggatgaagcaggagaatcgcttgaacctgggaggtggaggttacaatgagctgagatcacgccattgcactccagcccaggtgacagcccaggtgtctcaaaaaaaaaaaaaatagtgtaaagggcattgaacagaactgccaggtaatattggagcaagtaagagggtaaggaggttgaacaactctgaatacactaaaaaccactaaattatatacctaactgggtgaatttatttgtatgtgaattatatcttgataaagcatgtgcttgctcttgctctcactctcgtgctctctctctctctctctatgactctcttacacatacacacacacatgcacacacacacacacacacacacacacacacacacagagagagagagagcaaggaaaagatagaccctggcgtggaggaggtatgcaggataaccatgcagtaaatattcttgcatgttctccagtaaggaatgtatttttcaaaattgaaaaggaaaattcgatatcactttcttaggaagggagggaagattgttcaggaaatagtgagaacaccgagctgctcagggagattcacctcaatctaaagtaaatttgagatgggataacataaaaataactaggtttaaggtactaggacaaaacatctagcatgcattatctcttttaattgctcagtaacccagtgaagtaggtaatatcattatcacccattcagagaggttaagtaacttattcttagtcatgcctgtagacaggatgaacaccagtttgaaaaaccctctctctggctctgggggcaaggtgaaagcccacgccatgtgtttgagaattcagcgcaggtaaagaaatgtttttttgcattggtgatattttatttagtagtaacactttattcctaaggcgtactagttgacttgtcaatgaaattacagaaccattgtaaataatctgtagaaatttgcaagcaaatgagaaagcagctgaaagactgggaaaaagagatgattgttttagttgtcaaaaaaggtaaatctataggactagttcataactggcaaaattctagagccatttaataaatacaagtatgtcctgtaaagcggtttgcatcctggtaacacctaattgtaagccatacaaatactccattttcctaacttatttctagagaatcaattatgatcttaccatagtgttatcttaacagcttttatactttcaaatgaaatggatttattcaaacattagttggtgatatactttttatcatgctgtaaatgatcctaatagaatttgttaaaacatttaagttacgagtgaagcacagttttctagatgtgtgctggactaacatttgccataaactatcacataatcagttccttgattctttatggacctgaagcctacttacataaaattggtctagtaactaatgataaagattaaataaaagtcattgaggtcattgacagaaggctatgttttcctctaaaatcatggcactcaattcataaacattattcatttttcttctaacttgtatatacttttagatgtaattgtgtttcaattttgattgcccagctaatcggaaaagctttaaacctcttaaacagtttctttataaaagcataatgacgtatataatggctttcagataatcctgtcacagaaatgattatttttctctattcctggtgaaccaaagtgcccccatgtgcttctacgtgtaatgttatataaagcactttgaagcacgctgtattatttttcatgacagtatcattgataattctaatggtaatttttccttcacacttggtagcttccaggcataatgacacatcactaaagctttgactgttaaagccctttgctcatgggtgaagaaaagagaatggcaagttaaaaataatgacttaatcctcatttacattgcaatgagttattctcatttgtggaagagggatgtcttcgatggggaggataatgaaggcgatgagaactatcagaccttttgtgcccgatcaataggtcccataaataaaatctcaaatcacacactacaaagtggaaatcatgtgtaatgggaagggagtgaaatcatcatcttagggatggcaagttcttactgagaaggatgacttcatgctggacctcttgtggtttccagagctgtagatgaataaattttcatcccttgattgataataaattttttgaggacaaaaatagttctagattgagaattcagtcattagactagactcaaggggacatactctagggacaactgtgggagaccatagactagacgatggctttcttacctgcaggaacaggaaaaaccatcttcaattttgtggtctgggagggactgtgcctaagcaatgagaataaaaatacaatctattctattgaaaaggtctttagagcatccttccagtaatctaaaagtgtgacaccccaaatacactagttctttcattattttcttcttccttctctttatcctgaagcccttaagtctactcaattatagaatttcttcataaatgacttatagggccatttttgctgggaatggaatgattttccatatcttctattccatcctacctaattttagtcaacctgaaaccactgctttttgtgaataacgaatgtccaacagaactcccaccaacctcacagtcccagacatctgcattactgtgggtagtcactcaaatgtagctagaggaggctttaccagaaaagctaattgccccaaactttcctcttggaattagagttgagtttttgttggtttgttttttaatgtgcccaattaatcttttattggtgtgggacaaatgttgagactaacaagaagattttggataagtggataacaatctcgcaccctacatccctccttcatgggggaatgtaagtgtggattgacccaaagcaggaactctaggggtgaagcaaggactcagctctgccttttcatcagctctgatcatccattagagatgtccaccctgggaaacatgggaaaattttcacaccacccaaagccctgcactgattccaccacaagctcccagtggggtctgggccttgtatgtcaacacagcaagatagctttgtatgaggacagtttccttcccaccagacgttagagtcatcctaggaacaactgtccaaccctgggcacgtgccacccagcagcacttctgaatatgccactgaggggagagatgaaataaacacctactcaaacccatacatctttcttaaattagccacaactaatttctttcatgctgatttttatttctaaagctgtgatttccaaagccataaactttgggtctgaatgaaattaagaagggttagagggctgggcacggtggcttatgcctgtaatcctatcactttgggaggccgaggtagtggattacctgaggtcaggagttcaaggccagcctgatcaacatggtgaaaccctgtctctactaaaattccaaaacaattaggcaggcatggtggtgggtacctgtaatcctagctgcttgggaggctgaggcaggaaaatcccttgaacccgggaggcagaggttgtggtgagccaagatagcaccactgcactccagtctggccaacagagcaagactccctctcaaaaagaaaaaaataaatgggttagaaatacagctagacgctaattcagaccctctccttctcatactttccatcaaacccatttttctttctcaggaattcttttttttcaattgctgttaaatatataatataaaatccaccattttaaccatgtaaaagtatatactttagtggtacattcacatcgctatgcacccatctcctccatccatctccagatccttcctactttccaaactgaaactctgtccctattaaaactaactccccattcccccagcccctgcacccaccattctacttcctgtctctgtgaatttgactaccctggggacctcatgtcagtggaatcacgcagtatttgtccttttgtgactggcttatttcacttatcataatgtcttacgggttcatccatgttgtagcctgtgacagaacttccttctcttttaaagctggatgatattccattatatagacagacaacattttgtttacccatttatctgtcaatagaatcttggatggcgcctactttttggccattgtaaatgatgctgctatgcacatgagtgtacaaatatctgttcgagtctctgttttcacttcttttaagtctatgcctagcagtggaattgctggatcaagtggtaattctatgtttaatcttgaggaactgtcataacatttataagaagctcttaatatttccagaaaccatcccaaatagtggatgagccaagaagacaaagtcatttcaatgccattttgacactcaagaaattaggccttaaaatgcttaatgtacaaaagaacaagcaatatacacttgtctctcttcaatggaaatagagttatttctgtgtgagagtctgttactacattctgtggaagtggctggagagtttacctggcttacaaagtctgttttgaatggcctgtcataaaatttgcatttggggactctggcgtggcacttcaaaaggtcagccaccattctctggaataccatgtgattggagaagcagattgtttccttcctcatggaataattgtcctgtcctccctggtgtgctttctacaacaatcagggtccaccgtgcatgagaggccagaggacctagttctgggccatggactagattcctgacattgggcatttactgtttctgagttccttcctaccttccttccttccttccttcctacttttttcccttccccttccttcctgtctcccaggctggagtgcagtggtgcgctctcggctcactgcaacctctgtctcctgggttcaagcacttctcctccctcagcctcctgagtagctgggactacaggcacgtgctaccatgcttggctaattttttgtgtttttggtaaagacagggtgtttcaccgtgttagccaggatggtctcgaaatcctgacctgatccgccctcgtcggcctcccaaagtgctgggattacagacgtgagctattgcgcctggcctgtttctttatgagtaaaatgaataagcttgcatgtgaagacaaccccaagtctcttccagctctaagttcccacagtgcacggaggcccagatgatcactgcaggaataggaaaaaccatcatcaattttgttgtgtgggagtgtctgtgcctaaacagtgagaacgaaaatacaatctattcattgaaaaggtcttcagagctcagtaaattttgccaaattcgatccatggtatacattacacctactaccttttctgatttcttttctctctttttcctacaaataatcactcttcctcaggtctggggatagtccagtgaacttgacagagtcttcaaggtctttcctggggccagactcttgcggcaccagctctgtttaatgtaacttcacaaaactgctccatagcctgacttcctggaagggtgttttcctgctttcccagatgaccagaaggacttcctcaatacctactccgaactctgctttttttttttttggtccagacagaaacataaaaagagaggtgcagcattccaagatgcagggagcgcaaaggactgggaatgtcaggagaccatgcttagccacgcaggaaggcgctgaggaaccgtgctactgaaaggagaatgagagctgagccccaggggaggcatctgcagtctcccaggagaaatttctcacatgcactgactcaagaaaatgtgacgtataatcatgaaagacatatattatacacaccatggctgattcctacgaaagaggaaaacaaccaggcaaatctatctgggaagcacaattataatatttattcacttgagtaggactctatcctctgatttaacacatggagtgaggacataagactcaggactgggatgagaaatgtaaggtgcatgaatttcaaaaataataaaatgaaaatatttatttgcttatggttcaattacgtggaatagaagcataagcagaaatcaaatggtcaaacttacaaaatctgctcttctttctgaacagtgatcaatggcctcactgaaaggactcagggcttggatgtctctgtggggtagtttattctagcacttgtgtgtgttttgccttggcaacacggaccaaggcaccagaatagcacacagcagctgaatgccatctcgaattttctgatttcactcccaggcttccagtcttttctgttatctttttttattttgaaatcctcattatgtgtttgctatatgaaagcacaccaaaatgtagcatgacacagtccctcccatgaaagcagaatgacacatggggaaggaaaaacatgatccaagggctgggagatggtgaagaaagtgctgagtgtggaccaaggtcatcacttgcctctgtagctcccctggcaggactggacatgtaggaggcacccccacagtcagtatttatttggtgttctaggttggaataatagtgtgattccattcaagggaaaggaacaaaatcagatcccagttgtaacactcattgcagcattttccttgagtctggggcaggtgtgtccagcgattctgcttggagaaggagaagatcctacagatgagcttctccacagggtgagagttgagcacccagcacggtgtctgcacagaggatgacaaaaatcttgaatgaatgaatggagttgaataagcaaacctaggacagggtgtggaaggtgaactcatggttcataaagtcagatactttggcattagtgaggtaggcctgtgtatgtgagtattcacacgcagttgtttctgtacttgtatgagagttactaatgttgatctagttgacattgtttagttcctagcataaataaagtatcatgacattgtttaagggaagaaaatttactttgtaattctgtggtgttgaaagtagggaaagaaatatgttgccttttaaatacacagcagcgctctcatggagatcacatggaaatgacagcggtgttgtgtccggaaagcaaaagcaaaacaaaaacgagaaaaaatgaaaccaacagaacttgggcacttaagaaatccatttcctaatggagtaaacagatatcgcactgcaagttacaattttcaacatcgtttaccctacacctccaccattcggagaggcagctctaataaatgagatgcagtgatgacctttaccggctccaccgatagctataaattgagctgaacattcccatcagctaacaggacagaactcattactgactgaagattgctacgatgcctttgactgagatgtgtaccattaaaatgaatgctccttcactcgtaaaaacaatgtcttgtaccgcagaagacctgatatgccattcattgatttttgtggatgactacaagaacaacccgtaaagattagctgagtcttactgtgtgttagttaaattatgattcagatcaatttgttcttttttgagagagttgattttttgtttcttaaattagaacctttgtcgatggcatgcatggaatataattgtcagatttacagtcctgatgattcaagcttagataaacacttgttccaaatacattaaagtaaaacttatatccattaaactaagtcaggattttgaatttttaaagctttgggtacatagaaaaaatttggttttgccgatttttttggcaaaatgactctgactttgagaacaaaccagtgtccatgcccaggtgacagcacttgccctgctgtgattattaaagcagccccttgcactgccaagtgtcctagtccagatgatgaattgcacagtcttattggaagtatgtgaaatgggaggactgtagccatacttgatctctaggatacacttttatcaggccctacaggtaaagtattcccataggccttgtggattttcacaggaaggcctaagttactcagatgtctgggagttgtccctggttggtttctgctaataacattagtagtcctgacgcttcatacttagcaggacctaataggtgaacccagatatggttctaatgtcatttaagttattaattgacattattaatatccccattttttttcagatgggagtatcaaggcacagaaaagccatataacctgtctgaggttccacagttaatagctagtaagcatgggaatttcctaggactccaggttagggaactacatcagacacgggttctcatttcaccaggaaacaaatgcgaggacattcttacttccacttactacaatatattaatgactagtgtgtgatgatacctccacccactcggagcttagagtgataacccggttatcctgcagctttcagatgatgggttctacctctctaattgactagactttctctaataatactggcaaagtctttatgggtcaaagtcagaagggaaagagtctctagtcagagccagagtcataagacacagtgaatgtatactaatgatgccacttggtaaacttccagcatgttatgctggaggaggctgggaggcagtctgtccctctgtccctctgtccttggtggcacagacagccccctggagccagccaaattcagactcacattctgcctaaggcagagggacacaggcagacacacgctaccaggagacgtctgcctttgacatcccacgtttgtgacacatgccagatcttctcagaaagaaacagtgcaccacagccactgtgccatcaggcactttgacactcacagacataaatgggcaagtcggaaggagtagatgattccctctaagaggacctgcctacttttcctgggagagtgaagaaacctctaatcattggtttctctgtttttccaacccaatgagtagacagaattgttccatgtaatgatttttcttctctctgtataagacactggccttcctgctgtttgcattttggattattttgtttgcttttaagtcagaaggacaagagttgtgtatagacaagctttatcatagattctacctaaaattcttctggaatatgattcagttttttcctttgtaaataaaatcataggtgaatgtgtggtcaaaaggtgtagttggttttcccctttcagagatctgagtgccgctgggggaggtggcatctcatatttataaaacatgttatttattttcttactttcaaaatgctaaacatagctgatctcaattaatcagcacagtaaccctttcagaaaaataaggtattctattactgaaaatgaaagactgcaaggtaaagtaactgctctcaaaaaacgctgcaatgggattagaaccaaattctcctgattccaaagccagaagttacagtcagagtatgattgtatttctttattaagattaaagtcagctctcagcagcagaaagattaaaataatactagtttaagaaagatggaaatttacttgtctctcaaatttatttattttccacatataagtccagaggtggaatctacactgtattttgcttttatcttccattttcatcttttgcttttatcttccaagatcacctaaaggaacaaaatggctgctctagctccagccatcataaaagccttcctgctagcagatatgaaagaggagaggggactatcatgctctatccctttcaggactctgctttagaggttgcactgcatacttctggcatagccagtctgtggcaaagcctaaaatagaggccaaatttccagatttttggaccaagctctttccaacaatctgtcccttacgcctggagctttttgtcaccgttgtgttgatgtaatctttggtcaagtttctgtctctcagcctatccattagtctttgctagtaggaggtgatttttctcagggatgcatagataaggtaaggtggaggcttggctccattggaaatgctgaaatgaatttactgcaaaactagtgttttctatgggagtgggatggggcaggaaaatctattgcatctccaccagccagaattcacttgcgtctagtaagacctcctcacatttccatcagtgtctacaacttacagagtcacaaaaagctcggagacaataggaacagacatcaaaattatcagtaacgcaaaatataagtgcccatataatgcctaatataagtagcatgtaccggacaatgcctcgtattctactgaagaaatagccagtgatcttctggcggcccatttcaaagtcttaaatttttttgacaccttcagtaatacttgttattgatttgctctaagtgaggttttttaaataatagaatcatcataatccctttagagatccttcaaaaaatcttagatttatataacagctaatcataagaatccttaacaatgtgtatatgcgaagtccttttgttcgttatcaggaaagggcttggctgataacacatttctgaggatattcattcctggataaatttttaaggatttttattctttgctgatctttatttcaccttcacccctctcaacatttgaaagcctacttaactctatattttcttttatgttaggttcaagtgaaaaaataatttgcaaaaacaaatcctaattctacaaataaattgtttttttttttttccttaaccatgtagcaggtggttgacaatattaaatacagaaagagggccttcgttgtttcagtggggtttcagtgtatcaagctgtttaaaagtctaaacaggactctgttaaggcacataaaaattgaatagaaaataatggaaatgtaaaagattttaaaagctatttgggcaatgcattaatcaaaggcaaattgggcagtctcagatcttatgattaaaaattaagtgaaattgaaagccactaaagtcatctttgaaatgtagctacttcccaaataatttccaagctgtgattatttttttgaaagtacgaaagtacttatcaatgtcattactgacgttgtaaaaatagatattgtggtatcattttaccgtagtttgaagtccacagaatgtaataaccctcctctcagtctatccacacacgcttacccatttcagccccagacaattctccacctttgtttccaaggtttagggtttctaaagcaaatgcctcctaataacctcagacttacaaaatacagtacctggttgcattcttgaaagggggaagaaaaatattacgtggtctttctaactcttttttttttctttgagacggagtcttgctctgtcccgcaggctggagtgcagtggcgcgatctcggctactgcaagctccacctcccgggttcacgccactctcctgtttcagcttcccgggtagctgggactacaggcacctgccaccacgcccggctaatttttgttgttgttgttgtatgtttagtagagacggggtttcaccgcgttagccaggatgatctcaatctcctgatctcatgatccgcccgcctgggcctcccaaaatgctaggattacaagcgtgagccaccacgcctggcctcattcttattctcaagatcctgcaggaaaatcaggtgtagtgaacctcccagtcaggttatcccgccacgtatgttaaagttgccagcgtaagttggaatcaagaggcctgcgtgaggcccttgagccagagggagctcattaaccagccagcaattctaatgttcacatctcacttagggtcttggagaagctgggaaatctccaggtctcgggagcacgtctcacaaatgtcaaggctgtaccaccttggttaagcgcttactggcagggccgctgaatgctgtttgtatttagaatggaaagaaatattactagaaaacttgctcttttgaaagaaacctttgtacctctttggagcccacattgccttcctctgacaatttttgtgaggtaaaccagaaagcagaaaacccagacacgagaaaaaaaaattggaactctgtctcctccctccaggcctaatcctacgtactaaactgcagccccgctgtagagcttcccagcgtctgctcaggagccccctgaactgtcttcacctgtacaattagtgggtgttatgggaacgtgcacctctggcttcccaccttcggtatctcccacttcctgtacttgttttacctaaacacgagaatagttgctcacagtttagtctttctcaattctaccctcacccaacgttcccccaaaacccacctctggggcggggatcgccttcctgatcatccagggagaagcatctaggctgttttgagtcactgctcctcactgaccgagtcattcccaagtggtgcctgcactgtggacaagagctccaaccctattgtacgtttctagaaatcagggattatgtggtcttattttctgctccattttttatgaaatattttaaatattttcttgaaagggggaaggaagacattactgtggtctttctaactcgttcttttcttttttttgagacggagtcttaccctatactgtactctacagaaaagtagaaaacatatttcagtgaacacctatattaccagtacaaatgccaattaatttcaatgccttggccatttttgtgtcctccatcagttctttttttgctgaaaatatgtaaacataaattatactctcattttctttcatccctgaatactaaaacatgcatctccaaagtgtatcttcccatacatccacaggaacatcattgtatctgacaaaaacgaccataatccccaaatatcattacattcccaggccatattcaaattcccttattcagtctcaaaatattttctgtagcttttgttttctttaagcctggatcaaattaaaaatcataattgtacttgattatgtcttttacatttctcttaatggtagaatggctcctcttttttctgtgatatatgctatttcacaatacacctggattaggccagttgtattgtaggccctcctgcattccgcacttgactgattgctttcttgtgaggtggtttcacaggtttatctataatgtctacttgtcccatgattggtgattcgaaggggagattaatgggcaaaagaggtgaccaccaaatttctctattataaacatgtttttcccattgagaatggcgtattttctgtgggataatatcccattaacttttctccaaatgaggttagcatccatcattgatccttacctgcaccaagttttacgacaggggctacaaagcggtgatgttctgaattaatcacctcttctacacttacgagttgacagtcttctgaaaggtggaactctccttcataaacaggctatttggtgtacctgaagtaccaacaaagcaggcagctgaatccttgtctgtttttaattattagttttcagattaagaagttgatatcatagttatgttcagctatggaaaataaatagttttgttttctttaatgttttgtgagtatcactattgacttgtgctttctaaaatgtattcactgtgtcttcatcaccgatagcattattcttttggtgtttggattgtcctaactttgaccatggagagcccctccagagggttattctgtccttgtgtcagttatctaatgccacagagtgctgtgtaataaacaactaacaaccttccagaacacatagaataagtcatttttcacaaacctggctgttggcaggtggtggttagggaactccacgtatctcatggctgatgtgctcacatggccagacacccagctggatgttggctgatctggagtggcctcttcttggatgactggagcaactcggtttgttcttcatgcctttgatccttctcctgggccaggacactagaccaggcatgtttgtctcatggcaatagcagaacccaagagaaagcaagtccactgtgtaagagctttttaagcaccagcccgcttctacttactgatattccattgcccaattctagtcctgtgtctgagcctagagtcatgagaaaaggcccggaaaaattagatggaaaagggtggggtgaagaattggagccatttacaatctaccatggtcttattgatgtgtccttatcagtcacttgtctcccccactggtctttgctttctggccagtaagatattttagatttataatatactttgtgtgcctcagacctggaaacatccattttttcaaggatccctggctcattttggggagaatggtactcagagacaaaaatctgggtgtctaggataatcatgcttctagcccgttttcatggacaaaactagcaagtgtgtagttttgaacaataaagaaacattggttcctattgatatttctgatgcaaattcaacatcacagagttttaaattttaactgaatttccttttgtttgttaaagacagggtctcactctgttacccaagctggagtgcggtggcacaatcatagctcattgcagcctcaaactcctgagctcaagaaatccttccacttcagcctcttgagtatctgggactacaggcaaataccaccatacccagctaacttttaaattattttttttgaagagacggagtctggctatgttgcccatctaatttttcaggctctcaaactcctgggctcaagctattctcctaccttggcctcccaaagtgctgggatgataggcatgaaccactgcacctggtctgaatgtccatgattaaaaatgtgggtctcttttctcttgtacagaaaatcttagctcctaataacattaacggaattgtttattttcttggaatgatgtctgagagcacaatgctgtgattaacacggaatgctaccacagctaatatgcagtaactgtcatatgattatcagtttcattaaagtcagagaacgtggctaacacatggtccataccaaatatctagcagagcatcccgtacattgtaaatattttttaatgcataaaatgtctattggttttgttgttttgttgtgtttttttttttgagttttgcttcttgtacctatcatttctctttttggaaacacctaccttttctaagcatattctcatgcaaatgagttactgatctactttaagcagaatgcacataatttcttttacatttcctcaccgtctctatgtgtagtatttccttgatatgctaaagggctgtgtgcagttctcataatcccaaagaaaaggatgtagttatcatgttgcgtactttttaaaaatatcatgagttttaacaaaacctaaaaaccagaagaggctttggcatttccatggcattcaaactcctactttttaatccattgattctgatgacgattactgaggctcctgctacaatataagcctgcattcttttttaaggtcttgtgacatttgggttatgctggaatttgtttttaactatttaaagatttcctattttgtcccacagtggttgtcttctttatctttaagataatatctttaacactgaagacattattggcaagaggaaggtctggaggtctgctcaccacctttggtgttctcttccatagccatggcctgagaagggtgatttttccaggtgaaagataggctgtggtgtaaactaagacattccaaatgaaacataatcacttaatataacctcgtagatagtgctgtccaaaagaactttctacagtattggaaatattctatacccacagcatccaacacagtacccaccagctatatgtggttactgagaacttgaaatgtgtctagtataaatgaggagctaaatttttaatgttatttaattttaattaattttaatattaatggaaacatgtggctagaggctacatattagcagtacagttctagattataaatatggtccaactaaaatatttgcatttgactcatgtttcctgaaagaaactggcagtaggaattaatgtcagctttctaatcatttttgattcttcttataacttgccatacacaccttattgcttaagagccaaaggaaaaatcactcttcatgagaggcagtgtatctacatctggactgaagaccttcatttggctgctgtgagttcataggctcccagctcctgactttgcagcgaaaaatttcagaattggagcttgtggcccagtgattattggagaaacatggtgaaaacacaatcactaatagcctgcaactgaaatatcagattaattctataaacacaaattactgcagaagcccaaaagggatgaaatgaaagacaggtgcaacagacctttatttacgttatagctgcatgatgtttttaaaacttcttgaactgtaaatgttaatagaaaatgttaaagtagaaagaatagtaaataaacctccaaatctgtttgttttttaagtatcattttaagttcaagaacttatgcatagtcgatgagcttcaatcttttgcagttattagttttatcaatgctccaattgttttattcttggccagtgggagcctctccaagatggcttctgagtcattttgacatggtcctaataaactttgacctttgggctcagatattgcctatcacagacatggaattagccatttacagagagaatctgggtttcatttagtgggaaatggtatttctagactgcagtgtggatactggagattacagattaatattttatgaccataatattgatgttgactgtcttaagatatgtgtatgttgtatgctatttgttatcagaacatacataaatacaagtaaattatagatagaaataaaataaataatagaacactgtttctattgctagttatttaaaactaaaagaagatgataggagaaaaattaaatttactacattcattgtgtatactctttgtttcagaaattaaaatctattactatgtagggattctttgtgatatttatacaatcagggattaatgtactcttcaaaaccaaacagcatatataaattacacttagtaatgagatttgttagctcaattgttaatgaatctacagtaccataagatgccataacattatttaaatttttaacatacgcatggtcttcaaaagcctttttaaaaatgcattattgtcaagcaaaagtaaacaacatataaaatcagctgatctatgatactatgagtaaataactggcattttatctaattgttgagagagttagaaaaaataatttgttattgttatatcagtttgaaaaaaaaaacaaaaaaggaatcatcttcctagtcctagctaccaatgcaatttttttccatttctgtaatattttcagcttgaagaatcgcataggtacacaggaaaatgagatgagtggcatattttaaatgcaaagcactagatatattgcacatgaaaagtaactagcaattggtggtgctgtaagctttccttttggaaattttctcctaggaatctgacattgtatgtttcttagaactcccattgagcatggcttttcaactttatctccctatccatatagcgttaaaatgcactctacactcccctatgtaacatcttattgctttgcaattataaggataaaataacgataattgaatctcataaagaggcacaaaaggtataatttgacaaaaaagaaacaccatgcctacgcctccgtccttactccacctctgtcatggcctcctcattctagagcagttactcttacactagtggttctcgtcattgttttgtatgtaaggtggatatttggtgacttagacttatgatagtattaattggctcaattcctcatacatatatttttcatctaactttgtaccagtcattatgctaggtattagagatagaaaatcaggaagctgtggcctcttctctggcgaatcatgtactctagtgcagaagacagagagttattacaaacaaataactctatcatgctgtgatgaatataaaataggatgaatgaagtatggactgaaagcagagagagattaattctgcctggaaaaggcatgaaaactgtacaagggagttggcctttatgcagatcccaggaagatcttacccggccatagtgggagaaggacattacaggtgcagggagcagtgtgagggagtgcagaggattgggagacatggtggtgctccagatgctttgttggggtgataggcattcaaatgggaagaggggccaaggccagaatcggaaggaccttaaatgtcaggctaagaaacttgactaaaatagtttctgccaaagggataaaaaggagttttaaaagagagatatggctttgtctgcatagagaatggaaataaggagagcgacccattaggaggctgctggagtagtctatggtgaaggtgatgacaatcagaaccaaggcagaaacattggaaatgaagaagacaggtgatttgagaaggcttcaagaggaagaatgggcaagtcaggaaataatccagagaggggatccccagtcactgccttcccacattgctgaatgacctgtgaatcatatctgtggcagggaatcaaggcaggtcagctaaagagcttaaacatcttcactaacaacactaacaacaaagctgctacccaagaaacaaacttggctgtgtaagcctagcaaagaaaattgcctgctagaacaaaggaaatcacatttatcgggagataatatcaaaacccagaatgtccagaaattaatatccataatgtctaggatataatccaaaattacttaagatacaaataaccaggaaagtggaacacatgctcaaaataaaagaaagctaatcatttgacctggaaatggaacagatttctggaactgacaaagattttttgaaagctattataactatcctcaacgaattaacataagcctgttttgcaatgaatgaaaatctcagcagagaaatagaaaatctcagcagaaaacataaaggaaccaaatggggacttataaatagaacaataaaaattctgaaattaaaaaattcactggatagacttgataatttaattaccatgacttaggaaagattaaatgatagatcaatatccaaggtgaggctgggagtggtggttcatgcctataatcccagcactttgggaggccaaggcaggtggatcacttgagatcaggagtttgagaccagcctggccaacatagtgaaaccctgtctctactacaaatatgaaaattagctgggcgtggtggcacatatctgtggtcccagctacatgggaggctaaggcaggagaatcgcttggacctgggaggcagaggctgcagtgagcagaaatcacaccactgcactcagccagggtgtcagagtgagactctgtctcaaaagaaaaaaaaaaagaaaaagaaaaaaaagaaggaaattattcaaaatgaacagggagaaaatttgtttttagtgcgtcagaggcctgtgaagagatatccatctgcccaatttatgtgtaattaaaattctaggagagaaaatggataaagaagtagaaaaacaatttgtcaaattaacagctaaaaatgtgatgaaagacataccttggcaaatacaagatgctcagtgaacatcaaacaaaataaacacaaaacagctcaatctaaagcacatcacatcattagaggaatgcaaatcaaaaccataatgagacaccatctcatgccagttatcccagaacttgaaaaaaaaagtcaagaaacaacagatgttggcaaggttgcagagaaaatgtagcacttttacaccttggtgggaatgtaaattagttcaaccattatggaagacagtgtggcgattcctcaagatctagaagcagaaataccatttaaccttgcagtccaattactgggtatacacatgaaggaatataaatatttctagtataaagatatgtacacatgtatgttcactgcagcactgttcgcaatagcaaagacatggaatcaaccctaatgtccatcaatgatagactggatcaagaaaatatggtacatatacactatggaatactatactatgcagccacaaaaaggaacaagatcatgttttcttcagggacatggatggagctgaaagccattatcctcagcaaactaacacaggaacagaaaaccaaacaccgcatgttctcacttataagtgggaagtgaacagtgagaacatatggacacattgcagggaacaacacacactggggcctattgaggggaggcgttgggggagggagaacatcaggaagaatagctaatggatgctgggctttatacctagatgatgggtcgatctctgcagcaaaccacctttatacctaggtgataggttgatctgtgcagcaaaccagatttacctatgtaacaaacctgcacatcctgcacatgtaccccagaatttaaaataaaagttgaaggaaaaaagagaccaaaagaataaaagcacataacagtcagcttcaaaagccaaaggcagcacgtaaatcttaaaggcaccaaaagaaaaataatacgctctgggaaataattcaattaatggttgacttctcattaaaaaccatggtgaccagaagagagtggaacagagtttcaaaatgctgaaaggcaaaaaacaaaacaaaaaaccctataaactggaaatctatattcacagaaaatattcttcaagaataaaggttaaatgacattttcagataaaacaaatataaaataatgtgttttgccagcagacccatacaaaaagaaatcctaagggaatttcatcacggaagaaaatgatatacaatggaaactcaaatcttgataaagaataaaacacatcagaaatggccaattgtggataaatgcaaaagacatttttttctttttgactttttaattttaatttctttataaaccatgttgtgtcataaactaaaactataacattgtcttctgtaatacgtaaattatgttgatgtaatacacataacaagtataattgcgtggaagtggacacggacctgaaagcttaacaggtttctatagttaataagaagtggtacattattaactgcttctggactttgaaaatttaatggtatatattataacttctaagacaaccacaaaaaaagctaatgcaaagaaatgcaactaaaataggaaaattaaaattctaaagatatttaaacaataaaatgaaagccaaataatgagagagaaacaagacagaggagacacttagaaaacaaacaaacaaatgataaacccaaacccagccatataaatggttttcttatatgtgcatatggtatatttaaaggttagactatattattatccataaaaatgacgtttcaaaagactgaaatatatacagagtattctttgatccagtggatttaaattttaaaaatctataacaataagatggtcagataaactttaaatatttggaaattaacagatttcaaaatacctactgggcatatgagacatttgagggaaaattggaaataatttgaactgaataataatgtaattgagcatatcaaaatttgtgagacgtcactaatgctatacacacaggaaaaattttagctttaatagtttaactagaaaggaaaaaaaatatcaaaccaaagacctaggctttcatcttaacaagctagaagaaaagaagtaaattaaaagtgaagcaaaaagaaggaaggaataacaaagaaaagaaaataactttctgaagtagaatacagaaataatacacatgataatgccaagagcttgttctttgaaaggtcaataaaattggtaaatatccagtttggtcaagaaaaaaagaagacacaaatgaccaattcaggaaataaagtagggagataaatgcagatgccacgatcctactaaagcataacctgttatcttactaaaaagataatatgttattaattaatagaaaatgcatgcatattttttaaattaatatttttaaataaataatttatttttaaaataaaacaaaatttatactgatggggttcaggatatactaccaaaaaatatggcaccttggcagtggaggaaatagcagaaacaaaggtctctctgcccttcctccacacttctcccctaaagcaggtcatgcaagaatcctctgactttcttctgaagaaggttacaagactttcattctagaagtgtcattcttgtactcagaagaaaggaatttccttatttcacaagacacagggacacaaagaagaatgtcaaccaacaggccttgctaagttccccatttattaccattagatcacatcacctttcttcaattatacttctccataaatgtccaccattcatcaaaccaaagcataaaaatacacaggtttccctgtttctttggatgttcctgtctgaagtttcccatatcacataaaacttatgttacataaatgtgtatgtttttctcgtgttgatgtgtcttttgttgtaggtgcctcagccatgagaccctgatggtgaatgagaaaagatcttttctctcctacaataccaatacattttacaagctagatgacatggacaaatcatcaaatgactcctattttcaacaccgacctaagaagaaataggaaactgaagcagctctatttcggttaaagaacttgcatctgtaatttaaagccttctcacaaagaaaacttcatgcccagttggcttcattaattaattctatcaaatatttaaggcaaaaataataaaaacccaacataaattttttcagaaaatagaatagaatggaacacttcccaacttattttatgaagcagaaatactctcactctaaaaccagataaagaaatcacaagaaaaaaaagaattaagaccaatatccttcatgatcatgaggcaaaaatgcctggcaaaatattaacacataaaaatcaacaataggcctggcatggtgcctcacacctctaattccagcactttgagaggctgaggcagaagaattgcttgagctcagaggtctgaaaccagcctgaataacaaactgagacttaatctctacagaaatttaaaaaattagccaggcatggtggcatgtgcctgtggtcccagctacttgggaggctgagttgggaggatttcttgggtccaggagttcatggatgcagtaagccatgatcatgctactgcacttcagcctaggtaacagagcaagaccctgtctcaaaaaaaaaaaatcaatactatataaaacatgataatatatcatgaccaatgggtttatcttaggaatgcaaagttggtttaacatctgaaaatcaatgaacatagctcactgtattaatgacaataaaagagaaacctcataagataattgcaatagctgcacaaaaggcattttataataatcagcgttttatgataaaatctttcaacatcctaagaatagaagggaacttcctcacttattaaggtcatttatgaaaaaaaaattacacctaagttatattcaatgatgaaaagttcaatgctttctgcctaacattgggaacaatgaaaagatgtgttctaatgctgattttatttagcattgtaataaaggtcctggttagtgcagtaaagccaaaaaataaataaaaggtacacagatttgaaaggaaggagtagacctgtccttatttgcataacatgattgtgtatgttaaaaccctaagaagtatattttttaagtgaactagaacaaaaaagtgcattgagtaaagttgcaggacacaaaatcaatagacaaaattaactttataattacaaactaacaaataatgaaattaaacagtaataccatttacaatgaaaaaatattgggaaattttgggattaaattattaaaaagaaattcaacatctgtacatgaaaactactaaaattccaaaatgaagctaagaacgatctaaacaattagagatatgtactatgttcatggattggaataagcaatattttttaaatggctgttctccttagattgaattatagattcaatgtaataccaatcctagtcccaaatacttgtttgatgaaatcaacaagataattaaaaaatttatattgaaatacaaaggacctaaactatccaacacaattttgaaaaagtaaaacaaagtttgaggtcttatactacttgatttcaagacttactctaaagttacagtaatcaacacagtgtggcattggcataagaatagacacagatcaatggaatgggatagaaagtccagaaaaagaaatctacacatacattttcaattcatttttgacaaaaaaaaatgctgaagtaattcagtgggaaaaagacaatcttttcaacaacgtactggaataacaaacgagttatgtatctgaaaagaaaggaacgttgctgcttgttacatatactgtctaaaagataactaaaatttgatcgtagaccctaaatgaaagagctaaaattattagaattctaaaagaaaacatgagataaaatctttgtgacattgaggtaggcaaaaatttctcaggacactaaaaatatgaatcataaaagaaaaatacaaaaaatagatttcattcactttagattttttttttttattattatactttaagttctggggtacatgtgcagaatgtgcagttttgttacataggtatacacatgccatggtggtttgctgcacccatcaacccatcacctacattaggtatttttcctaatgctatccctcccctagtcccccatcccctgacaggccccagtgtttaaaaaattaattgggaaaagaataaggaaagccacaccctggtaaagaattttaaaaaatacatctcagacaaagactcatatccagaatgcttaaaggactcagtaataaattgtaaaaaaaaaaaaattaaaagtggacaaaatttttcaagatagtttgcaaaaaacctgcaaatcacccataatcacatgagaagatgttcattattactatgtatcatcaaaatgcaaattaaaacctcagtgagataccactacacacctgctagagtggctaatgtttaatagactgattttgccaactgatagtgaagaaatgatgtgcatgtgactcttatacaattgatggtggaaatgcaaaatggtatagctactttggaaaatagtttggcagtttcccataaagttaagtgcaaacataccatatgacccaacaatataatagctacaacctggcagcaatctaaattgtcactaatgcatgaatttgaatgcataaaaattgaggtctgtcagtcctatagattactcctttgtagtataagggaatgaaacattaatacatggaataacatggataaatctcaagatcattatggtaagtgaaaggagagaaacacaaaagactatgtaatgtgtgattctatttgtaagaaattctaggagaggcaaaactacataatgacaaaacagagcacttgttacctgggtctattgatggaatagatgatccacagtaaaggggcatagaggtctttcacatcccttgttagattcatttctagataggttatgttttgtgttatttttgtcaatggaaaaatataaaaactcatggaaagatgctaagaaaaatacctaaataaatggaaaggcagaccaagtacgcagaaggaagactcagggttgtaaaggtgtccagtttcctccaaatggaactttcaattgaatgaaatctcaatcagtttcccaggagaattctttactaatttaacaggctgaatgtaatgcatataaggctgaatctgacacatataataaacagcaaaatcctaaggaacaccaaacccttcgtgaaggaaactcataagggaaaatttccagatagcaagatgtactacaaaggtacataatttcacagtgtagtatcaatgcaggaatgagtcaactcatcaggggacacataaaaaaagtcccatgtgacccaatgactgcagatattcttgctgaaatattattgatcacatcacatcttatagagcgaataatgaccttctcaaattgtactgcaacaaatagttgcagatataaacatacaaaattagattcctacctcacaccatacattcatgtcatttcccagtgaattaaggctttattttttaaaggaaaattcaaaagtgtttcagaaaatatataggagaacattactatgaccatgtaatgggaaaatatttattatatatgtcatatcaaacacaaagggtaaacatttttactatattaataatttctgcttatcaaaatattttatatataaaacgaaaaccacaactaagaaaatgcactttcaacacataaaactaatgaatatttcatatgggatgtacaaaaaatctcttacaaatcaattagataaaaacattccaacagaaaaaagtgggcaaaataaataaaccaatgaattttataaaataagacaagaatagtaaataagcacatgaagagacttttaaactgattaacactctgatgatgcaaaataaaatcagagataccatttttacacccactgtattggaagatagtaagaagtttgaaaatagcaagttttagagaggatgtgagttatgagatctcattcactattggtgcctgttaaagtgtcataaccacttttgaaaataacttgtaaggttaagattcccataacccaggcaaaaccccgtctctactaaaaatacaaaaattagatcagcgtggtggtgcaagcttgtaatcccagctactgggaaggctgaggcaagagaatcacttgaacccagcaggcagaggttgcagtgagccgagatcatgccattacactccagcctgggcaacaagagtgaaactccgtcaaaaaaataaaaaaagaaaggaaggaaagaaggaaggaagaaagaaagaaaaagaaaaggaaaggagagaggaggggaggggagaggagaggagaggagagggaagaggagaggaagcaaaagtcttgtacatttttaccaaaagatgtaaagaagaatattcatggtagaatggtttgtaataacaataaaactaggaatgactggtatccattgtaatatacactagaatcgtgtacatcagtgagaactaagagccaagacagcatggactattatattcacctcagaaatatgatataatataaattactgaggaacacagtaaatatcaccttattaaggtcaaatgcaaaaaaaaactaaacaacatagtatttaaagatacataaatatgtgataaaactgttaaaagtaccggaatgataaaattcaggaggaaaaaaaagtaatcatacgttctaattctgaaatggtctcattggtttccgtagaaacaagcaggttttatgtacctcaaatgtagtacggcataatcttttttatgtatttatttattttattaagttccgggatacatgtgcaggatgtgcaggtttgtagcataggtaaatgtgtaccatggtggtttgctgcacctatcaacccatcacctaggtattaagccctgcatgcattagctatttatcctgatgctctccctcctcctgacccctgcaacaggccccagtgtatgtcgttcccctctctgtgttttcattgttcagctccccactgcatactcttaaacaatcattatgtttcatggtgatcagtaatgtgggggcggggtagaagcagagaacttggaactcgtgagggggtgtcaaaggtagtaaatcttcatccattgaaggcaaacttgatatttagaaattcattcagagtaaaagctaatggacgaagggagataaggtgacaatcaaattaagtagtaaccttttttgcaacttatataactaacaaacttaagtgctttctaaaaaaaaattctaaaatttgctatataagggcaacttcactgaaatgattgcagagtcttccatgtgagttcttttaatgtgagatagctcattcaatagatgcaccttggtgtgtttgcttaagaaacagaaaaatatgactcatttgatttgttcatgaaagtattaccaggaaaataaatgaaaacaatttcacctaaacatctgttaactttagcactgaagctttggatgtaatttacataatgcataaagtagattgatctaggaccatgtcgatgatgaaattttcattatattgatagactttcattttcctcataaaatctacacatacttaaattataacaactctgcttttgaattaatccagtctgcataatgtttttcagtcatcaactattatagtgtgaaatgcctttaccatcaaactggctcaaggttactgccttcactcagaaagatagtgttttccttctccccactgtgggccctgcctctcaacctgcaaccctacatttcagaaagtagtttgcctgtatgaaattttcttactctcttctaaggtagtggctgcaaaatggtacctatctctgattttaatttgcatcatcagagtgttaatgactttaagagtctactcatgtgcttacttactatttttgttttataaaatttcttggtgtacgcatgttctcactcataggtgggaattgaacaatgagaacacttggacacaggaaggggaacatcacacaccagggcctgttgtacggtggggggcagggggagggatagcattaggagaaatacctaatgtaaatgatgagttaatgggtgcagcacaccaacatggcacatgtatacatatgtaacaaacctgcatgttgtgcacatgtaccctagaacttaaagtataatacaaaaaagaaaaaaaaaaggcataaaaattctagaagaaaacattggaaagtgtctttatcatcttggagggtcaaagatctttctaattatggttcaaaactaagatgtcgttaaagatggatacatttgatgaaataaacatttttttaaattaaaaaaaattattggtgtatttattttgcctatttttttctgttggagtgtttttatctcattgattttggggagttgttttttatacaaccctacctttcagaaatacaccctttcattcataggagatatatatgtacatgtccatatgcataccattttgagtaagcgtttttactaattttctaaggggatgcttgaaatcttggttgttcatctacaagaggccagactcagcatctatgagatgtatagattcaaaggtattcatggcagcgaagagctaattcctccaagcaagagcacctaggggagctcgtggagcagatgaaagcatgttttgcaggatgtggctatgggccacaagcattctgcatacagatttactccaaagttggatataggaaattagtccctttactaacagttgtctttggctccttggagtatctgctttcttaatctgctctttgtgtcctgcccaagaacattctagctgttccaaaggttttcggtgtgtgcgcctgtgctttctatgtcaatgtgtaaagtaggagagaagcatcatgtgaggctggattaagaagagctgggcatattgcaccatattgaaagggccgtttgatgagtgggagcctatctttttttcagaactagtgattttactttacataagcattcgtcaaaagttgaggagagttccttgatgtttcatgtggtttttttctacttcctctcttacagatacagaattcatctacagagaacagaaaggaacagtgagactgtggaatgttgaaacaaatacttctactgtcttaatagaaggcaaaaaaattgtaagtactctctttaatgaccgggataatttcagtttttcttcctgcaagtcaataaaacagaaaatgacttttggtttcaacttttagcatagccaaggagaagcaataaacttgtaatactacaggctgagcaaccaaagataatgtgaaattgaaaccacgctaattcaataagatgaaagcactgtttctttcattgtctgggaaatttctctgcaggtgttgggaacaagtgttgcatatcatatataattaaaagataaagtcctaaggcttttacacatttacagaacaattgcaataatgcatgtagaatacttcaggagaatttgctcaatcctgtttaaaaaaagctcgtctccgcatgcataggaagtattaacttaggcactgtgactgtacttaccctaattatattaagtggatgcttatgcctcaaagtaaatactgagtcaatatgaatgccactgctttatgatttgggaaaacttgttttcccaaatatatgtatattttttgagacaggatctcactctgttgcccaggctggagcgaagtggtgcaatcatggctcatttgcagccttgacctcccaagctcaggcaatcctcccacctcagcctcctgagtagctgggactacaggcgtgtgccgccgtgcccagctaattgtttttgtttttgtttgtagagatagggtctcactatgttgcccaggctggtcttgaactcctgtactcaagcaatcctcctgctttggcctcccaaagtgccgggattacaggcctgagccactgtactcgaccccaaagatttaaatggcattaagatttgatgttcatgtacggttaaagatatgtattagaaatattgactggagttatacaccaaaatcaatttaaagagaattaacattttgtttgtttacaaaatgttcagactcttattagaataaataaatctccaactcaaagcagttgattcttttcttgtttgagacactggggaaatcaaaggacagaactaaggttaaagctatgttaaaaagcaagaattgaaacaggctgtgaatcccgttaaagcgatcataacagggctctggtatgaatcagaaacacagaaatcctagaatcctataatccgggattagaggaggttgtaaaaaaaattaaccggttccctggttttacagataaggatcctgagcgagacttagagcatgagcttttgagtctcacagctcagtgatggctgagggagcattcaggtggtgtcccagaagcctgtgtcccagggagaaggaaggatggcttcatctttaccctaccccatccccagatccacagaaatgctgtgctgccttcttttccctcctaaagaacatgtaacttgctatttaaatactttcatttcttttcttttgcataaagatacctttttattaaaaggtttgctgagatttagtattaaatgcatgctgcccctaacatagactgcaggcgtaagggaggcctcacgctgttggatgatggcatagttccaaaaatgatcactttattgaattaaatagtattctgcaaagtaggacctaggacaaatgaatgtgcctgcatttttgcattaaaaaaatcatctttggtagaattactcccctaagagaatctgattcaactcacttagaaatactaacgttgtagaaatggttttctaatattaatagagaggataaaatgatcagactgttgctgagcgtcagtgcattttaatgtcggaatgttatcattatttcctgtgaggatgtcagtttagtaaaggctgggtgttgtacataacagcagcacttagcaatgaaatacatgaatgtgaaccgccttctctttctaaaatcaatagcttgtgacagatcatatattttaactgaagttattttagccaagtcgcctttaataaggtgacttcagaaaccaccatgggtaaagaaaagttctcatctcagaaattcgctggcttattctatataatgcaatcttttttccttaaaatgtcacttttccatccattttataaacatttattaagcaccaaatatgtacagcctaatggattcattattcctttctcaaagctacatttaaatgctcctgtcaacagactcaaaataaagaagacaaaaaatgtcatttagaggtctgcatcctaatttaatttaatctggatttaatttccgcagagccacttagtcatttaaaattatcatgcctcaattgctctatctccaaattaaagctgatttcttctgccagcccagaacctgggtactctgtgagatccagcaatggaatatgtgtatgctctgtgtgttttcatgagcaagtatggagaaggtgaagcctggtgttccacaggggctggaggttggaggatcacccacagcctggaggaattgggaatggggagcagtagctcttccatattctgttctcttgccttcctggtgactgatcaggtgttctcttctcatttgaattccagaagctgtgagcttgtataaatgataaaaagcaatctgaggccaactgtaatttttaagttgggctataaaacagccttaaacaagttgagaaatggaaaggaattggtaaattctgtggtcagcagaattttaaaatattccctacaaccttgacctctaataacctcattctctttcccgagccaataaaaacagaccctcctcatagctggtcactgcaaggtaccaaagcctgtttgcctccagcttcttctttgctcctgcgcttactgtgattggctcttacatgggacaggtggatggaagggcctgcaaatcactgcaaacattttgtcaatccagcaggaaagcttttaagatagctggtgattaagcaaattcagagcttgtgctaagttctgtatttacatggatgtatttcacctttccttcccccaaacaatttcttttgactaaatttactaattcagtcatcctttattgtgcttttaaatggtagaaatcatgaaatatttcacaataccacaaacactttagattgttgagttcagaccaggtgcggtggttcatgcctgtaattccagcactttgagaggccaaggcgggtggatcacttgaagtcaggagttcgagaccagcatggccaatgtggtgaaaccccatctctactaaaaattaaaaagttagccgagcatggtggagcatgcctgtaatcccacctacttgggaagccgaggcaagagaaacgcttgaacctgagagttggaggttgcagtgagtcgacatcgttccactacacgccagcctgggcaacagagtgagactccatctcaaaaaaaaaaaaaaaaaaaagagtttctgtatgtgtaaacatttaaaattctatgatgattatattatggttcacaatttggggggcattcttttgttttatatatatatataaaacaaatatatatacacacaaatatatgtattttatatatatattttatatatatatatatagtgggctatttcctgatccttattatttgatagcatatcatatttgatggtagctaagaactgctttttagaaaacatttatcaaaatgtcttgatccatttcctcttttgagaatttttgaagtgcttgtctacatttctacagaaaatgaatcaaataaaagcacagttgtccccaaagcacaagtgcatcatctctgaagtagctctcctcagctgtaaaggctgctgcccagttctaagctcactggagcaggttctgtttgggatttaattttgtctcccacatagtgctcagcaccatgacctgcacatagtagatgctccactgctatgtgttttatgaatgaccgctctagaataacaaaacaatagagttgagcagttttccagaaacatccatgtgagtgacaggtgtggaggggcattcagcactggggtcatgactttgagcttcaggtctaccttccagccttggcattgtgctctgctcaggaacaacaggaccccagccggttgtgcaagttctgaatgtccagtcttatccctcaggagtgtcgtaggactgaattacagttgtaacagctggaatgtgggtatatgccacatgtggattccagagcgttaggctagaccaaagagcctgggccaggctcagggctcaggcaggaggagtgggttggttctatgaaggaagagacagaggatgatgatgtccaaaggagcatgacaaggatgctgccgcatgtgggcggctgcgtgggtccaggcagcagtagcagacagtggaatccacgccactttagttttgaggtccatccctcatgaagctggatgtagcctgcatcccagagtgaggcagaggcatccagagctggtaattacagcaagaggcactcgcagaactctaaacatcaataaaaaatcaaacctaagctcacttttatttgaattacatgtttgatgtcacagaaattccgggaccttacactttactcttttaaacacaattttaaatgtcaatgttattttacgtttcatgctccttataagactcttgtcaacaagatagcacatcttatcaaatggcctttgttctattatgtatcttgtttttttttcctaaaaaatgaaccaccacaaatatatctcatggtccaaaattggatctttggacatttggccaatggttgcctggttcctaaagtcctcatgaatttttatcttctgagtagaacactcctttttcctttccctccctccctccttttcttcatccttcactcctccctccctccctcccttccttccttccttccttccttccatccttccttccttccttccttccttccttgtagaaatacacttaaaatagccttaatacattttgctgaactaaatagatttcttggggacttaattcttacaaaaatttaacaccatctctccaattcttttaaaacataatagagcaaaaattatcagaagggtgaagtgtttcaccagtgcttaatatttagatatttaaagctgaaatagtctttagagactgtgtctttcaaactcttcttttatgaggtgaggaaactaagaatttctaagaacagttctctggcttaacctccactgatagtgctatggatgtaacgcaccagttcagaatgagtcactgtattgacctgtgtcactcatactgtataggccctttttattgacaatgctatcagtgacaagaagcattaagatttatatagtcattcattgtatcacttaaattctgccaggtgtttggaaagcaacttagtgatacgtttcaggagcagtaacaatattgatgcatttttatttgctctggggaatgcttctgtacaaagttgcagcattatttgttaatacaatagtgaaaatacttgaaactaggaaaatgagataactttttaaaaaaagataaaatatgatgtattcattaaaataatagctatgaagggtatgtagcgatacaaaaaatatttatgatatattttaaaaagatacaatatactaggctaacaactatatatattgaaaggctagaaagtgaacactgaactatgaaaatacttaatcttgttgggtggtgagattttgtgtattattttctagtgtggtgatttccataactgccatttcaatgccatttattcaataattttaatcgggatttaaaaattttggtttcatctttcaaaaaacagcagactgccttctcacaatgagtatgtaagagctgtagacagttcccggaaattcttgaaggagaaaataagtcgattatttaaaaaaaaaaaaaaaagtattctattgttatgcttatgtcaggctttctccatttttatgtcttgttttaattactaatttctttgttttaattgcttattttaatgactaaattaacatctaaatgaaatgtattttctctaagctgtatccttcttggttttatataatcatagatgtagaatttgaatttttatctctgtctctaaaaattaattaattctgactcctcacagaaagagacataaataggcaagtattattagacccattccaaaataagaagaacaaataataggcctgtttgtactaccagaggaactccagaatgtggctgagattagaactcgagactactttctttttacttcttcaaataaactccactggatacttgacccctgcatcagtaattctcactttattctatgtcatttaatttctgttaagtgctttatgcgctagtcctctcagccctgaaacagggtaaatttggaaggaaacagaagcccactttcttacctctttctcttttctgttctgcacagagcccagtgcactgttgaatgggaagcacaggatgttctgacaggtgtcatctcagccaggaacaggctggcccccgggaagtgggctcagcctcggtttcagctcctgttgtcctgagttcactgaccactgataaccaggacggtggctgcaacttcagtgggccagcaatggcccatgagccatctctaatctgaggctggatttcacttagcatgtcagtgaaaaccatgaggggaaacagccgtgtttttgtgtacggttgagagggcataaactggcagctcgtgatgcccactgaaatgttttgtttggcccacagagtggtttttacaaactaacccagatttctggcgtctcttgaaaaatacaaagatctggcagcagcaagatcctcatttgctcacagagagcaaaatttggctggagctaagaggcagctggcccctcagacaggacatgggccgaccagccctgcagtgacccacatttgctgacttctaaccagactggtctctgagtttgaaaccccttttagttcaggaacaaaagggtggcataagaactcaatgtcttctgcaagaacgttgcacattgtgagaaatcgtagcacaaactgtcttggtattatctgtattcatttctgtctgtaaaattccctggatcctctttgtccccctatgtcattatttcatttttctcctgtgtctcagagggtctctctctctctttttttttcttttgtctttcttgtcctacttttctctctcctgccttttctgtttctacttctcttactacaagatagaacagaaaacaagtatattttacttacttttattctaacttttaccacatagaccatgattttactttttaaagtggatgaggctgagcacagtggctcacgcgtgtaatcccagcactttgggaggccgaggcgggcagatcacttgaggtcaggagttcaagaccagcctggccaacatggtgaaaccccatctctactaaaaataaaaaaattagtgtggcgtggtggcaggcgcctgtaatcccagctactcaggaggctgaggcaggagaattgcgtgaaccggggaggtggaggctgcagtgagcagagaacacgccactgtactccagcctgggcaacagagagaaactccatctcaaagtaaaataaaaataataaataagtacagtagatgagtatttatacttatgtctttaaaatatctgaaaagaggccgggcgcagtggctcacgcctgtaatcccagcactttgggaggctgaggtgggcggatcacaaggtttaggagcttgaaaccagcctggccaatatggtgacaccccatctctatgcctgtagtcccagctactcgggaggctgaggcagacgaatcgcttgaacccaggaggcagagggtacagtgagccgagatggtgccattgcactccagcctgggtgacagcgagactccatctcaaaaaaaaaaaaaaaaaaattctgaaaagcagtacagtagtggtttaatctttctggccccagagctactgttccctgcaggctaagggctgtgtaccatcactcctccatcacacgtatactcttcaagtgacagtcagggaaggccttctctgtgcaaggccctgactagacatggtggtgggtggatacagtgattaataaaaacagatttctactcttatgtagctttcagcctgcatataaaagaagtagttgttttaacataatatattttgcaacggaggtattaatccaatgtgcaatgagaacaaggtgagaaagaaagaggattgctgggaactctagatagaggcttgcagaaggaacatttcagcagtccttgaacatgggagaaaagtcggaaatggcataataggcaaaatgaaaagggtggataattccacatttcaggggtagacagtgcggttagtaggttgttttgggaggggcttgaaaagttgtggctggaaggtctggggaaaaggtggagagaggtcttcaggaagcttccattgtgtgtagtctttagtctgtagcacatggaaaggtgtcaaccaaaattaaagctactgaagcagaaatgatgtaataaaggtttattggaagccacaggtgagaatcgatctgggaaaacacaccaacaaagttggacatgttccagaatctgttacaagccagaaggctttcataagaaagtttaggagaagtgaaggggactcctcatatcagagttgtcctttatcattaagaggtacaataaaaaggttccaatcactgacaacagattgcaacacacaggctaaaatgcctacgtgcaagacaatcagtaaaacttcatgattcagaggcaaatcagcatccttttcaatgtcagtagatcacacagtaatcagtacgtcaacaatttgaagagctcacagtaagattgtttacttagcgacaagatgacacacaagacttcttccccaggtgacttaatttggaagtttgccaaatgtgacctgtagggtattatttccctcttttgattaaaaaaacaacaacaactaaccatggaagcattgatgatcagtctctgcttacgttagaagggtagacatccttctttccttccttggctctgcgaaggctcattcccaagaagtcatgtccctgagtggggagaacaaaccttatcatcgcatgtgggccaggttgctagcaacatggggtagatcatgacacgaggttacatgccaatctcctgaataatgaatcaacctccagtctctggacgatcattattttggccttaactgtggaggcatagtttacaaattctggagaattcaggtacagagaaaggtaaatgttttaattttattcacaaaagtatactttacctgattgttttaaaatacaaatagctcctttatttataatttttagaaatatgttttgctatagtattgttattttatttggaaataaagaatgagtattatttaaattgaacataactttaagattgaaaattatgtaacaattatttataaaagtttatcccatttatatttacctaatttatttatttttaacagtttacctggattgctcatgaaaactgagatattggacaaagttagtcattatttcaagttacttccttgttaaccatttttatggcctgtgaatatcagatgttcacttaaggaaggagtttaggttaaatatatgggtattttgctaataactcagaagatacagctttttttcatttaaccaacaagattaaattagtcttacccttcaaaaaattacacaaaaatcattctggttttggctgggcttgtagttctataacctttgtgccaaaccctgacatttaaaaatatctagcagagacaaatataaaattgtcttccaagtataatgaggcaaaagggtatgctgacaatcttgaagacatttctacttttattttatcaataatttaaaaaccagcttgtttattaagggtttacttaagtcatgtgaacttgggaaatatttgtgtttactaatttatgaatgctcatttatttatgttgatttggtaccaggtagacataacatataatacatctaagtaagtgtaaacacatctaaacatacacaaacacaaataaagattgtacagctttcattttagaattttagttctttttttttttttttttttgagacgaagttttgctcttgttgcccaagctggagtgcaatggcgcgatctcggctcactgcaacctccgtctcccaggttcaagcgattcactggcctcagcctcctaaatagctgggattacaggcgagtgccaccatgcccggctaattttttgtatttttagtagagacagggtttcaccatacaaactcaccaatttataaaagacagctggatccaagttatatttctgacaaaattgggacctattcatatggctaaactttttttgcccctatgggtaatctaatgaaagctacagaccaaaagtttgggtaaagcagtttccatgtaagtttgatttttacaaacttcttttaccattttttataagtttcaaatgagttcaattttcaatgtttacattttacctgaaaactgaccaaattgcataacaaagacaaaatctccaagtagtcttgaaatagtaacaaatctatcttttgtttgctgatcttgtttgattagcaaatgcaggtggggaaaaatttttagcagtttctctcttttttgggggaggtggcactttttcctttcagcctttgtagcagaaaaagcaaaatttttgtgctagacacagatagatgattgctctgagctcaagattctgacttattagacctgagggcctaacttttctaaacatttatctttttcttttagattattaattgttcaattaagcatttcattttaatacgagtggctgaatctattttaccaatgccagtggaagatcgggatcataaatggtctggcaaagcttacaataaatcaattggtatcattcattagtttcagtttagaaaaaaacttgttggatctgtatttttatcatctcagtaatttcattctcatgctgtagtcctttcatttgctccttttgttccaaattcatacatttccctcttttgagagagaaggaaatgtgtgcattgtgaaattccaaaaatctctgcctaagaaatgtatgggagctgagggaacaagcagagaaggatgaggaatgaggagcagttggaggtgaaagggacaaagtctctgaagtctttttcacggcagagatagttgcgaatatccttttgtttacctcttgaatggaggcaattttttctttcaaaattttttatggaagcttctaggtgctattggaagtaagtcttccattcaatttgtctaattctaaatccagctttttccaattgtgtgcccaagtaaatcattttaggcatttcaaagggtccccattttgggtgttgctgcttatgaccatgccaagttaggtggatccacttatctaagcacttgcaggtaaaaggaccaaaagtattgtgcataaaaccagctggtgttgattagaggcagtgcactgtcagtctcagaagacctgctttccatcgtgattgttttgagtgagaccagctatgtagtggagcaaaagtgcccctcatgccatcactaaggaaaagtgctttcgccccaaacctccagggaaaaattcacagagctactttaccttgccctaaaattcaaacaaaaacccttaccttggattggtaagagggatactcgttctgagaaagacattgtattttctagccaaggagaaagccagcttcaaaaaaatcacaactttgaccaagacgggaagtttgttgatttcaggaagaactcatctgtaccacccagcaggggcgtccaagctcacaatgggtttgttgccaggatctgcatgaaggctggaagctgtgctggatggtccatggaggtcactccaaagcctactggctacaccataatgttgacagaaattaaggctgaaataacgtgataaaaggtgtattggaagccaaatgtgaggatcagcccaggaagacacatcaacaaagtcaggagtgttctagagtctttaacaagttggaaggcttttataagaaagcttaagagaagggaggggactcctcatatctgagttgtccttttcattggagggtatgatacagggcttataatcattggctacggattgcaacatacaggctgaaatgtctgtatgcaagaaaattagtaaaacttcttgattcagaaacagatcagcattttttcaatgtcagtaagtcatacaaataatcagccacatcaacaatttgaggaactcaaggtaagatactttactcagggacaagatgtcaccatgcatcacaagaccttcccccaggtgggttagaatttttgagctggttagaatttaaagccaccgtgctttaggaaaataactgtaaccaataagaaaggggtttgtagaaggtaaagattataaacaaaacatcgacagtggctgcttcaagtccaggtgaatgtgatggaggtcttaaattaaggcagtggctttgaagacacaggagaagttggtttaagttacatcacaggagtagaattgataacacttggcttcactttgtgtacaggcagatgggattaaacaatagtctatgttgtctggggtttttcgagacttgctcatgggtggagagatgtcaaattcagaaactgaaatggggagagaaacagattgtgaagtagaaaaccaaagccactttgaggaataagctactgcaaggtatatgcagagttcattaactaatagttgatattttgagtgcttacggtgtgactaaagaatcctaaacactctacgttcattatcttacttaaccaaaatccttaggaactctgtgagcttcagtactttattattattttaaaactcagaaaaaagaggttaaaaaaccttttactaagtcacacagctgatagctgatagtcctgagagctgaagtcagctttgtctagttccaaactaaattatttctagactgcatacataatccagctgtagccttggtcgctgcagttataagatagggctgaggccgccattccattactgagaaggaagccaccgcttcaaacactgtgttcatatctgtgagtccatcattacatatcacgtggttactcctggaggccactacatttgccctaaaatgaagactagagatgcaaaacattgagtcagtttagcctaatgccaaaaaaaaaaaaaaaaaaaaaagtgctgacacagctgagtcctggggaacgatctgtttcaaggttagagagaaccgagctgtaaaccatctggacgctttttcgatgtggctatttaatcatctttccactctgctctatagcatctatgttttcaggttttctctgactcagtaaatgcagtgctgggagcagcacccgagtctgtctgattcaaaattaaattattcttaggtgaattcagggcccagaggcaggctgtggccactatcattaacattatcgccaggcccaagggttctgtctttctcattgaccaggaagggagaatacaatcatctatttatgttaaatttgatgtgtgcacccacagagttgcacatagcatcctcctgtaacaatcttttcagtatttgtcttttgttgatcattactcatcttgtatatttagggttttttttcattatgagtttcatgaggaggttgtattcaaaaaagcctctgggtatatttatgctttctaccattcatttcccttccattacttgacaaattgggggcattctatcattttatatctcttttttccctaacaaccaccttttcttctctgcatttattatcacatatgtatttatctactacaggaaaaacaaaccaatcctttagttagatatgtatctcctcagaaacatgcctagaattttatataaatgggatcatcatacatgtagaccaatatttttaaagtcagcataatgttatttaaacttgtgttattgatataactggtagccccagataatgcaaaaggtgaaatactgtatatacccatctctctagtaagtataaaagttatgagcaaaatattaacaagtggagttcagctgtgtaccaaaatcataatatgctaaagtcaggtttaatgattacaacagcatttaaatatcaggaaatcaatcaacaaaatttattagaactacaaaatgatagaaaaatccttatgattaagtcactaggtgctgaaaaagggatctgataaagtttatcaacagctcctaataaaaatccttgctaatgtaagaataaataattgcttaaatatgctaaaggttgtttaccaagaaccaaccatcagtgaaaaccattctaaatgacaaacaataaaaccatttcaattatagccaggtatcaggcaagaatactcaccatcaccattaatatttaatatgttcttgaagaaagtgcaaccaaaccaaatgattcaaataagaactagaaaatagaagaaaaaaagacaacttttttctcataatagaattttatttctgaaaaacctaacatatattagttttaatatacaccatggaatactatgcagccataaaaaatgatgagttcatgtcctttgtagggacatggatgaagctggaaaccatcattcccagcaaactattgcaaggacaaaaaaccaaacaccacatgttctcactcataggtgggaattgaacaatgagaacacttggacacaggaaggggaacatcacacaccggcgactgttgtggggtgggggaaggggggacggatagcattaggagatatacctaatgctaaatgacgagttaatgggtgcagcacaccaacatggcacatgtatacatatgtaacaaacctgcatgttgcgcacatgtaccctaaaacttaaagtataataataataaaataaaatttaaaaaaatccaaatgtcaaaaaaaactaataagaacatatcttaatatggctaaatacaagaaatatattatgaaatcaatagcttttctcttcaccaatataaataccttgaagtgaaaatggagaaaatattccattcacaataagaacaaaaatataaaaagacttcaaataaatctgacatgaactccagaagattgaacaaagcaaactataagatcttgttagaaatttgaaaacattaaaaaaattgtataatattaaataagaaaacaatatttaaaatgttaattatttgaaagttgatatcaaactttaacacaatcctaattagaactctgaaactgctttagtgtaaacattttgcaaaatgatcttgattgtcatatataagaataaacacctttgtgtagccatgaagcatttcaaaatgcatagtaatgtatactcttttacctgcagtgaaaacacacaagaacgacgttatattcaactcaatgacaataatagctaacgctttgaatacttattatgtaccaggtattgtaattactttattaaatttgtgtatcaattatgaggtaggtacaaatattatctacactttacagaggcataaaaaattgagaaattttcagcatctctcatagtgaatggtataaacaggatatgaatcacagtctgtctgaatccacagtccaagcttaaaactatcaaattttgcatagaagtagcaaagagagtgctgaaaaactggagaatttgaaagaagcttccaatataaacaagtatttgacatgagaaacactagggatagggtgacacacttagaacacagtgctggcataactaactcttcatctacaaagatgtaatgtaagtctcattgtacaaatacacaaaattacgttccaattggattaaagccttaaatgtttttaaaagtctataatttggtttcataaaaagagagaaatttttaatcaaaataggaaatcctgaagctataaaagatagccatatttaatttgccatatatgattttaaattttaattttaagaaaggcaaaattagtagacaaacaatggaaaatatttacaatccaggtaacaagtaaaaggagtatatctacaactgataaggaattcttccaaattgagcacaaaaagacaaataaataatagaaaatgaacaaaaatattttagaattagctcaatcaagcctgaaaccaaggcctgctttgtttgggaaattgatacatagagcaaacgttcaggaatgtgttagatgtttttttgcattcactattggcacttggtgagaaggtagacctgcagctcaaaatttgtacaactgctacaggatcccttgaatttgtaacagggccactcgttctgagaaagacattgtattttctagccaaggagaaagccagcttcaaaaaatcacaacttcgaccaagacgggaagtttgttgatttcagggagaactcatctgtagcacccatcgggggcatccaagcttatccaccagataagtggagccacctaacctggcatggtcacaagcagccaagtccaaaatggagactggggtggtcagaaatgcctggaatcacacctaaccatggcagtggtgagtttctcaaagagaaaacaaattctcactgtctccggcagcatcgttagcaattgaccctccatcaaggaatgtgacccggactaatttctaagtgtaaaagttgcattctttgctggtttcttttggtgttattgcgtatcagccccactgttgccactcttgtaacagctgaggatgtaatcattcatttcttcagcaaacatctagggagcatctctattataacccagtcaccgttaggcactgggaatagaaccgtggcaaaacaaactaaaatttgcttcttggcatctggtcctggccatgagactataagaggattggaattaccctcctaacataaacaactataaaatgggataaaatgtggagagaaaaatcagttttcatgtattggacagcaggcagtgcacagctgtgatccccgagaaaagaaaaacaaatgaatgaaccatgccatcccgtgggctttctgcgtgaatgctgtactgcagcacgaaggggaaaaattcaagacctgcagtcttgccaagttaagaagacagaagtcagagttcaagaaaagaagatggctacagtttatgagatggagtacccaaaaggaggaaactagagaatactcacaaaatctatttaagtaattccttttaatggcaaaaccacaattactttattattattattatactttaagttctggggtacatgtgcagaatgtgtaggtttgttacgtaggtatacacgtgccacagtggtttgctgcacccatcaacccatcacctacattagggatttctcctaatgctatccctccctttacccctccacccccccacaggccccagtatatgatgttcccctccctgtgtccatgtgttctcaatgttgaactcccacttatgagtaagaacatgtggtgtttgaaaaaccgcagttacttttgcaccagcctaatacatagatttccctttgagacctcggttaattattgacctttatatgtgaataatgaaacaccaaaaggcagaacaaaataaaactccaaggaaataacaattacagaactctgttagatgaagtattcccagagctcatatattgtcaggaattatttaagtttattctaaccatgagacattaaacagagaccccaggaaagtagtttcttaggatgaggttcaattagcactcaaatatagtcatgtgtcacataatggcatcttagtcaacaatggatgtaggacattggtcccctaagattataatatcatatttttattgtatcttttttatgtttagatatttttagatatacaaaaattaccgctgtgttacaactctctacagttttcagtagagtaacatgctgtacaggcttggagccttggagcaataggctatgccatatggcctaggtgtggagtaggctgtaccatctaggttcgtgtaggtactttctgtgatgtttgcacaatggcagaatcgcccaatggtacatttctcagaacatatcagatatattgttaagtgatgcatgactaatggccactatggaataacccttaaaacatcttttttaaaaaccttgaataagtcaggttaatccacaaataattaattgcctgtcataaaaagtccaatattctttgaaggaaaacaaaaagtcctaaattcaacaagagagaattaaaaatatctggtgttaatttaaaaataaaacatgatatatgcaaaggagcagggaaatgtgactcctaatgaggagaaatatcagttgatagaaacagaactcctgataacaaagataagggaattagcagaaaaacacatgaaaactgctaagataaatgtattccaaatgctcaaggctataaggaaaaccatgaacatgatgataagagaaattaaagattataagacacccagataaaatttccagagattaaaaaaaaaaaaaattctctagatgatcaccaggttagataccacagaagaaaaaaaaaaaacccctaaattgtaagcagtagcaatagaaaactatttaaaaccaagaacaaagagaaacttgaaaaaaaaaaaagcctgaacagcatgtcaataagctgttggacagtataaagtagactaatatacctgtcattaaagttccagaaagtgaagagagaaaagaagataaaacaaacttttgaagaaataatgactgaatttcttccaaatttggtaaagaactcaataaactccataaagaaaataataacaaagaatatgataatcaagttacttaagatgagtgacaaatagaacatcttaatggcagccaaaggagcgagacgtgtttggaagaacaaacctaagaaaacagctgactcttcaacagaggtgctgcgagccagaggacattggaatgagatcatttaaagtgctgggaggcataaaacactgtcagtctacagttctacacaccacagaaatatctctcaaaaataaacattaagaatttgtataggcccagctactcaagaggctgaggcagaaggatcccttgagcctaggagtttatggctgcagtcagctatgatcacaccactgcaccccagcctgggcaacagaatgagacctttttctcttaaaaaaaataatatatatagatatatatataaagatatagatatatataagatatatataaagatatagacatatataaacatatatatataaagatatatattttcagagaaaatcagacagtatttattggccataaacctatactatgagaaacttaagggaagttctttggagtaagaaaaattacaccagatgaaaagttacatctacatgacagaaggaggtgtgccaggaatgataaatgttgtcaacatatggccaggttttgggtggaaatttttgtagaattagttaactagttctttaaaatatccttccttttctcaaagggtcctttaaatataataaaatatgtccagctcctctgaatgtaatctcatgtaagacttctgtctgaacctttgtcctgctctaaacactgacatggaaagtgaaaatataaacacataaaacctttggaacatgttagaactttcttggacaatagtggcaataataaatctgatctaatatagggtggactataactgacagtttaaaggacagatttcctatatcattatgcctacaagctccccttaatactcctggaggattttatattttgtttaaaaggaaagatccaattataagctatctatgttatctaattttaatataaagacatagattaaaattaagtgaattttaaagctgggcatggtggctcatgcctgtaatcccatcactttggaaggctgagactggcagattacctgaggtcagagttcgagaccaacctggccaacattgtgaaaccacatctctgctaaaaatataaaagttaaccaggtatgatggtgggcgcctgttatcccagcagctcgggaggctgaggcaggacaatcgcttgaacccaggatgcagaggttgccgtgaactgagatcatgccactgcactccagcctgggtgacagagtgagactccgtcttaaaaaaaaaaaaaaaaaatgaaatggattttaagagatataccatccaaaccctagtcaatgaaaatcttgaatggctatattaatattagataaaatagacaacaaggaatattaccagaaataagaagaaatatttcataatgataaaggagtaagtttattaagaagacttaagaatcctaaagatgtatgcagctagcattgagctacaatatttgaagcaataattggttgaaccaaaagaagaaatagacaaatccataatttaagttgtagatcccaacaatcctctctgagtaattgatagactatgtaaaaacatttaataaggatacggaagtcttgaaaacactattaaccaagtcaaccgaattgacatgtgtgcatcacatcactcatcaatagaaaaatgcacattcctctgagtgcacgtgaaacattcaccagagtagactatatgctgggccattaaacaagtctcaatatattgcaaaggatggaaattatacaaagtatgttctttaacagaaacaaactagaaatcaataccagaaaaaatatctggaatgtatcttgataattggaaattgaacaacatatttctaaataacaaatcagccaaagaagaaactgaatgtattttaagtgaatgaaaataaaagcaataatatcaaaatttacggtatgcaacaaagcaatacttaaaggggaatttatatctttaactgttcatattagatctcagctttcacttcaataaactaggaaaaaagatttaaaaccccaagtacacagaagaatagttaggagcagaaatcaactacacagaaaacagaaaaatgttagaaaaaatgaccagctgttttttggaaaagatcaataaaatcaatcaagagcaaagataatggaaaaaaaatcagacaccaagcaaacatattaataatttggacaatataaatgaaacagaaaagtccttgaaagacacaaagtattacagttcaccagttaagaaataagtaacctgaatacctggatattggtgtaataaattgaattcgtagtttaaaagccccacatattaaaactcaaggcccaaattgattcacttgatcaattctaccaaacatttatgtaagaaatagtaccaattctgcacaaacttattagacaaatagaagaggaggaagatatatttccaaaattcatttcttagggcagtattaccctgaaataaaaaccaaacaaagaagttaaaagaaaataaaaccacagatgacattccctcatgaacacagatgcaaaaatcctcaacaaaatattagcaaattgagtccaacaatatataaaaaggggtaatacatcacggtcgaatagcttatcccagcatgcaaggttggtttaacattagaaatcaaacaatgtaatttaccatattgacagattaagactaaaaaagcaaaataacataatcatctcaataaatgcagaaaaagcatttgagaaaattaaacatacattcattataaaaactctgagcaaactagaaatagacaggaatatcttcaacctgataaaagatatctattaaaaataccataaatatcatacttaatggagaagaatgaaggctttctcctcaagattagggaaaaaagcaaggctgttcactctcactacttctactcagcattatactagcagttctctagagtgcaataaggcaaccaaaagcaataaaaagtgtctagatagaaaagaaaggaaatacctatatacacaggaaatatgattttgtagaaaattctaagaaatatacagaaaatatctaccagaacaaataattacatgtatcaatgctacagaaaataaggtcaggatacccaaatgaattttgcatattagcaataatcaattaaatatttaaattaaaatatacatgtacttttatatgtacaaagcatcaattatagtacatccttgggaataaatttacaaaatatgggcaaaatctgtattctgaaaactgcaaaacattgctgagagaaattaaagattaaaaccatcttcctttcaaggtgtttacactctaatgaagaaagcaggcaatatttaagataaataggttaaaaaatataaaatatgtattaatatgattagacctagagaaacaaatcagagaaaggggtataaaaagtcggaggcaaggcagttaatatctagatatattagctattgaaggacatggaaggcctcacttagaaggtgacttgagataaaagccaaagaaatgaaaggttgagagcatttcaggcagaagaaagaggagttgcaaaggccttgagaatggcatgtgcctggcttgctttaggatggacagagactggcgtggctgcagtgaagcagatgggactgaggggagaatactgggagatggatgcagagagctaagagggaactaggtccagcagggctgcctggtcagtcaggactttggcttttcccacaggtgagatgggaagctgtgggagggtttcccaggggagcgatgtgatttacatatttgagagatggccctggccgcctgggaaagcaggtagaaggccactgcagtacctcaggaaagaatgcacataccttagacaagggtaatggtggtgggaaagagaagaaatggttccaaacctattttgaaggtaaaccaatggtattttctgaccacctagatgtagggtgtgtaaaacagagggaaagagaaaagatagccaagagtttgacctaacaaccaagctaatggggttgccactatctgagaagaggaaaaaggttacaggagctggaggtgtgggagtggagtagaagggtctcagcttattcccattgacttgaggtatccatttgacactcaagtacagatgtcagggaggcagttggccagacaagcctgaagttcaaggtcaggtccagtgcgggttcaggtggtctgggctggagacatgaatgttggaatcctcagccagactgcgcatggtttttagaaccatgagactggataacaccacctaggaagtgaggagatccaaatatcaatccttgagcactccaacattcagagctcaagaaaacaaggagaagcacaaaatagcatgaaaagaaccagcgagggaggtaggagaaaagcaggtgatgagtgtccgggaagccaggtacagtcagggcttcgaggagtagagagactggtcatctgtgtcaagtaagaggacagctgagaaattatgacatttagcaaagtgagtctctgataaccttgagaagagtaattgtggttgagtggtgggggtgagagcatgacaggcaggagtttaagaatgaataggaggagaaaaatggaagcatggagaatattttcaaggggaagtagacagacagttttctaaagataaaatcaacattgtctaaaacgtggatagtaaggatcaaatgtatccataagcagggaaacaaaaactaatgaggcatgtttacatctacaggagggtcaaaattggagaaaaaacaccttatgcttccagagaagggaagaaaacatgcattcatacatctgtagtgggagtgcacattccaaaaacatttttgaaaaagaatttggcaatacctatttaattttaaaatttgtaaactgttcacttcacccgtggatatctattctatacaaaaatgtgaaaaccacacatatatcaacaaagacatagattgggatcttcattacaacattgtttatagaaagagctcactagaaatgcttataatctatcctcattattcacagcttctatatttccaaattcaaccatgtgataaagtgtacctgtgagccccaaggtgataatcacagcacttttgccatcgttctcaggcatagtggcagaagattcgagttgtccaatgttggcattcccaactgcagcagaacaaagcactattctgctttctcatttcaactttcatgctgtgaacaactgtccttttctgttgttctatttggtgctccatttttttgcatgtttgtaacttacactggtgatctcactgttgaaagtgggtcccaggcatagtgctgaagtactgtatagtatcactaagggcaagaaggctgtgaacgccttatggagaaaatgcatctttgagataagctttgcttaggcacaactcatgggttgttggccatgagtccaatgtttatgaatcaacaatatatattcaataaggtgtccttaaaaagaaagacacataaaacaaggttatctattgatcatttgactaaaatgtttagactagaggttcaaaggaagctaacgttgagtctctcctagaagcaatggttcagtatccactagttgcacatgaactagtgttcatgatgactttatagaacaaagcaaccataaataacaggaatgaattgtctccctttgttgagaattgtgtgagtaaattaaagtatatcccaaggtgtgcaccatgtgatattacgagccctttaaagatcactactcaatcaaaggaacccaagtccttggagtcatttccttaaggtactgttgcatgagaaaactaaggtgcagaggaccataatatgatgtcactttttttttcttttggagatggagtgtcgctcttgtcgcccaggctggagtgcaatggcgcgatctcggtccgccacaacctctgccgtccaggttcaagtgattctcctgcctcagcctcctaagtagctgggattacaggcatgcaccaccatacccagctaattttgtaattttagtggagacggagtttctccatattggtcaggctggtctcgaactcctgacctcaggtgatccacccgcctcggcctcccaaagtgctgggattacaggcgtgagccactgcgcccagccaatgtgatgtcatttctaacctttgtcatctctctctgatttcatgtggttgcctgagcatgcatagagtgatgtccaccaagtcagcaatgtgggctctgggggtgggtgtgggtatctgtggagcaatgtgcttgcagtgcagagggcaggggcaattaaaagaaaacagcacagttgatggtatcatttatgtcggatgatgtttgtactatgaagaaatttgaaggaaaaagtcacagttagtcttctatgtactgacttgtagggatgaccatgttggaaaaagagcaagttgcaaaataatgtgtgcaatgtgattctattctagtaacaactctgcttattatatgtgtcttagaattagtgagaaaaaggtttctaaacatatcaagaggttgagagttttgtagaaaagtttgctttttaacgcttatttctttttcttttcttgctctctctatttttttttctgagatggaatttcactcttgttgcccaggctggagtgcaatggcccaatcttggctaactgcaacctctgcctcccaggttcaagtgattttcatgcctcagcctcccaagtatctgggtctacaggcatgcactaccacacctagctaattttgtattttttttcttttttagtagggatggggtttcaccatgttggccaggctggtcttgaactcctgacctcaggtgatccacccacctcggcctcccaaagtgctgggattacaggtgtgagccagtgcacccagcctttaatgcttatttatattggcttgtctcagtaagtccaataagtatgttttgttgaaatttgaaaaaaaatacaaataaaatatgaaaaaacatcaattagctaaatattattcagctaacaaagaaaggatatagccattttaatagctaattaattttgaaaatggcaccagcagatacaattttattataagattctgacttgttgtatgtaatgctttaaaattctttgtctattttttcttttaggaatcattaagagccatcagatatgaaatatctccagatagagagtatgcacttttttcatacaatgtggaacccgtgagtattatcctttactgcctacaaaataattgtttctttattctaatatctcattaagtatatttccttgactcttctatacttagtgatctttgaatccagaaatactttgtacatcctggaagtctcttttgcatatcatactgccacctaggagagaggaaaggtataaatatctgcttggcaggggaaaaaagtcacatactttagaggctctttcatagacttttcttaggaggatggtaagaacttgtctcttcatagacacaaatcttgcccttttgtgcaattatttttctggctgttttctcagtgaaataatagattttatcctaagaacaaaaagcaactgccaggttctccttaaactgaaataatatgttaattatctcctggtcattgtagtgttctagtgaagagctgaagctatcacttccactatttaaatgcctatttttagcacttcctgtatatatgagcctcccataaaatttcaccagaattttctgtaaaatctcactgtgtattagtagcagtgtaaaacttcctaggccaggatcttccttcttcttcttgttttttcatttgacatgctcgtatttcaaatttcattttggctctttaattttaaatagttggaaggtgaagtttatttgtataagtggagaggatgttcagtttacaagagataagcaactttagaaatgtatgttttaagaactttcctctctggcaaataagatatagagtctactactgcctccctggcatttctgagaccatttgaaatagagtttcctggtgcttctgtgaggtgtaatgactcctgcattttaattcaggtcagaatggctctgtggtgagtttgagagaatcttttctggcatgagacagtcaagctttttggtttatatccactgggaaagctggggtattggtttgtatgaagatgcaagttcaattctgaattcttaaactttcttttagaagttgattggacaactggattactggagatttcaactttattcttccaactgtagatttttttggactctgtttcagtcttccatttttctatttttaaatgtccattctataaaggttttcattttttccatccaaattctttgaaacaatggggcatctttgtctctttgattgggatcagttggtgaacttgacattctaaaaggcttgggactctgcattacctagacacagccttaaacttgcctctttcagcctcaggcacctggatgtgatgttcacgggtcatagaccatttcagcttccttcatcacccttgaaaaccaccagaaatacaatctccacacctgtataaaagaaaaatgttagcagatatttgaaagccttacatggatgtgttctggtttgccccaggaggcacagctaacacctgagtgagaaaagcctagaaagacaaattgatttcaggttatcctcctagagaatctttaatcatcggagcaccccgacagtgggatggaggtaatgagcattccgttcccagaagcctcaaaacaaagtgaggtattgttctccggaatgtgacagaggggttcccgcagccgtgtgatcggaagaggcgtgctctagtcagtggtgctgtggttctgtgcatgatacaattctccaccactttcttcggcttcccagcgctctgtttggaagagtgccctgggatcccattgaaccagaaaccattttgataaagatcattttgctaaagatgagtcttcaccatgtggagcactggctgtaaacaggaaccttgaaataaccctttctcactgggcagcatctgtcggtgtttggagtaagactcttcagtttgtcttctcaactgaaggaaaacctaggaagtttgaagtgtatttacagaactataaaaatgataaaattgaaaatgtaaaaagtctatagaaacagatattttaagttgaataaaataagtaatccttaatagttttcagcactgagcagttactgtatacatgactattcaagcaagtattctctgttcttctggaggaaaaattataagggaaattataacctataggttatgagtagtgtgtcttctctctgaactccttagcgctataccaagatacaatccaagttcttgaaattctatcaaatccacaaaatatgtaataaaaggattacatatgggattctgcatgagaatttggagttagatattaggaagatcttcctaactagataaactaaaatgtaagtaattttagaaaagggaggggtaaatttcaaaggaagagtctaggtctgtgattctggaataagtggaatagaccaggacttcctaatcagtatttagtatcagtaattgttattgctagtattgtattaatagtataatcaattaaaaatattatccattggtattctttaaaaacaattaaaggttccatattcaaatacatttgagaactctagttaaacagataagtttcttgaagttcctgatattctcatgttggttacatagtacttcccaagtgggtattacaacatgtgattccaatctaattataatgaaactagaatttgttatttggattcatgctcaacatattcttatgtgtgtatctcaaaggcagctagtgtaacttgtttatatgaaccaactcaacttttcattaaaaagactatcataaaattgttttagtgtaaaccaactgtccaattactagatatctgtcatttatttcagtatatgtttcatttgcaataaaattttggtatattgggttaccactgcactaaaaaaaaaaaaaaatcctactatcccacatttcgtcaggataattataatctcttcaatctctgcttctctttgttgcctgcccaaagatactggacttggaagtcaaataatcataggttcaagggctcattccgatgctcaccagctatgtttgcttgagtaacccactaaaccttatgcactgcatcttggagccatcttcctgggtgaccctgggcttctgtttctcagtggtgaagggcgacccaatgaatgtcagctctcctacacttccagggtatatgtgtttgagcacagagtagttccgtatgtatacccagggccagatttaaggctctatccaatttcattggaatggagttgatggatgcctacatgaaatcagctgtcttggcagtggctcaagtagaagtgagtaagagctttccagcacagcatgggtggtaagagaaatgaggaaacagatcattaaggagtttagacacaaatagtacagcaacatcctgagaataagagttgaaggaaagatgtttaagtttaatttttagaatatgcattgggtatctcttcttctcatttattcagactaattgcaatgttatatcatttcccagttgtttggcatagactaatttaatttgtccatttttatattgtcagatactcaaagacagggacaggtctttttatctcctatctgtccccacctcagaggacccagcacagggtgatctgcgtacatttagtactgagcaaatatatttgtggtgtgtgtatattctctccgaaccccttagcgctataccaagatacaatccaagttcttgaaattctatcaaatccacaaaatatgtaataaaaggaaaatacctcagttgtgaaatatcctaataacgttccatgtttattctagaaatgtgggatcatgctaattagcatgctttttcctactaaactcttctaatattactaaatgtatagcttggctagcatccttgaacatacacaagttagctcatcttaactatgccaaccctatgtttttttgagagctttaaaagtagcctttaaaaaggtgtttgaaatatcaattatcaagtaaatttgagaaacagcaaacccaattttccactttttcaagcctcagacacctataggttataagtagtgcatctggaatgttgaaaataataaacagtattgtgtttgtatttatgtggcaccagcattatagtttgcaatgtgtgcttatttacaccaccttattttatctcaaaagatcattcctgctccaaagagacaacatgtgctaaatgagttttattttattttatacataaaatttcataacatttctcagtgtacacttcctgaatattctcttgaaattaagttagacattggagaaatagcaattttttatttttaatttgaaaactgtattaactatactaataaagaaaaattgccttaaaacaaatgtatctaattagagcagccatgcttttttatattgagatatatttgacaaatatgaaacatttccaaatctctttggggagagggaaaaagaatgtaaaatgcattatctaagatcatttaaaaatattaatactttttcctactaaactattttaatattactaaatgtatagcttggctagcatccttgaacatacacaaattagctcatcttaactatgccaaccctatgtattattgagagcctaaaaagtagcctagtattaatatcttagatcatttaaaaatattaatttcaaagacctaagagaaaaatattcttccttgaagaatcatttctgaaagagtcactgaagatttgtgaggaatttcattgcaatatttaaaggagttagttgaaatgattgttcttagtcagatcattgccagtggaacatcattctggtccaaatgaaattctgtccaaaatctggtcagattttaagatttttttcctaaaatcccaatcacacagtcattcagtcagtaaaatgggttgatacactgatctgtttataaactgttcatataactgaaacacataaaccaatccgttttagttacttgccactgcatagcaaattatccccaaacatagcagcttaagacaaacaacatgtatcatcccagtttctgctggtcggaaatctgggctcaagttagcaggatccttgcactcagggtcttctataaagaagactgtggtcaaggtgacatccgggctgcagttgcatctgagagctcacctggggaggagtctgcttccaagctcagggcatgggtgttgacagggcccaaatgccatccttagagatgggttctgctcagtcctgagagaagatggtttgctgctgagcttttcatggcaggaattggaagcagttttcatatttgataaatttctactattttcctgccatcgtggtgagttgatagagcccattttgctctctaagggactgtgaaatttataattcatataaagcttgaagaacaccctgatgtggataatcctgatcaaacctgcttggtgaggtgaaccccaactatatcccagaatcttctatgcacccatctggtcgagttacctatttatctatatcttaattaattttaaaaaataacttgaggctttataaatgtaatataagggattgggctataaattattgaacccatattgtggactaaattataactgctggaaatcaattcaggtaattctgagtatatgagtttctttttttttcttttcttttttttttttttttttttttttttggtggtgtctcactctgttgcccaggctggagtgcagtggcgtgatctcgactcactgcaacctccccatcccaggttcaagagattctcctacctcagccttctgagtagctagcattacaggcacccgccaccacacatggctaattttttttttttttgagacagagtctcactctgtcacctaggctggagtgcagtggcacgatctcagctcactgcaacctccacctcccaggttcaagtgattcgcctccctcagcctcccaagtagctgggattatgggcacgcaccaccacacctggctaatttttgtatttttggtatagacagggtttcaccatgttggttaggctggtctcaaactccttacctcatttgatccacccgcctcggcctcccaaaatgctggggttacaggggtgagccaccacacctggccaattctgagtatatgagtttctttgttgcaagaaatatagctattgttataatatggttctgatgtttactgccatcccttcttcattacaagaagggatgaaatcttcgtccaggagtggctaagggaattgtgtttcttgattctcgtgctcttggactggttctttctgcactgtctacagagcctttcctgggcccacctctgggaaccagttgatccaagcgttttctgctggacgaaggccttgcacattctcatgtgtgggggctgctatcagaattgcagggagctctctgtctccctctgcagtggcctcagagggcaaactgaagagcagggcctgcgtgtgccatttctaccacacctgccgccctttctgcatcagcccagtagctgctgcagcagcaggaggcgagtctcaccttcagcacgttctccttctgagaaggcagtggatgaacagcctgtccaccacccactgagaccagaagctgccccttcactgcctggaagtgcatcctgcacccatcagcatcactccaagcccttttatcccgggatgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttaagtagaaggagcgtaacagtggctaggcatcactccataatctagctctccacctgagcaacacgtgcagagcttcaagaggctctgaattctttctggctgccagagataaccaattatacaaagaagaaaaatctgccaggtgcagtggctcatgcctgtaatcccagcactttgggaggccaaggtgggcagatcacctgaggtcaggagttcgagaccagcctggccaacatggcgaaaccccatctctactaaaaatacaaaaattagccaggcatggtggtgggcgcctataatcacagctactcaggagaccgagacaggagaatcgcttgaacccgggaggcagaggtggcagtgagctgagattgtgccactgcactaccgcctgggcaacaagagcaaaactccgtctcaaaataaaaaagaaaagaaaaagaaaaatcttatgttttcttactcttggaatgaagaaatatgcaagtacgaaaattcatgaggagattcggtaggtatctagctctgattaaatgatttattagaaataagaattagtgaaatcaaccactttttaagttacaaaatattacaatgatcagttttaacctcaccccctgccctgaatgaactaattgtttttcttagagccaggtaagggcctgccattggcaagcttgcaccttgagttagggttagagttgtcatgagtcaaatgccagccatgtcctcttctgccccccatgggggggcccaaagtgcaggagtgacagagaggaacagaggcagatgggcagcagggagatggactggcaggtacctgtgtcctcacaggtaattacgtgtcattccctctggatggtttctgaactgtgggaactcccccatgtgcattgatgggagaagagccaggcagagacacggtaaggagggcaagttatccatgtgaccttagggatacttggggcaaaagtaggctaacctccgtgcacaccctggaacaaaatctttaaaagagagagcacagaagagagagagagagcactttgcccggaatgagccccataatcagacaccacatctcccaaattagcagcacccttggtttctgggcaggctgagtttcccgcgcgtcggaggggataggatgtagcggtgaataacagtaagactccaaaatcaagtgggtatgtctgacgatctgcctctctctcccccttacacacacacacacacacacacacatgcacacatactctccctcccccttacacacacacacatactctccctcccccttatacacacacacatgcacacacacattaacacacacacacattcattgctcttagtatatttcctccctacctccttaactttgaccattgacaaatttttctctcttaagaagtcttgaggcagtgcactcgggcataactcccttccttgtgatacatccacgtctttgtgaatgatgaatggaacgttgctcacttgttagtaattccaacagacaaagacgtggcctgagactgcccctcacctgctctataatggcttcttgcagcctgctttcctccctccagcgctgccgttagagcctgaggggtccaagggagtcagtctgcccccgtgagtcttcatgtggtgtagatgatgtcagggtcagaaactgacattcaacacgagctgaggcccatggtcccaaaaatgtgtgtgagctgtagttgtccaaagacgtgagaggacaagaggcttgagtcagggaaggccgacggagaagaaagcctggaaggagaggaggatccggggtgaagaagagaggaatggggagaaccttcccggtgcgatcactgcagaggaacagaggccgccatgggaaacacctgcagcgagcatcagcgaggagctgaaagtgctcaggtatcaaaagaaggcagaagaaagagcagcaaaaaggagagaaaagtcaacataaaaatttaacacgggtcccttctgctgacagaagccttcccagtgcctattgcggccaccttcctaatgtgacctcagatccaaatttagaaacagcctctgttccctccgctcccagactgttttttctgcttgccctgcattcatttcttggaagttttttaagtatataagagcccaggttggccagggcaggggttagggaagcaaaggaactggaaacctgtgtccgctgaattgcagagcaggaataagggactctgcagaaaagagcatgacaaagagccgcggatacaagcgagggtagcaggagaaagagctaagaaggcagaggttagttgtttgatcgtgcacttggggaaggtggagggagaaggggccgtgaagagatggaacggactggcagaggagatttgtgtggggaaaaggagacagaggggacaggaagaaggggacagaagagtaaagagcctggaagggccagggaaccctgcctgccatggtcctcccccacttcctcccacacaccctgatgcaactgtgactgccctggcacctcagcagcttcagaacagggaaaggaggagaacacgggtttcacaggaggagaagcaaggaggacccagggagctggggtgccctgtgattctcaaccctgtccacatgatctgacctgggggatgagagcttattagatccaacttgagttgacaacaaagaacttctggagcctttcaggcccttttgaaacaggcagatcttctctgcagtcatgtctaatgcagcaaagaaaacaacagtgtcccctgcaggtgcagggacttctggcctgagacagcagaataatcgctcctggagtgggaaggttggcttgtgtattgtgcgcggccatcagcagcatctcatttcagactctctcatatccccggaatgtcccggggttaccgaaaaggccccattctccttccacctgccttctcctgctgctagaaaccaggatttttgactattgtccctgcatccccacatgtcacccagaggcagccttaggccccctgtcctgggccacccttggcataactggagtagacccgggtgcctaccacagcctccttttcctcaagggcagctgccctctcggtgccctgctcactgtgagcaaatacatatttaaagacatattctgctacttcccaaagggaccagccaccacctgcactcctcgtcctggtggaaacagtctgagtgcttgctttggtaatcaaaggtttcattgagtgcagatgtagtgatcctggcaaaaccctggaaacagaaagtcagctgaaggggtgtttctggagatgaggaattgtgctggttagccacgggcatgtcctgaggataattatttgtttacaacatttctgtgaacaaagaacatatagggacagaaataagttagtttccaagaatcttgtgatgggctccatttatctgacccattgggtttgtagaagaggacagaatgctgctttggttctcctccttggacagtggaactagagaacgggaagctgagatggccgagctgagtggacagaggagggaggaagcccctcacctcgcctgcttcccacagggtcccttcctcctcctcctgtttcctaagcttctcagctgggcttcagatgtcaaggtttcctggcttctgccacttcaccttctcatcttagctgccactggaccataagcatttcaggttgctcagatctctcccaccgcaaaataaagcaaagacaaaaaagttctctctctctcaacccatacccatgtcctcctctggttcttcccttcacagtcaaatgactaaagaaagaagcagctgcactcacctctctgtcccctccccactcactcttccgtgtgtctcccacagagtggaatgagtgctcagggctcagccacccagcccctggggaacagtatgagtgtcttccccatgttatacccccgggggaaggtatgagtgtcttccccatgttatccattaggagacgggctttgggagattgcaaggtttctgcagtgccagggatggagggctgtggttccaggtattcctctctgcaaacacctgctcttgatgggggctctgctgcccctgagcccactggtaactgtacttggcccccaccacacagcaaaactctcacccatcttaccagcagtcttctcgccctggaattcactggtgcctgttttaggctgcctgggctgccatggcaaaataccacagactgggcagcttaaacaacagacgtgtgtatctcagagttctggaggctggaagtacaaggtcaaggtgccagcaggtcggtttctggtgacggctcacctcttgtgtaattttgggtggacacaaacattcggtctatgtgccaatctcctcaggcctcctgtggcagaatttgaggccgctcacccctccctcttcctcagtccttggttccacaggccctggctgccctctggctgcctcctggccacttaggaggtcctcaggtgctcagacttgattggatttcccagtcccacccaaggtcatcttctcttctcttgcgcactcaccctgggcaacttaacctactacggcaactactgcatcggctgctgccacccaaaacgcgatacactgagtggtggcagaagcctccccaggaagcctgttagaaacactgactcgggacccagcccacaccctgatcagtcagaagcctcgcgtggaggagatctgcatatgattcgtgcgcacactgctgagacacatgaacctcaacaacaaggctcccgcatcacatctctgttctggacctctgactcgggtgtcagacctgtgtgctgctgtctccggggaacgtagagggccctcagacacagtgtgtgcaactgatctcatccgtttaatcccacgttggccccacgtcctgcctgcaacatcagcactttaggaaaaacaccattgtcccctccttaccaggaccctggctagagaccttctgtctccctggcccaggcagcatcgccatccccctgcctttgggatatgtcccttccacttccccattgccactgcccagttcagcccaccttacctgttatctaaaaaaccacctctgcctccagggcctctttgcctcagcctccccgccccacacttcttcaatctgtgctggccacgctgccttcagggtgacctttctcagtgccaatcaggtaactcattcccaatctgcacctcttccctaacccccttgctgtcccacctgctccttccctctcacctctgggcctttgcaggcgctgttccctctgctgggagcacctgcctcctccactgacctcacagttctcccacgcccttccagcctcttcagcagcaggccttggactccacaggagtgggctcccatacccgtgcacacccacggggaccacagcactgctgacggttttccgatttcctgcctatgagtccccgcactccaagggactttgagatgcttaaaggtggcttgggacatggctgatccacaatagagcctcgagaaatatccgacccattgcaaaatggaccgtcccccacccccatgcggtttcagggccgctcccaggctgtgagtgtttatgtgaaaggagtgtttgccacgtcgctcgggacgcccatcctggcaatgagcagctgcagcttccaggattttaccttcttaaatgcacttctgttaagctgtgcatgtaagaggtctgttctgttgaaatatttcccagagactttcatactaaggagggctttattgttataaatatttaaacctgctttgcagccagtcgctacgattactcagctcagaaagcatgcacaaagcctgcctctagtggacgatcctgtgctattcatcggcctctcattttaaatgtcttcctgatttcaatttaaaagcgtatctttatataacatatacaatttaactttttctttttaaaaatatgtatagctagtttttgttgtgcaattctatgagctttaagacctggatagacttttgtaaccatcaccacaaattgggatatggaacagccccatcaccccaaaaaactccccctgctctgcttccttcagggcaagccctccctccacccctagtccctggcagccacagacctgtctacagtcttgtagtttagccttttctagaaggtcatataaatggcatcaagcagtatataaagactagcttcaaagtggagaaaactttaggcctctaaggcattttaatgcccgcatagtcttcatctttagggtaattttgctctaaaaacgtttttgctgttttggtgaaatatgtaatactaggatagactatggaagatgtgcttactgagttcttaccctcaatgtcaaaaacccaacagactttcattactgcatcccctctgtacaggatcaaagtgcccacccttagaaagtctgatgagacagagaagaatgacttgcgaggatcaagaaagacaggctgagtgagcagtgtcctggcctgaagcctctgagcactgcggttgtccctcagcacccctggggagtggttaccagaacccccgtgggtaccaaactccacagaagctcaagcgccttaggtaaaatagtgtagtatttccctataacctacacacatccttccgtgtacttgaaatcatctctaggttacttgtagaatcaaatacaatgtaaatgctatgtaaaaagttgttctactgtattgcttaggaaataatgacaagaaaaaatctgcacatgttcagtacagatgcacccatccttttctttcttcccgaatctttttgatccttggtggttgaatttgtggatacagatctcacaatactcagggccgactgtaattctgaaggagggggctttggggcgggagcctacaggaagctggaggcagggcactggggacttgaaagtgaaaaagtcagtcatgagcatgggagaaaggagaggaaggcaggggaaggcactccagatgaaagaaccccctaagtgcaggcttgaggtgggatggcacagtgagggcaggagagggatgatagatggtccacctggagcacagtatatgcagtggaggggcaagcaggcaggccaaggtggggctgagtgtctggagttgaccctcgttgccaccgtcttggagggagctgaatggttccagagtagaggctgatgccacgtgaccaggtgaggtgtcttgttgagaccgggcacagtgattcatgcccataatctcagcactttaggaggctgaggcaggaggattatttgaccttaaaaaaaattgttctgttgaacttattgccttgagacagaggagctttcccaggatggccatttcctacctgccggcctcagctcccatcgcctgcccttatgcccactaaacgcgcttgtccaatctcatggttaaggagccacgggttatggttttggccccatagatgagggagaaatttgctggagggcctgtgggagtctttggctctcttgcaagaggaatacagagttggcctttctcttccccactgtccttgccttcatgaagctgtgctgcccaggctgtcacggtgggacacggagcccagcccctgatggcaccatccatgtgttgctctcgatccctgttctctagattagctaagccagaaaaattagcctgatttgtctaagcgtctgcccatcgggttttcccttacttgccactaaacgagtcctgagtggctttgctcgtgctgtttcctccacctggatctccttctctaccttgtccagctggtgatctcttccatccagaaatttaacttcagtctgagtgagcacctccccagataccccaggcatcaaacacaatcattgcttacagggctgtgtccctcatcaaggagctgtgagcccctcatgagcaggaactgctccttacttctctttgcacctggaaggtcataaatgatcagcaaatattcgttggataaatgaaagaacaaatgaattccatagaaacaagcaagggaaaaatgggaaatgatttcatcaattcttgctaagtcacaggctttcttccttcacaaaaggatgcgcaagagagttgaggatcttgagtctgacaagcagagaggtgcttcttgttgtatttatcaaagcttcgctattaatccctgcagggtcagtgaacgcatgtcagctctgcactcagtcctgctgcacttcggtggactctcaccagaggtcaaaggctatcagctcactccttttgtctgaccaatgccttgggtggctgctctcatcctgacttgagctaaattgggtgatctgcctggagacttagaaccttattcctccccccaaccattcccactgcctttgccttgatctggactcttctctcctcttgccaggaccaatgctgccgctttccacctgtccttccctcctgtgcatcccacacagcctgcagctaagcatggttctgagcaagacacagcttcatgcaaaatattgtacctctgcttgaagacccaatgtgaacattgcccattgatttttgtttctcgatccccaacttcccatgccccaaaatagcatcctgggaccatagaaatggaattgagctttctaaaatgattctgcccatctcccactttacagatgaagaaagtgaagtccaggaagttgacattgcctcattcaaaatcatgtgactcattagcagtaagtcaagcctgtagcccagcttgtcaccagggctgttttcttcattacatcaccatgtctcttcctcttcactgcctgcgtgactatgtctcggcagtcaatggatacagcacagcattgccagcttgccatgtacaagggggacctgtttcagatattccatggagaccctggctggaggattgcaggagagtcccaggaggcaggactgccaatggcaccaggcttcgcagccatgcacctgcagccctcaggcagcactgtccattgtcatacgagtgtggcaggtgtgaggcatcgcatctgctcaccccggggataatgcacagcagctacaggcagatttcgggccagagagcaaccgagtgagccttgcagcctctgctgccagcacaggcttgttccttcaacactggtggagagagacacgctgtcatcaggcccaagaaatactgccttccccatcctatccctggtcactgggtgcccgcagagtgtcccagaggagggagggagggaccctccactggttcaaatggcctgttctcagagatgcagcaatggaccctcgtgaatactgaactgataatcatgggaaggagactggctctcctggattccctcatgattcctctgagtgacaatgtgatgttggccgactgtgtcttcttcagaatatcatatacacttgaggtctccaggagcctccaattacattattttcctggctcatacagtgacaagtaattcttatcctggattcctcgttactgagacttttcttgccttttttgttagcttatgatttattctaggacttcctccaacaggttatacttaactgtctacctcagtctctggaagttttaaaaatgttcagctaaataaaagaagtagattctccctggaaaccaaatacctatgggcctcactgaattaataatttatttatttctaaaaaaaggttttattaattaagtcaaaatttcattgtaattttaaaataatcttgtggtctttctccatgtgtctgaagcttgtaatcactcttattgtcctgtgaattctgatatgcagttacctgctagcttagtgggtaaacattttctctattaatgagcaggaggcttattaaactgtgacagtttagactattctttcaaggccattgatcagtgaaaaaacagaatctggatgctaaaaactgtgcccatgtgaattaatttacccccatctttccctgagccatcacctgagtatttgttcctaggtttgttggctgcatttgcttaatttttatcttgtgatttcattgagaggtgtagttgagtgggtgtacttacagcttctgttcctgtttgaaatatcatttggaaacctgatcacaccctgcacaagtatgcttgtgaggcatactaattcaataccatttgagcaggtgcctcctaacgctgccctcctcaacctttctcagcatgaatgtacgctttttcatgtgctgattttaacataatctttggttcacagtaacagagaattttgtttgaaaaaattcagggattgaagggatattgacatgtacctagtcaccatctatcactccatctcaggagcaagtgttccttgctctcgtgactttgtcctggtgacacagaattcatccttgtagaccacttactttcttcccaggctgggcagttctggcttttgcaaagttcttcatcagctaatttaagtctgctttttaaaacttcccatctgctgaatctcattccaccttttatgcggcagtgtccactgcgctttctgcagtgacggaaatggtctacagttgcactggccaagatggtggcattacccacacgtggctcttgagcatggggaatgtggctggtctgacaaaggaactcaatttgtagttttctttaattgtaatcaacttaaaattacataggccatatgtagctagtggctaccctattgggcagtacagttctaaagcaatgctgaatatttaacgaccttcagatatttgcagacagctctcctatccacatctttagccttctttggcccagccgaacaagtgtttcagatcatgcctctggactcctttctgtctccggacttcgtaacagcatggtcacccttcattcacctcattagatatctgaagtaatgacggaagtaatcgattgagtaaattagtgaatgaatatgtgattttaattcttcacataaacctcatcctagctaatcctcttgtcttctttataagctgaggtttttggttttatgactgtggatgggaagaggggatgcagaggataggaccaagcaaggtcgtattttctttaataaccacatccccacctgtttcccagttgggaaaaacacaaaccgatttgctctcgggtaccactagtttattataataagatgtacaaagcaaggcagatgaccctgcagtgatagcagggatggtcacttgtttggcagaatggcccaggggagcatctctagccgtttcaatcccaagaaagcaccttggggtagagatgatgcaaaaccaacctgtacatcgaaatctattttttattattcaaaaattacaacctggtcttctgaaacttatttttttatgcttttacatctcctacagccttacacataatttctagtgtctttttagaacctctcagtattgtaacatttaatgcgttctcagcagcgggtaggtccgtgttatgtttgcatttgaagtagaagagctaagctaaaaaatatgcctttgtttactaataaggtagatactatttttttgttgctgttgtttgatatggagtttaactcttgttgcccaggctggagtgcaatggctcaatcgtggctcactgaaacctccacctcccaggttcaaacaattctcctgcctcagcctctcgagtagctgggattacaggcatgtgccaccacacccggctaattttgtatgtttagtagagacggggtttctccatgttggtcaggctggtctcgaactcccgacctcaggtgatccgctcaccttggcctcccaaagtgctgaaattacaggcatgagccaccacgcccagccgatactattttttactcaaaccaaaaaatatattctgcgagtaagtgatccactgtatctcagcccataatgatggcctcgacaaggaatgagatggccacagtcagtgtcacccactggaccacagtgatgggcgtggtgaaccaagaagtgtggacatggcactgtgctgggttacagtagtgagggaagcaagcttagactagggagcaaaatcaacctgtgatgagttgtgccttcctttaagcatcttggcatttgttgttggcattgaggttatagaccggtggtgcaaagacgaggccacaagggccactggagaagagggaggagagcccaatggctagaatctggaaggacagccacacgtttccccctctgattctttaattcacccacaacatatgcccatggtgagttcttcaattgcaggcttttggtacaggaaatgagctcttgctagagatttaagacggagtcaaatcatgggtctagccctaatgatgagtaactgatggtgaggatgagagttgtgacagtgctggtggtcatgaggaggatgaggatgatgaagaagaaaacagcagtaacaaggacgatgatgaaaacctgctaattatggtgctgatgccagggataattatggtagtgataatgatcatgatcccaggaggacttactgtcattatttctcagtggcttttctttgggtagagagtgagataattaaagtctggaaggagacaggaacagggggcgtgcagttcctcagatccatgggtcccgcccagctgcatgctgggagtgaaactatcaagattaagagctatgctgtttcagcagcatttccactgtctaaatataaacagcctcaggccctgatccagcagaggagaccacagctgccaaatgcatcgccagctgcaggccctggctgggtttctttaggggaaaaggccatcccaccatggacaggttccaaaaggcatgagcctgcgaatagaatttgaggttcaaggaatgctagactgtgcgtctgtgttcagggtcacagagcgagtctgaagggagcaggatgaggacatgggtgccctgcctccagggcctgtgctctctgctggtacagacaagggcctggtgagatggtagaacaggggcggctactgcagtggtgccacctgcgtaggaagacgggaatctagtggggatgggcaggggccaggctccctttgctttcgcaggcacccagctccagtggcccctcagtcccagctacagatggactttgagatctgatgacaggatctgctgttatcccacctctggatcaacggcgccatcatcggtgccccagctagccagcagatgtgggccagagtaaggcttgactggtccacatgtcctttctggcttaagacactgcttatcttgactcagggagagaaggaaatggaagaagaagaagaaagaagatgcatttaaaacatattaccaaactaatgccatgaacacatgaaatgtcagccttttgattccctcctgccaatacgcatccgtttatccagtgctgacttactcagccctgaacatgcaccaggcgctctcgcaggcacagggaatactgtggtggacagagccggggaagcccctgcgctcgtggatcttacatcctgctggaaagaccgtgcataaatagatgtgtttatcatgtgtcaggcaggacacgtgctccacaggaaagtgacgtaaggtaaaggacagggagcaaaggggagtgtctgggggaggacggcagggacggcagggacggcatggaagcagtggcccagcagacgcaggacaaggtcctgtgatccgaggaggggtctcagggtggagggacagggagcaggccagcgtggctacagtgcatgatgtccaggatgagcaaacggagtgatgtttgaacatgtcatccgggaaaactacacacaggggcaggctcacagccactttttccccagctgatcttgcttcctctgttaccaaaccaccctcaatacagcctcgcaaactgagcaacagaggagggggaacacaactaataccccatttggcaggctggctgaaggctgttgaagaaacagcagaaacacctggtaatccttgcaggcgtcacccaggctgcgggccggagctgtcatgggacaagcaggaggctggaatggagctgggatgggaaggaacacaggccatcagcttcccaggccccacgttaattgtgtaatatcatcacagcagggtaggatgccctgtgagggcacctaacaggtgttcatcacattcatcagcattgccctaccaacgaccgtatttacatcaggcataaatgcagtttaccgcactctgtgagaactggggattaatagctccggtccagctagattctgatttccttggtaggaggaggcagaacagcacacatcttgactgaataatcgtgcattttgcatggttaataattctgagagcaggaaagctaccttcctaggatcacagagagcttactttcttttctacgaatctttgaaaaaccaaacagatgggattttaccttaagagttagattgcactcttacactgtgctgttcaaattatgaattggcctcacttggatgttggactattgattatcaactctggcaagctctttattcagaatcttaggacatgcacattaaaagaaaaaatcctctctttgacctggttgccaccaatgtgtatctacataggatgaaaaaatgcatcacgtactcagaagaacgggctgcagccccggagccccagtccttctgccagctctggagcagggggagctcctggctgcacctgaggtgtcagtctccaagaacctgagccctttccacacgcatggctctgttctaggcactcgggggagctcaaacagaaagagagtaaacctgctgctgttcagtcagagacccaagtcatactcacaaatgatcaagctagtgaactggatggcattttcacagctagatcttgtactgcaattatagattgtcaccataaagcttttgagagcaatttaatagttaataacatcctaattctatgatgtgagtaatctgtgctctgagaacggcctacatataggcagaagaaccatgaggagctctcaaagaaaatgtgccatatattcaggcacctggggagtggttgtagaaagtgtgaccttccaaggcaattgattttggttgttctttaaaggatcactctagcagtccggtcattcttatgggtcctctggtctagatgcccctcatggaggatcttctaatcttgcattattagaaatggcagctaagtggattatggatggaaactttcatgttgtaaaaacacaccaccagaagtcaaccattcttattttgcccacgtattaatgctatttccaaaactgcccgacagctcacgggtgtaggggtttaggggtctatattccttgttagactcaagctccttgaaggtagggaatgtgtcttactcattactgtatcctcagtttcttgccccattgtgcaagctaaataaacaatgaatgaatcaatgaatcaatgatgaataaaaggaaattagttaaattccccttagatagcaataattgtccttctcaccccaggttatctacagccagataccatttggattattgaattcctaggatgttccttgcctctctgattgtttgccatctaatcatatccactcttatgtttttatttaacttcttagtatacatacctgattcccacctttaagtatcctaaaggaacacaatgccttatcttgctttccctccgcccttggcacacaccacctaccacaacgttgaacttacagtaaacgatcaaggacaagtttcggactaatgcatttggatggaatggcttctgtggctttcaaacagaattctagatctgacctagaccagacccagatcctgcctggatgtcaggacttccctgtctctagagaggcagcatgaacagagacacaatgccgggcggattgttctgacctggctcccagacccaggccaggggccagggtgtgtgtataagggcatttgtattctgatggcctttgtgggttttttaaaccccaattgtatcattgattttttttttggcattgacgttaagattttcattcaatggtgatggattttaaaattgccctgccatgtggggtgttactaaagctcatgtggatgaaggctgttgaacgcctgtgtctgtgctcacactggctgctttgctttcctttcctgcctgacacgtcctctccatcttccccttctccgttgccatcttcctgcccttgtctcctgccagcttcctccttttctgcactcagccttaccctttcttccccttatgcttcctttctgggactcccaaacccaactgtgctttagagaaagagtcctggactcaacgccagggaaatgcatgcccgtgttcctgccttgctgccttctactctgaccttgagaaggttatgaactcttgggcttccattttgccatctctcaagccagtgagttagaccatggatgaaagaccgcccatcctaggattataaactgggtaagatttgcatcaatgtgagtcttcacactgatgctggctccaggtttcctttctccactgtgagctgagttaaaaactctctattaggaggcatttcacataccattgtcgaggaggtgggaaataacaattccattcatttgccaagtagaaaagcccttgccttcttggttcattcagcagagggaaaagtaagctaggcggaggcaggaatggcctttatttgcaaaggaggctgtgcctcactgttcttcaacaggatgcctaatgagttagaatttgagtagcatggctgggtgcagtggctcacgcctgtaatcccagtactttaggaggctgaggcgggcagatcacaaggtcaggagtttgagaccagcctggccaacatggtgaaaccctgtttctactaaaaatacaaaaaaattagccaggcatggtggcaggcacctataatcccagctactcaggaggctgaggcaggagaatcgcttgaacccaggaggcagaggttacagtgagccaagatgtgccgctacactcctgcctgggtgacagagcgagacgccatctcaaaaaaagaaaggttatgcctcacaggttctgacattcagtaggatttgcactttggtgcatttttctttgtacataaaaccctcatctcacttttagaacagtgcagtacttaactttttccaggattaggtattcatttcagtcatgaaaaagaaaagggcatttgacccaaattacaaaaactattgaagtaaaactgccctattttttccttcatgctttcattgcaaaatgcagtgactgtctgctgctggatgagtgtgtatttgggggctctgagggatggagaaggagaggcacgactcgcaagtgccaggaattcacattccgctgacgcgggaacacgggcagtgtatagacattgtacagacattgtaaagacattagagcacaattttgagaaaacgtgaaaggatttccacaagtctttatgtcctctgtatattaaggtgttaagacaatggatagcaagagaaagatgggattttgtggcagaaacttccaaaaaaaaaagttgacatggagcaggtcctcaaagcaggaggcctcagagtactttgtagtttaagtaggagggaggactcgggtatctggagatgggaatggaattaccagaggagaggagcattgaagaaatggcgtcaacactgaagaatgtgctgctttataagaataatgagcccttaaatgccagtctgaatcttagcttgacaaatgaggcgaatctgaacacctttgggataataatagcgccttgctctatttgagataaaatccatttcttctgacttctgaaaggaattattgtattggtccatttgttttattttaggaaattttaaaatatgaggtagaaaagtataaagtattctccaagttattagctaataattggctgatgtcacccaggtggttatataataaactgtctcagtatcattaaattctagaagtccagaagaagaagtcaaggacttcttagtattttgaggcagagggaagaactacaaaaaaacctcagggcaggaaaattggacctgttgcaggccctgaaagctggtgtgatttgagtacagtgagagagagacacagagacagagagggagagaagacagagagagagagggtggggagacagagaaggagagaagacagaggggagacagagagagacagtgggggccagtaggggaatggaagcacaattgtgggttggtgtctcctggctcaatgcctaatgagttagaatttgagtagcatggctgggcaccgtggctcatgcctgtaatcccagcactttgggaggccgaggcaggcagatcacagggtcaggagatcgagaccatcctggctaacacagtgaaaccccgtctctactaaaaaaagaaaaaaatacaaaaagttagccaggcgtggtggcaggcacctgtagtcccagctactcaggaggctgaggcaggagaattgcttgaatccaggaggcagaggttgcagtgagccaagatcgtgccactgcactccagcccgggagacagagtgagactccataaaaaaaaaaaaattgagtagtatattactttgctagggctgtcgtaacaaagtgctacagactgggcgtcttcaacaatgaaaatgtattgtctcacggttctggaggccagaagtcagagatcgaggtgtctgcagggtgggctcctgctgaggctgtgagggagtgctggctccaggcctccttcctgcatctggtggttttctggcaatctttggtgttcccaggtgcaccaatgcatctccagcctctgccttcgtcttcacatggtgctctccttgtgtgcatgtctgtctctgtgtccacattttccctgtttacaccgacaccagtcatttggataaggatcttttttaatgacctcattttaacttgatcacccctgcaaaggctccacctcccaataaagtccctttctaagtcctgaggataacgactccaacatgtcttttctaggagacacaattcaacacatagaaaacagttaagaaaaaaaagagaaaatttggtaattgtcttctgtacagacttctattaaaacaatgaaatgtttatttaccaaaatcaggaccaagttacaggccagtattaatatatgaaactgcttgcgtttcacatgtacacttaaatttccagtcctgattttcataccaagaaacatggccaagtcatcacttcataaaggaaaaccgttttggaaggtaaaaaagacaattactgtttgaaacagtctaacattgaactttagatgtaaactatgccgagcaaacattttttccaggtaacgttatttgttgcagacagcctttggccattgtgtagatcccaaatgtggtgaaatgggagctcccagatcattgcccagtttccagctgccatcccgagtttgttggtgtcactgattccaagaacaaaacactggtgcatgaaattaacaaccttataaatagatgacagcacgtctgttagacaaaaggctgcagttatcccctagaaacaatcaaacacaattccagtaaaagtcttgccaaatacctctttgtaattcaaggaacctaacaacagacaatatgcagtgcctccttgtttatgttctggaactcagcgctgctgcagtgtaactgagaacaggctagtacaacccacaggcatcttgaagtgtgcaaggaggctcagagaggtttatagcattgttgttttgttttgtttttcatggttctttatgtcattgtttgttttataaagtgttatttatagtatgttcatccttagggacttttccttgaaaccaccacctttaatgctgatgattggtgttcccatggaccttgggttaagggggccaaatggtatagatgccctggggagagcttgctattggcctttgggagagaccctgcagcagtaggtttcagctctcccagtggcagagctgggtgataactgcactttcttctaagggcgatacattttgggaatgtgcgtggtgtgagttttctgccagcatctttatagagcaatgtgtacttgcaaataaatacaaccaaagtcaacaaaagagcatattgatgctttggtagagaactcagcagtctcccctctctgtagcgtaaaatccagggaaaacaaaggccccacaatggggacagatggccccgcataggtctaaggactgccattccgttttaaagttataaagtactctcacactgtttacctcttttatttcacaaaaccaccgcattaagtggacagggtagaagatattatcctcactttttatatggagaaaacgtggctcaggtgacgaggtgaatatttgtgggtaaggcaagaactttctttctttctcagtcagttctctctactcaagtggacttctttttattattattattattattattattatcattatactttaagttctagggtacatgtgcacaacgtgcaggtttgttacatatgtatacatgttacatatgtatacatgttggtgtgctgcacccattaactcgtcatttacattaggtatatctcctaatgctatccctcccccagccccccaccccatgacaggccctggtgtgtgatgttccccaccctgtgtccaagtgttctcattgttcaattcccacctatgactgagaacatgcagtgtttgattttctgttcttgcgatagtttgctcagaatgatggtttccagcttcatctatgtcccttctaagctgaccccactccttcctttcatggtaggcacacatgcaccgagtaaaatggctgaatctgggctccaaaatgttctcttcagtcccgcatgttttggcaaactttcctctctgctgtggcacttcaatcccgctcttctccataaggtctatccttttcttcataaaactttctcatggatggctccagtcccaaataaagctatcctcctgctcctggcttactccaatttcccagctcttttgggaaatgtaaactttatggtgtcattattccttttatgtaacttccttttttcttttctgagatggagtctcactctgttgaccaggctggagtacagtggcacaatctcagctcactgcaacctctgcctcctgggttcaagcgattctcctgactcagcctcctgagtagctgggattacaggcacttgccaccgtgcccggctaatttttcgtattttttgtagacatggggtttcaccatgttggccaggctggtctcgaactcctgacctcaggtgatccacctgccttggcctccgaaagagctgggattacaggcgtgagccaccatgcccggcccttttatgtaatctcttatcctgtcccaaagacaattttataaaataataataagtagcacttttgggtgattaataggtgccaggcaccatgtcaaaaactttctgtccagtatctcctttaatcttcacaagaaacctattgtggtaactcttacaccattttatagatgatgaaaccaaggctaaaggaaatatgatgaaatgtccagggtcactcggctgggaatttgggaagccaagttggaaactcagatctactaattttcaaagcttgcacttattttaaagtaatggcatatttggtttgttgtcatagtttaatcatgaactgtttcaagtgtacagaaaagtacagatggcattacttaaaaccacttgcagccaggcgcagtggctcatgcctgtaatcccagcactttgggaggctgaggcaggtggatcacctgaggtcaggagtttgagaccagcctgaccaacatggagaaaccccatctctactaaaaatacaaaatttgccaggcgtggtggtacatgcctgtaatcccagctacttgggaggctgaggcaggagaatcgcttgaaccctggaggcggaggttgcggtgagccattggactccagcctgggcaacaagagcgaaactccatctcaagaaacaaaaacaaaaacaaaaaaccactcacatccagaatgctcaaatttaacaagtgtgatctgtcttgttgaatgcgtccagggtcttgaaggtgtgtatgtatgctgatgcacttggatgacctgttgtaaagtatgtcaattaggtcaaattagttgatattttgttccagtcttctatttaattacttttgctgtgaattactgtgtaagaagtattgaaatctctcattgtatttggagatttgtctagttctcttttcaaatctgtcacgttttgcttagtaaatattgaagctctcacagtaagcacatatacatttaggattttcttgtcttatcattgaattgaccttttcatcattatgaaatgtccctggtagtattcctttgtctctgttaatattctgtgttcttcagtccatttgtttgataataaaccattgcagctttcttttgattcatatttgcctggtagaactttttctatccttttacttctaacctcttcatatgtttacatttaaagtatgtttcttataaataacatgtagttaggtcttgctttttttttctttcagtgagacaatctctatcttttaaaaagaatatttagagaacagattagcaaattatggcccctgagcctaatttatcttagtgcctatttttgtaaataaagatttattggaaaacatccatgagcatttgttaggtattgtccaaggctgtttttgtacttccaaagtagttgcaatacagaccgtatggcttgaaaaaccaaaagcatttattatatgtccctttatggaaaatatgtgctgactcctattttaaatgttacatttgatgtaattgtcagcatgatttaattgaaatctaccatttgctattaggttggtgcaaaagtaattgtggttcttgccagtaaaagtaatacttgtttctttatgcttctctcttctgatttttggttcaatttttcctgtcctcttttggctacttgagtttcttattattccaatttattttcactgttggattaacaagctctttgttttactttttaatggttgatctatgtttacaatgggcatttttaagttatcacagtttatctttgattgatggaccacttttggtatatcgtgtaaaagcctacagcagtattcttccatcatttcaccataccatcctttctgatattttgttgttcatttcatttctacatatgtttaaatcccataatacattgttattatttgtagtttagaaaatcaactgtctttaagaaaaaaaacagctttatatttatctatttcttaattcttgtttgtttttgttttgttttgagatggagtctcgttctgttgcccaggctagagtgcaatggcacgatcttgtctcactgcaacctctgcctcccaggttcaggtgagtctcccgcctcagcctcccatttctcgagtagctgggattataggcacccaccatcatgcctggctaattttttgtgtgtgtgtttttgtagagacagggtttcaccatgttgaccagactggtctcgaactcctgacctcaggtgatctgtctgcctcggcctcccaaagttttgggattagaggtgtgagccagcatgcctggcctatttcttaattcttaatcctttttttttttttttgagacagggtcttactctgtcacccagcctggagtgcagtggtgcgatctctattcactgcaacctctgcctcccatcttaattcttttttatagaaacgaatttcctctggctttattttctttctgtctgaagaatttatttaacattgtaatgctggtctactggcaatgaattctctcaacttttgtttatctgaagaattatttcgctttcattttttaaagtttttttgctacataaagaatttcaggtggacattatttttctttcagtacttaactatatcattccttgtcttctggctagcttagtttctgaggggaactctattaccattctcatctttttttcctttgtgtatatgtttcttttctctcttgactcattcaagattttatctttatctttgattttcagcagtttgaatacaatgtgcatagatgtcattctctttgtatgtaatttgtttagagtttgtgaactttgcacatctgtttttggtagtcttccattcagccatgatttcttcatgtgtttcttctgtcccatcctctcttgtttttccttcggggtctactcttacatggatattcggccattttaatcattccaggctggctgtgtgcggtggttcatgcctgtaatcccagcactttgggaggccgaagtgggcagatcacctgaggtcaggagttcgagaccagcctggccaatgtggtgaaaccccatctctactaaaaatacaacaaaaattagccgagctaataatcccagctactcgggaggctgaggcaggagaattgcttgaaaccaggaggtggaggttgcaatgagccaagattgtgccactggactccagcctgggtgacgagagtgaaactctgtctcaaaaaaaaaaaaaaaaaaaaaaaaaaattatttcaggctctggactctctgttcttcttttatttacttatttactttttcttcttttctcataaatataatgttaagaagtagaagtcagacataaaagaataaaactatgatggttccatatctgcaaagtcaaaaaatgcccaactaatctatgaaaataaaagtcaggttcggatgtagggttagaatgtaatgattgataggtgcacgtgggatttcttagtgtctgataaagttctgtttcttgatttgcatggttgttagaccaggtgggttcactgcaaaacttcatggaactgtacacatgatttgtgtactttttctggacatgttattcttttacttaaaagtttattttaaaaatcaaaaatagctttccgtgtgtttttcttctaaaagtcatacattttgtttgggtccataatcttttcagaatgtatttttatttatactctggagaaggtaagtttatttttctcctacaataatagtcaactcttcatcatgaatgttgcatcatttcctggtagtttttatcataatcttggccatgtatgcacgatccttttctcgtctttctcttctgttctatttatctatccttacacaataccacacattagacattctatagctttatgacaaatctttgcacctgatatggtcagtcccttctaattctcttctttaaaaattgccttggctattatttgccttttactcttacatgtaaatcaggaaacagcttttaaattttattaaaaatcctattgaaatgatattgaattgagatactaagttggagagaattgactactttatgatgttgaattatcccatcctggaatatgctagataatataagcacaaagacttcttttaagtcttctaataaaatgttataatattcatcatagatgtcttaaatataatttagaataattacttctgcataattttaaaatagggtaaattagtgcttctttttaatcacacactttgcattgagtgttaccagtgaaaggaaatgctaaagactcattagtaggaatcttgtatatagtgaagttaccattttcttgctaagttcaaatggttggattctcttggatagtctatatggacatttgtaaacaatgacggttttgtttctccccgtccttgcctatctcttttgtttgtttgttttgtgtcttcctacactggctactcttttccatccaatgttagcccagaaaccatgacagcatgcactttagtcttcctcttaatttaaaatgaatatttccatattttcatgcctaagtgtgttttctgtatgctttggtatctcttttttttttttgagaagattaatatagatctcttctatcccttgttttaattttcatattttgaattataaatatgcactgtgttttcaaagaatttatttttctttgcatatagaggtgatcgtattgttcctttttgtttaatctactactataatgatttacctaaatgaaatgtccaatattaaaccaaccttgattatattcctaaaatacaccttatttaaatatgttattcttttttaaatatacattgacagatgtactttgagggtcctcatctttatttgtacatttttagtcagttttacgagcaagagggtatctgttccatctgagcttgatcctctgatgattcattaattccttttaaactactgtttcacttcctttaatggttatacttctattcaggtatatttcttcctgagtcaattctaagatttgtttagaaaattaccaattacatttaaatgttcaaaattatttaataaagttttgtatattttcatattatatttttctactaattacattttcattttctgtccttatagtgtttgtcccttttctgttttgatcttgatcaatttttatataattttgcatgttagtactattctcaaagacctatagtttggttttcattttctctttttatctttgcttaatctctcattagtacctactcttattgattgattccttctttctgctatctttgcatttaatctatttttaaatttttaagataaaatatggcacatttattttcagttttctatcctttctatgaaataatgggtacaaatttttctctattattttagctggatctgtgagtcttgatacggagtgttcattacattcaatgctaaatatttcatattttgcattataattttttactcatgtgttattttgtttccgaatatatgctttatttacccttttcacaaaaagttgttgattataataaattaggaattttcttaatttattacaatacaatcaagagtttactcagtttgagatgaaatttctgtatatttgagactttgtatttgatcaattttcatgacaaggattaatttataaccattgaaagaggacccttcaattggccactggcttattagttatattgttgcaatattctctatccttactagatgttagtctctatgacctatcagtttttgagagcaatgtattaaacatcttataattctatacacttttgccttatgtattatgaggccatgttgctaaatgcctacaagttcaggattgtaatcacttcctgatcaattatttctttttatcattaactctccgtattcctagcaatgaaatttgtgtgtctttttgtttccatttctattttctcaaagttatatttgtctgctgggagtataattgcactagtttttgttttccttttggttatttgcctggaatgtgtttacctaacccttactttacacctttcttggcccttatgatttaattatgtccttcctgaattgcatatgtttttaaacatctaacttaaaggaatttaacctgcctataattagtatgattacagttgaataacaggtttgaactgtgcaagtccactgataagtgaattttttacaatattttagaataatttttggacacttatgacaatttgagaaaactcacagatgaactgagtagcctagaaatatcaaaacaattaagaaaagttagatggtcataaatgcataatatgtagatactagtcttttttgttattttcttctataaaatatacacaaattataaaaagttaaaattgatcaaaacttttatacacacacatacttatagactgtacatggcagcattcacagtccagaaaaatgtacataaatgtaaagatacagcattcaaccacaactgcgtaagattaactgtggtgcatactgtactgttgtaataattttgtagccacctgctgctgctattatggtgagctaagtgtggtagattgcaagtagctgcatgaaatgccacgcgatgccaatcatctccacatgagcagctcatttctccagtaaactgtggatcacaggaaaaagtgatctctcacgtatttttcctcatgggtagtgcaatacagtaaaccttaaataaaactatgggacacatatgaagtgccactagtaatgctgggagtgttcccatgaagcagagaaagttaggacattgcaagaaaaagttgagccgggcgcggtggctcacacctataatcccagcactttgggaggccgaggcaggcggatcacgaggttaggagattgagaccatcctggctaacacgctgaaaccccccgtctctactaaaaatacaaaaaattagctgggcatggcggcgggcgcctgtagtcgcagctactcaggaggctgaggcaggagaatggcgtgaacccaggaggccagagcttgcagtgagccgagatcgcgccactgcactccagcctgggcgacagagcaagactctgtctcaaaaaaaaaaaaaaaaaaaaaaaaaaaggaaagaaaaagttgaattgcttgatgggtactatagagtgaatggttacccaccatgttagacagacgattcatcttgtaaacagaaaacatgaacttattatagtcctgtaaatgtattttcttttccttatgatgtttataacattttcttttctctagcttgctttattgcaagaatacagcatataatacctataatgtgctaaatatgtgttaattgactatgttattagtaaagctattagtagttaagttttggaggagccaaaatcatacatgtatttttaactacacgggaagttggcatctctaatctttgtgttgttcaagggtcaactgtactggtaaacttgaactattcctaaaataatatttagttttttcttttttttttctttttttttttgagacagagtctcgctctgtcacccaggctggagtgcagtggcacgatctcagctcactgcaagctccgcctcccaggttcaagcaattctcctgcctcagcctcccaagtagctgggattacaggcatgtgccaccacacctggctaattttttgtatttttaatagagatggggtttccctgtgttagccaggatggtcttgatctcctgacctcgtgatccgccccctcggcctcccaaagtgccaggattacaggcgtgagccactgtgccccacctagttttttctaaataccatgcttgcattttttaggagtgatcatatatatatatatatatatattttgagatggaatctcgctctgttacccaggctggagtgcagtggcgcaatctcagctcactgcaacctctgcctcccaggttcaaaggattctcctgcctcagcctcttgagtagctgggactacaggagcgtgccactacacctggctaattttttttttttttgtatttttagtagaggtgaggtttcaccatgttggccaggctggtcttgaactcctgacctcaagtgatccgcctgccttggcctcccaaagtgccaggattacaggctgagccactgcgcccggccgatcatatgttctttgttgctgttttcctttccagtcatccctgtactcatttcatgttattgctcttgggtcttttgattccatcattttaaccttctgtcaattagtcataataatcattactgatttatacagcttaatttatacatattcaataattgattgctaatcgttgacaactacccctcccttctgaatttggtcacctttaggagtcatctccgtgaatatctgtgactgataaactgcttcagttcaggtagatggaattttctagttccagtcccgttttcaagaaagtttaatctatgtatgggtactggctttattaagggtcaacagttttagatcctaaccccaggagggcccaaggcactcaccctgtttctgtaaggtcatcacaacctcagaccctaggcctgtattcagacctgctgccccactagctgcccagactttcgccaaaactcaaatgttctcatcgtgaatttatcttcacttctggcatctagatatttcccttatttcgcactttacgtattctcgaacagtttcgttatgttgtatccatgtgtacgtaataggagggtattctctgttaacttaaaacagcatgttgcaggaacccagtactatctttctttgcattgcccatgcaagtgagccctgcaatataaccatcttgtctgctgagactttcttacacattttcagagtattttctaaagaagtcatcacatctaagatgcaagcttacaagcgagttcactaggggatttactctgtagacatgttgattttgatctaaatttaatgcccttgtttctacaactgtatttgtttactcttttgtgcctgtggtataatacactatcttatactctcaagcatttcaatacctcttccagtgtttctagatcactctgtctctctcattcacacacacatgcacatgcacacacatatacttttacacatgcatgcacacacatacatgagcacacacacatttacatacatgctcacacacagcacacagtgggacagtctgttcacaaacactacagaacaaacttccttgtctgtaggaagatatgtgtgcacctggcctctttgctgttcttacgacttgcccttcccaagttatttctactttacctctgtggttcgtttgatagaatttccagttaatgtattataagttataatatgccttttctggaataaatctttgctttcaatagatccattcactcctttccagaaatgatcgctgctttttatattctccttggaaaaacaaaagcacctgccttgacccttgtcttcaatatcacatataaccatacaaaactaaaaacaatccattcatttattcctttggttaatagatttttgttgggcagctatcatgttgtatgcggtgtgttagatgctgggtatgttctatgaaacaaaatagtctctgacccctggaagagaaagaaagaaagaatatccctcgccttacctttcttgacccatagtccaactgaagagagaagacgtctgttaattaactaacaatattaagtagcaaattctgagtaccaaatgagtggtattgagatcagctgcctatttgtgggctgatatggttccaaatggcttcacttgacagccttgaaattgagtcttgaaaagggtgcagaaatctaggtaaaaaatatcgatggggaggcatttcaggtgggagaaggaaatgaagaaagaccctgaggtgttacatggggtcaaaagaaaggatgattcaaagcaaggagagagcagagaagagttgggctgaaaattgaatttcctaccacttgtaggtaccaagttgtgacaatgagcttgtcatttcttgcagcacctgtcttatgtagctaaaagtctctttgagttctgcaatggcatattgcttctacggccaacattctgtctttgatagtgaggtcttacattagcattaaatcaaatgttatattgaaccttgagtaaaatctcttccaatttatgttttttttttattatttgtgtctgtgttgttctctgtgtgtgtgtgtgtgtgtgtgtgtgtgtgtgtgtgtgattgtgcacctgtatttgcgtttctcatctggaaaattctcttattcttttcccagggtttgcactgattttcacccttattcactcatctgaaatatcctttttcagtttaatcccagcattttatgtggtgctagactttggcttattggattgtaatttccaacttctaacctctcacctttgtaagacattgacactgaatcatctttcctcactctcagtataaatggtattttaactccaagctggctgcctgttaaattcatttactgtgctagagtgtatctggtaacttgcctgtgatgaatttgtgtccattattacattatagatggtttcatgcagccatctctgcaaagggcctaattatagctgtgatggccaaaactacttgttacctcgtgtcttctgactcatgtgacttgtacatgttttgacaatgaacagttctaccctccaccatggttagataaggtggaatctttttgataggagacctatattagttcagataaatgatgttgcttgttacgtacgaacacacatcactttatctcgttagcttgggaaatggatacgggcagagtgtattattcattttatatctagtgctgagagaggggcacttcacacaaaatagtggttcagcaaatgtttgtgggatgccaaaaaagcccccacaacaaaaagtggacctctttggttatccaagagagatgttttgtcttttggttctagaaattttttcttgcttcctcatctctcatagacatcctagaggagtgtgtgcatgtgtgtgtgtgtaatattaagcaaccagccattctttaccaatagaagatatccttgtttctaacaatgagacttcttctaatagtgctaacactttatctcatgtatgttatttattttttgaagatatagctttgcattttggaataattggagactcacatgcaattttaagaaataatacacaaagatcccatgtactctttgcccagcttcccctaaagttaacatcttgcacaactatagtacaatatcaaaaccaagatgttgacatcaactaatcttatttagatttctccattttgctttcatatatgtgtgtgtgtgtgtgtgtgtgtggtgtatgggtgtatttagttctgtgcaatcttattatatgtgtaggtttgtgtaatagcacctgctgtggtttgaatgtgttcttacaaaaacatgtgttggaaatttaatctccactgcaatagtgctgggaggtacagcccaatgaaaggtgtttaggccatggattgatactgattacaaaaacagcttgagtctgtgagcttgctgtcttgcccttctgccttcctccagagacccttgacagatgtgggccccttgatcttaagctttccagcctccagacctgcgagccaatagatctctgttcattacaaattactgagactgtgatatcctgttttagcagcacaaaaaggactaagacaccaccatagtcaagatacagagcagttctgtcatgaggacccctcgtgatactctgacagccacagccactccttccctccctaacccctgacaaccatcaatctattgaccgtctctaataatgtcatttcaagaatgttatataaacagatttataaaatatgtaaccttgtaagattggctttttctgtttagcataactcctgagatccacccaagctgttcatgtatccatagcgggttcctttttattgcggagtaatattccatggtattggtgtaacagtttaaccattcactcatttatggatatctgggtttattccagttttgggctattacaaaggaagcttctataaacattcaagtatggtatgtgagtgtaagttttcatttctctgggattcttgtctatgaattcaactgctgggttgcgtggtgattggaagtttagtttattaaagaaacagtcactgtttcccagaaagactatgccattttccattcccaccagcaatatgtgactcagtttccctctgtcctcatcaacatgtggtgttttcattatcttgtattttaggcattctaataggacttgtcttattgggcttattgtcttatttgggctactgtaacaaattaccatagactgagtagcttcacagaagtttatttttcacagttcaggggaaagtttaagatctgggtgctggcatggtccatttctggtgaggtccaccttctaggctgcaaacttctgacttcttgttgtagcctcatgtggtgaagagcagagaggagaaacaagctctctcgttactataatgagggcactaatctcattcatgagagctctgcccttatgacttaatctaatcctcattacctcctgaagtccacagctccttatccatcagggggtaaggtttcaacatatgaattctggggtacacagacattctgttcataacaggtatgtaatgacatttactttctaaatggtatttgaatgttgttttgtttattgaataaccataaaccaaggagttaagggttgcagatgctgtaaaccttatttaacagatgaagcaggctgggtgctgtggctcacgtataatcccagcattttgggtggctgaggcaggcagatcacctgaggtcgggagtttgaaaccagcctgaccaacatggtgaaaccccgtctctactgaaaatacaaaattagccaggcatggtggtgcatgcctgtaatcccagctactcgggaggctgaggcaggagaatcgcttgaacccaggaggcagaggttgtggtcagcagagatcgtgcaattgcactccagcctgggcaacaagagcgagactctgtctcaaaaaaaaaaaaaaaaaaaaaaaaaaaaaaaaaagtagatgaagcaagttgctcaaatcagacacttgtttgagtcacaaaataatcaatggtagagctttgtctgcaaccctacattactccctcattgttttatgttgtcctgattaaattgagcttctaactgataataaaatctattattcccaaaattgggccacccattccccaaacgtcctaccttcattctagaatgtcaaacacaagccacagctgagcagcaggacctccatcagcatgcaaccacatggccagccacgccctgcgccaagcctccagatggagaggatttggtgggaaatcatttctgctgctttccgcattccgcatacagtgtcttcttttaacatggcctcttgagagccactctccagcggcagcacggccagcctctgtgcctccactctccaccccaccttgcccatccacagctgtcttccctttctcttctctctttgcagctattctcccttcccaatccagcacagcagtgtggctctccttcctgtacactggtctcctattttcccttctctcatcacataaatcaggctcacatagggttagcttgcgttagcttcttttaactggttgttctgttggttttaattttcctatttttgggattggtttaattatgggaggagttagaggctattttaatgaaataattatggaattagcctaggttttttgaaagaaagaggaaggaaaggtgtgttccattctgtttgcattttttcttctgtatcaagctttgatgtagctttttttccaggcagaatttaggtgcaaatggaaaggtctcaatctgactcaagtcagagtactgtgtgtggttgttctcaatggtttattaggttttatagctctgttttcttttcttgacaaagttatctcacctttgcttgaaaaccatgtttctctgaactatttggtggtttcatgattgcttgtgcttaaattaatgtcagcagcaaggcaatcagtagaaacttcaagtttaaattctcctgaaagctaactttaaatgttaatgtttcatttaattgaagcattctgagatattagcattaaccatttagagcacttttattagataaacggaagaagggagaaggcctaattattgtaagtcatttctgttagacatttatagagaacttgcctttgatgagaaaattgcaaaagaggccaagtatgtcaaatgttgttgtcttccaattcccatttcaatgtgcaaactaatcattcacttccctcatgggaccgctgtgagtttaactgggcaaatacatgtggagtccatgggtgaatctttcattcagtgcaggctacgttgggcgctgtggtcagctggaggcccctatttgacaagagacggtcagaacttagtgtgtgttttctggggctgttttgattttcctgtacaggagagttttgcagggaggcatattgggctggaaatcaaaaggccgtggttcttgcccatctttatcatgggtagatttctggagccagaaccagagccaaataacttcctgacctgcaaaatgaggaggcctggaagattatcctaacgagcctctttgctctgtagttccagcaattatatgtattctgtgaaaagccaataacgtgcaattcctgatagtgaaataactctggagcccatgaactcatgcttcataggccagccctacagattaggaaatgggtttcttcctagggtttttattcaccgtacaatactttcacattttctttccaaatgactattaatcacatattgaattttaaaatattataatccattttccctccagtttttgtggaaaaaaatgtatacacataacgtttattattttaaccatccgtaagtaagtatacgattcagtggcattaaacacattcacaacgttgtataaccatcaccactatctatacacaaaactttttcatcacccgcaacagatcccaatgccttttcaacattaaatactgacttccccttcccactgttaccattcacaatgttgtgtaaccatcaccactatctatacacaaaactttttcatcatccacaacagaaactctgtccccgttaaatactaactcccctttcctactcttaccattcacaatgttgtgtaaccatcaccactatctatacacaaaactttttcatcatccacaacagaaaccctgtcctcattaaacactgactcccgcttcccactcttcccagccctggtaagtctccctctgcctgaattccccaggagtttgcctattccaggtacctcgtacagtgtctatctttctgcatctggtgtattgctcttagcataattactccccctccagttttaggagaagcttcttcccaaggagatttttgataagaacaggaggcggccagctcagcttcctgggatgatttgggtacagccccacccagatgtctctaatttggcgttatcagagtcagtcaccccactgaaaagcccgcctacccatgagcttgggaagccctacatttacaggatggtcagctgtccccatgcccaggagtggttctgtctggagctgattcacagctccatcccctagaaactgtaattcaacaggtcttgggtaagatttagggatctgcattctaaagacagattccattgatcccagtgccttttcaacagtgaacactgtcttctgcaaacagctcacaattgtccatgaaattttgagcttaaggaagttctaacgcccccctcccctcctttatttttgagttgaaagagggtagaatcaaaaacaatactgagaggggtctaaaaatgcaaacacagagagttgctggtttaggagggctgggaggctatgggagaccataggcatagagaaaacattccttctctgtgactctcgggcgcgagcgaatccccaagggggtcaccagagaatcatttcctctttgggaatacaacatgagatggttctttcatctggacctaggttcaattaagtaaatagagcaaatacaaataagagaagaaaagcagcacaaacagtgaaactaggtctttacatacctaaggaggagccgtgagcattcgcctccagggaaccacagtgacgggaaacatgctggaatgttaaacgttccatctcatttgtaggaagcagatgcctacatcttcaaattttgtcttcttaaaaatattattttatccagataaaaatctataacctctagcaaagaaaaaacaacagctgcaagttggagatcatgaactgtctttccaaagaatctccacgtgtagctgatgtcagatgccatcagcagtcagccttcatcaccccaacgccaagtatttgttcagtttctgctccatatgaatgcatcttggatagaatgtgtttggtttggcttttaagaaggctcactgacttagcccatgacctaaagcatatacttaccaagccttggaattcctacagagggccctgcactttgtgtttggtacagagaccaaaaatacaaacccagctttgaggacagaagggcagggaagcaggctctttatgctgtgagtctctcactccaccccatggtccactctggaagcagaagaagtttctttggggatataaaatgtattgttggcaattgtttttgtgtgcagttaaggatcctggaattacagcatctaatgttctaactctactgccatatccatcttaggaatagaaatgcaattgcaaatggcaatttgaggtaagcaatccgattgtgcgaataggtcatatcagatggccaggaatcaagggtcatctaatgagactcactgaccacaactgaaatcagccaccagactctattttctctctgacaattgtgatatggagcaaagaacttcacctcccaccaccatccctgcccgttggtgactgctcgtgaacatttggttgatggatggacaaatgtatgtgtgaacaaataaattaataaatatgtaagagtattggttactggagtatgtattactagagaaataagcaaagacctgctccatacccttcccccaagaaaatagcaaatcattctcagttggaagactaaagagaaatgctagagtccaggccaatggaaaacaagttaaagacagaaggtttagtagcactggaaaacccaggaggacaaagattctccaggtcatcgggaggcgtcgtgctttttttcatgggaaagaaaacttgacccagagtggcttcattaaagaagggagagggacttcataagtgaccagtcgagagctaggccataggggctgcagacccgggactcaaacgatgtgcaaaggcctcagtttctctcttggtctctcccacaatgctgtctgctcacacaggctttccccctttgcactgttgctggttgcattctcgctctttcccccataaggctattaaagttgctgctggaaggttccagagctgtatgatcccggaattgtaccctgtgaaaaagcatagctgcttttctcacagagtaaagaggtccagccctgagttattttgcccctaatgggtttccagggtcgtgtcctttcccaacccctgaggaagctcagcagagatgcttcaggatgagattaggctcactgagcgggtgaacggagctgtttgaactgaggtctcagggagaccagccctctaactgcagcgagctggatttcagacccttcctgtgcacacacactgttgcttgcccagacatgcttcccctttgtcttgttagaccattgatttcctttagaagatcaaaatcagggtgcaggtaggagccttagacaatttctagtttgactctcatcatatttttaatatagccctgcattttcctcatatgaaagcagaaacccacagagtttatgatgtgctcagagccacgcacaggatcgctagaagccggggccacagcccagcttccaccctcctgatggggaccatatccatgtgctgctcttacatgtactgaaaactcagcacatgcctactaaatgctctgtaggctttatctcattttaacttcacttactcatgtaatctcagcactattatcatctgcatgtcacagaggagggagctgagatgcagagtatgtttgtgacttgcccagagttacacactgatatggtttagctgtgtccccacccaaatctcatcttgaattgtagctcccattatccctacatgttgtaggagggacctggtaggaggtaactgaatcatgggggcaggtttttcccatgctgttctcgtgagagtaaatgagtcttacaagatctgatggttttataaagggcagttcccctccacacattctcctgcctgctgccatgtaagatgtgactttgctcctcatttgccttcagccatgatgatgaggcctccccagccatgtggaactgtgactccattaaacctcctttccttgtaaattacccggtctcaggtatatctttattagcagggtgagaacagactaatacgcacataccatcgattggcacagcataggcactccatgttcatgactccaaagggtaccatctaccacctgttaactgcctactagtatcttcaaatcaacgtaagcctcgtagcgttacctattgctgccttgtcctaagcaatcatgttaatggtatctaggttggatgagctacttatatcttttcaattatacaggaaaaacaatggaaaattgtgataatgaaaagaatgtttgctcacaaaccactgaagatggcttcacctgccaccagtgatatgtgaacacacttatgaaactctcacctatattacacagccagggaggctagtgtatttgtggctgatgagggatcaataagcttatagcataacaatacaggtaaaaatttgtgaaagagccctggtcaccttcagggatggaattgacagcagaaagcccacagcaccaaggttaagtactttgttttgtgtgtatttatgtgcagaaacatagatgtgtatatgtgtagatatacaaccacattatacgttatacttagaagtgcgggttgcatacgccactgcacattagaatcactatacagaatccagcaaatcagattctctgatggtggggcctcaacatcagtacttttttaaaaagtcccaggtgatgtctaagtggagccaggtttgcaaaccaggtacctaggatagaggttttcaactcttggtgtgctcacagagaagcacttgaagtatctgcacagctttgtcaaaatgcagattcaaagcctcaaagattctgatgcaggtaatctggggtggcccaggaatccgcacatttcacaagcacgttgaatgattctgatgcaagtgaagggtctgaggaccacgccttgaaagctctgcacagaccccagctcctctagaggacttgcattgccatctggtgaggactgaagacccacattagctaattacatcagtatttttaactctgggaaaatgtaaaaagaatttagcacccagtgtaaatatggaaagattctttcttaaatgttcagtagaggaccctgagcatatggtgactatatagtcagtagcgactgatcactttttaatgtcagtttcatcgtaatcatacggcttccgaatgccacacattaaaatgttaggtccttttcttcccaacccaggattaaaattcatctcaaaggcaaaacatactgtgatttctcaaatgtttttggaactgtcaaaaccagaggatatatttagaggcctttaatgtagaacacaaaatttcactacacgcagaattgccaattaggatgggaggctcagaaatgatcttaatgacacaagtgtgcagtgtttttttccttctgcattacatgaataatttcaagggtgttttcactctgaatgagttttttttcctccatttggcactgcctgtggagtcctctctatagcagaggtgatgttacgagctgtaacgacgtccccgtcagcaagtagcacatgcttttccattagttatacttccataccttcgtttgcagttttgtttttacatacaggattgaaacaaataccagatagtacttttccaaattgttttggtggactcctccccatccacagcggcagacaactcacattaaatatgaagctttcaccacatacaatcagaggcctatcaaaatagcttcaaacttcaaattaatgccattttaggatcactgatgcttttctttagaatgccatacacttgaaatcttctaagactacaagaactgtatggacatttatagctgaaaagaaaacctatttttagaactcagagctgaaaccctacctcaatactacccctatgttttcaagagttcctgtttcccaatgctagtcaactctgaacctgaattttaaaaattatttcctctctgtttcctccctatctgagaagtcatttatttgatggttttagcttctactggcaactacgacatgatttggaagcctgctaagaatgagtctataatatgtttatgtcatgtattaaaaatctccacggtcttataacttaatataaccctatgtgtaattagttgaccgagagtccttttcaacattgattttgatatatgatttctaatttatttgtttatttacttatttatttttgagacagaatctcactctgtcgcccaggctagagggcagtggtgcaatctcagctcactgcaacctccgcctcctgggttcaagcgattctcctgcctcagcctcccaagtagctgggattacaggctcatgccaccacacccagctaatttttgtatttttagtagagacggtttcgccatgttggccaggctggtcttgaacccctgacctcaggtgatccgcccaccttggcctcccaaagtgctaagattagaggcatgagctaccgcaccaggcctctaatttttaaggttttaattctaggccgtaattttttctcttccaacatgataaaaagggtcttcccatgcccttctcttggtttctcttccctcctcatgcctaccgtttatctgtttccatgacctccctgcccacctcaagtcaggtggcacttcaacctgctggcaaacagtgccacccaacactggcacatgagtccatagaatgtctgggaaaagaggcttgtcgtaccatgtgatgtaaagtactaactgtgcaaacgtgcggcactcaacaattttaggagctttgtgattccttcttaatgatgtgcttaatatatttcccccaatgattgcttattttctctggttttaccctcctttatcaggtccttattgaatttcttcttttcctagttaaactggaaaagtaacttattactctgccaggcagtaggatcactcaccaagagacggtaatgagggagaccacatagcccagttggtctggtgatgcctgttttcccaacatagttattaatagcaccactttcactttgccactttggatggcaaatgatatagcgacaatggcactacatttgctactggcagctcaagaagatgttacagaggctggttttgacggaatcacatatgccagatatgtggcatatgtggaaatagatgggaattatgctggaaataggtggaggcccaattgaccctgcttgctcctgtttacctgtagcctctgcttttctgcttcagcctggaattgtcacagaatatcccagacctcctagtctgtacagggtctggttggacaagacccactggctttttagaattactccggaagtcctggcttgctgatcagaagacttgattcttccagaaagaggtagccaaggagacagaaaacaagctggaatcagagcaagaaagactatgtctaccaaacatccccgtctcttcctactctaactgtagatacacgtggataccatagcagcatgaatgagaccaacaccatcgaatgaccattaaatgaatggtcattcgtttatggggaagcagtactgcagggattatgaggtcttatggtttaaagtacagcacacatggaccacggtcccagccagggcagcctgctgtgggaatctctctcagcagatttttgcctgttagattccagaaccttctctggtcactttcatccaatctaattgtctgtcttacccaagaagggatttgttacaagggacttggtggattaagctaaagcaatcttaaatgcagaatgccaggtttctgatacagataatcaatttcagttgctgcagaaaactctgttgggggtgatggagagaatgcactttgtggacccgtctggattgtctcctagtcttgtatccaggtggcactgagcctcatcagtggggtccactctgttatttcctggcctttacttggtgagataaacccttcatgttcagcagccttgtaacagtttgcagaaaagtctccagcctttgcttatgtgttgggtgcaagtctactgatacatcctgagggtgtatgctgttgccggtgcgttgcactaaatgcctgctactgaaaatatgcccagggaatatttctctttatatctgtggaactttgtccatcgctgtgctggaaacaaactattccctgggcagtcagtggtgcgcttttaattctggcctgtgtggtggcagtgggaggggcggtgccttttgctgcgtcgggaacctcttgatcccaccagggtgagctgaaagaccttgaatatgatacttcaaataataaaaatgtatgtgtcaccttggatctgcccagaaaaggggagaggattttacaaacacacacacacgcacacacgcaacacgcacacacacacgcacgcacacgcgcacacacacgctgacacacacgcacgtacacgcgcacacatgcgtgcacacacgcgcacacacgcgcacacacacgcacacacacacgcacatgcacacacagagtcattcaggaaaaacaacaacagaaaacaatttagcacatttttggtgctctgaaaatataaattgggattttatctaccaatattaccatttatcaagttataactatgtatagcatttaattgatataaatacacacagcataaacttaccccaaagtatttatgctttaaaaatttatttacaaataatctgggagaaaaaggtttatttcaaaactatatagagggctgggcatggtataatcccagcactttcggaggccaaggcaggtggatcacttgaggtgaggaattcgagaccagcctggccgacatggtgaaaccccatctctactaaaaatacaaaaattaggccgggtgtagtggctcacgccagtaatcccagcatttggagaggccaaggcgggtggatcatgagatcaggagttcaagaccagcctggccaaaatggtgaaaccctgtctctactaaaaatacaaaaatcagccagacgtggtggcgggtgcctataaatccagctacttgggaggctgaggcagagaattgcttgaacccgggaggcagaggttgcagtgagccaagatcacgtcactgcactccagccagggcgacagagtgagactccatcttaaaaaaaaaaaaaaaatcagcttggtgtggtggtaggtgcctataatcccagctactcagaaggctgaggcaggaaaatcacttgtacccaggagacagagattgcgccgctgccttccaacctgggcaacaagagtgaaactctgtctcaacaaacaaacaaacaaacaaaaaatatatgcagagaagagagtacttaggagcacagtgggagggtgagatgtcagggctcagcatctgcttccgaagttgtcaccaggcatttgttcagggcatgtgggcactaagaggatgaccccgtggtggtcaggtaccttgctgctctgcacacaaacaatagaaagcaatggagcccttgttagaaacacatatttctaagctccaagcctggagcctaggaaacagtgtctcccaggaagaaacctgttaatctgcaccatgtcagggaccccaccccaggattcttaccagtagtgatgggtgagaaacactggctatgctaacagaagcaggcacacagcggccccgtcttcctcccatctgtgagcatgcttcagggctgagcatatgaccaacattttacatttcagagttggctcccaccttaacacacacaacaatgtggacaccaccataaactgtgacatcaccatcacccggacaccagtgggatttatgttgtgtggattaatggccagtggataaatatacagcaataccaaggggcaggtcaacagcttaaagattaggagaaaacaatgagtcagaaactgagcaggtaatcatcagagcatccgtgaataatctgacagactcctcagtcttccacatgtgcacgtggggcagaatgttgacatccaagtgggcatggtaagcagctgatgaaaagttaaggatggaaactttaggcttgaaagtcagcaaagtgaagctgacttgccaagaataaactaagcagctatgtggcatcatgcagatacacacacagacacttttttttttttaagatagaaggagaaacagcaggagagggaagaagtggaaagaaagatgctgacttgactggactcttcactgctaacctttggtgaaggataagtttagacacaggctgcctacatgcaagcatagagatatttctagtgtgccttcttataaaggaagcacaggtagatgtttgtctttgtatggttgtaattaagcgccaaatgatgtcctccattcccttagtgacctaggaagagaaccagctgtgcagcaccatctctttgtctgtttttggaagtgagcccaatgcacttgaccctcagtgctatgagggaccagggggctgacaggtgaaatacagcagggaaggctgcaaagaagccccaagctgctgcgggcagggtgtgtgcaaggcgcacggtacagacagacccaccctgtgtttgtggggcaagccccctgtgcctttccccctctgttgcctctttcagctgccctcagtccttcccacaattcatcccatctcccagcacctgttttggatttggagccagtatatgcaggagagaaaaagaagacagtaaatcgagcaagaaaaaggaaaatgttgtattctggagcagaattacgaatgagtcagcagcaaggtctgacaaaacaaaatacaaaggcagtaaagtaggaggttggctgccaggctggtgtgaagctcggatacctgtttctcagtggccgccagtagaagacagggatatgacaagcttgggaagaaagcaggcatgctggtgtgcatcctggaaaattagttaggaggaaattctcatgggtttcttcctttgaatttcctcctagcaatgctatggctgatttcatttgtttcccagaagatgagctgaagacacataggagcagctattggaattgaaatgtccaagtggagactgaaggaaatatatattttgtaattactcagctatttctggatgtcacagatgtttttgaaacgcatatttggaaacacagttgaaatcacaagtgaaatttttattgttcatctcctaaatgtaagctttttattttatttagaggcatcctcggttttaatcatcttgttatacttagatgttctcctcttaacgactcattgcaaaaagaaggcattctatgtgaagggtacagagaatgcgagaaacattctctatcaatgacctgaacaactagggattgatcagaaaagaaggaactaaggtataatagcgttgggtgtggtatggaagtagaagtcgtttgagatacatatttgaagaagctacaggttcaagaagaactcaccatttctactctcttaaatgtaagttttgtgaaagaccagtgactactataagttagtttattccaggaggagagaaagagctgagatataaatactgaatcctaaggatttgtccattatttttgtgtttggaatctgacaactgtatgtcttctatattttaacccttgtataaatggttgcagtaaattgcctagagcagtgaaggaaagatgtgcagccaagggaaagatcaagaaccttcggtttacatggagctatttcctaatatttgttttatgtcatatgagctaaacatctttaccttttactaaatatttcaaattttatctggggtccattagaaattttttctttttttttttttttttttttttttttttttgagacagagtctcactctgtcaccaggctggagttcagtggctcaatcttggctcactgcaagctccgcctcccaggttcaagctattttcctgcctcagcctcccaaatagctggaactacaggcacccaccaccacgcctggctaattttttttccttttttttttttttttttttgagatggagtctcgctcgctctgtcgcccaagctggagtgcagtggcgcgatctcggcttactgcaagctctgcctcccgggttttcgccattatcctgccttagcctcccaagtagctgggactacaggcccctgccaccatgtccagctaatttttttttgtatttttagtagagacggggtttcaccatgttggccaggctggtctcgatctcttgacctcgtgatccacctgcctcggcctcccaaagtgctgggattacagacgtgagccaccacgcccggccttttttccttttaagtcattataacaagacgtttaacttcatgcaaatggtataaaatatattggcaaggagtgcagaaatgtttgccaaatatggtcattaatatgggggtgactacgacctgcttgagagaagagaagggaagacttctctagggaggactgattcattcaggaagttttccatcatccttcaacttccgcatcaggacttacagttcactggaccatcagccacaggagtgggcccagacaccagacaagaagtcagaagttttggcaagatgccgggtctttgggtgagtgcccagtgagaggtacaaatgcaacaggagtctgacgccatggagggatgtgacttctgcagaatcttgggaagggggcagtgtgggttttgcatgtgggagggacttaaataacttttatcacagccaaatgtgacatgctaaggcctgaatgcatttattcatggttcaggcagctgtagccaacaacaagaagcagttaaagttatgtacccactgagagcagatagcggggaggcagaggtcagcacctgcttgcctgggagctgcagggtttctgagcgggaaggaatgttagtggttgctggttccatctcaccaattcctgcattcctgcattctgaatgcaccaacaaatggcttccatccttctattaacaggggctgttgagccttttcagtgttgaagtatttcagactaccaaaagacagtttcatggttctgaaatctatttccttctaatgtgtacttgtcagccttattcttcccatggaagcaaaagagaccaggcctactgacatgcatgtactcatgaagttctctaaaaccttaaagacatctatccctctcccccgggtcgtctcttgtctgtgcagaatacttccacttgctccaagcatctctcaggtagctttgtttccagactcagccaacctggtcatcttctctggagtattttggcttattggtctcaccactagaaaaaagtgacaccctcaactggacctgttacttcaaatgttaagggagaaggttttagacaagataggacaacatgtcttcccagaaagaccttatgagctgggtagctcttgtctccgcccacattattagagatgagctcgtttattttaactatccaaagaaggatctgggtggaaaatggggaaagtctgcttctgcctcccctgccctgaatgcccacctgataattagcccttccacaaagcgagtccccaggggcttcctggaagcacagcagctgctacatcgtgcaggaccatgacagtggatggaattaattactaaaaccagccaagaccaagattaaggaagataccatgtaaatgtggcaattcgcgaagtatttctgaaaaatgaggcatctgtttcctggtctcacctctcctcatgtcaggtgaaaggtgtggcggggaatgggggctgtaattcagacttaactgtttgattgatcttctcggactcctcaaggttatcagagtaaaaaaaggaatatgtacaggacattgctttcatgaagtgtctgtcacagtccacaaaacctcggcttggattgtgaaagcagattgttttctgtctcctaggggactgtctattgtgttaatttccagatatggatatgactgtgccatctagcacctaacggaacttcttttttatctgttaatgatggaacacttcaaaattgcaagaaaataaaccctttgagtaaacacttcattttctcattttcctcagttttagagccaagaaatagaatattttccagcttctttttggtgcttttatttttttccttcaggttttactttttttcccttctcacccctgacatctcatgcagataactttccttttttttctcttttttaccacccagtctctaaatctcactttcttttctctgtctcatctgccttttctctgtgttaacttttccagtattttcagccttgcttctcattatgttactatattgtgtttctttaactgtgtatgccagccatggggttcttgattctagcttaagaaaatctgactctgggctcatctacacctcctgttatttttcacttcctctttgaatggaattgtaggattaaataaggaaaggactgtggaggtcccctgaagcaattttcctgcaatgcatgcacccattccagaggactccagtggtgcttcgagcccctgctcatatgctatccatgctggggagctcaccacctcagggagaccatccatcctcatacatgctctaagtggactgcactaatgctgaccagacacccagtccaaaatcctgggtaacaatctcagtcattgaaggcagctgcaactctgccattcttaatgggattccggtttgccaagagccccagagagtagaaaagtaagagtttcgtggactctacacaatgctggtaactagatcatgcaattctcagaatttagaaaagagtgttttttattcctttcttgtgatttgaatttcctcacaacccttagccctgtattacacaaaaggaaactgaggctcagataagcaacttgtgcaagttcacccagcaagtgaataacaggctcagatgacctctgcgccttactctaaaactgcctaatagtagtagctgtgtcctactccagagctacacctagccaccctcttctgctggcctcagcctggtgcattgttaggaagggaatatctgaggtgatgtggaggagggaggggagcacaggcaggccagacaggggcaactttggctactccagcatcccaaactagggccgtgctagagggtagaaaacgtggtgtaaatttaaggggcattctcaagttacaaagtcaagtgaaacttggtaatcatgtttacatggacagtaaggaaaataagcaaggggaatggctgatgcgaattccaatatttttctgtggaaagaccaggtacatggaaggaaacagagaattctttagcagaaaaagaatgtatctctctaatgcccagtgatgatgagctttttttcatgtttgttggctgcataaatgtctatgcagccataaaacaaatgagttcatgtcctttgcagggacatggatgaagctggaagccatcattctcagcaaactaacacaagaacagaaaaccaaacaccacatgttctcattcataagtgggagttgaacaataagaacacatggacaccgggaggggaacatcacacactggggcctgtcgggggatgggaggcaaggggagggagagcattaggacaaatccctaatgcatgcagggcttaaaacctagatgacagattgatgggtacagcaaaccagcatggcacatgtatacctatgtaacaaacctgcacattctgtacatgtcccagaacttaaagtaaaatttaaaaataaaataataaaaaatttcacctaaaaaaaagaatgtatttcattttcaaaatattgaatttggggttaaagtttggcataaaaacatccatgtggaaaggtccagcccaagctaaaaatataagtttagaactcagaagatacatgaagcataaagacgtaaattcagtaggaagctgtgtcagaaagcagaaatgatggggacctgccagaccaaggcttagaccagtgaggaaggagcccctgggatggcaggttggtgcctgccttccattcgggtctgcagcagcaggagagaaaggtgaagagcctggatggaggggcaggaggcgaaggagagcaggtcctggaatcaggaaaggggaacagctcctgttgccttcatcacgtgctgcaggctggaaatcagaaagatgccacgtgtttggtagataagggttagctgggagaactcattttgagaatgctaggagtatattgcagtgggttaaaagtgaatagaaagtgagccagtgaagcagtgtagactttgcttgtgaagggccatgatagttacaagaaggaggctgggtgcagtgtctcatgcctgtaatccaagcatttgggaggccgaggcaggagaatcacttgagcatgggaggcagtggttgcggtgagccaagattgcaccactgcactccagcctgggcaacagaacgagactctgtctcaagaaaaaaaaaaaaaggaaggagcagttccaagggaatatggccagaggttttttgtttgttttgtttgtttgtttgttttcaatgagggagatttgagttatattctacagaattagaagaagtaataggggagaatgagtggttagaaatgtaaggcacagtggagaagttgttaaagttcaacaagaagcaggagggtatgagcttagtcttgcaaaggaagatggcagtttcaaaacgtcagccggattcaatttaaagcttaattaagcagtgaacaatttgcaaattgggcagcctcctgagccacaataggctctgagactccagtgcagccccatggtggtagaagatttatggacagaaaaaggaaagtgatgtacagaaaacagaagtgagggacagaaacagctggattcgttacagctcagcattcaccttatttgaacatgcttcaaacaattggctacgtttgattagccaaaacttggtgattggcgcaagagtaggttatggtctgtttacacctccactggttataattcacaatgtgcagagaaacctttaggctgaacttaaaacatgtaaggaggcagctttaggctaaacgtgacttaacggtagcttctttgtaggagaggaaggatggaggagaggcctgacttagggcacttgacctaggaaggaagagtagaagatggatttgagaaagacttagaaagttactgattagaaattgggcgctatttgattgaattggagtaggggaagcaaggggtcaaagaatggagggaaggaaaactacattttcaactcagcttactgagtgcatgatggagctaccaactgagatagggattatcaaaagggagcaaggtttgggggctgctgaagagtttattctggagcaaattgagtttttggtgcctgtgagacataggatgcagtcatctgatatattggtctgtagctggacctgtgggagttactgatatttaggtaatttaggttacggtttaaaatctcaagaatggaagatttcataggggaggaggatgtaaagggagtagatgagtggccaaagaaaaaactcagtgtccacgatggtacagagaaagaaaagaccttagaaatctaaagtatgggtccatcggagagaaggaggggagagggtagaaatttcctgactagagggaaattttagagagataagaagcagaccaaatatgaactcaccctgtgacaaatcctcaactgctttctaaaaaattattgaatgccaatgtcaactattttgtgtgtaatatattaaaaaaataatttgctgaaactgtttttccatcttgtggatagtgttttgggaaataagttctcctttattcattttccaggagagatattaatgtaatgctataggatgagactaaaataactcatattcatgaacttctaaaaaatggcactcttagaaaaataactgaaagcagccttactaatttccaatctttgtattttttatgatcagaaatatttagtctattttattttttatttttatttttatttatttattcatttagtttttgagatgaagtctcgctctgtggcccaggctgaagtgcaagggcatgacctcagttcactgcaacctccgcctcctgggttcaagtgattcttccacctcagcctccggagtagctgcgattacaggcacccgccatcctgcctggctaatttttgtatttttgtagagatggagtttcaccatgttgactaggctggtcttgaactcctgacctcaggtgatccacccgcctcagcctcccaaagtgctgggattacaggcgtgagccaccactcctggcctagagtctattattttaaagaaagaaacataaatacaacattgaccacagaaaaagaaaaagactttatctctctaaggaacaaattctttcagtgagatgcagctttcttagtgcctttctagataaaacattgtacaaatgaaaacgcttcaatttgcactctttaaacagtcattccctttgtgcctgcagttcttttggcttgatgttgaggaagattttgtggaagacaatgatattttattgcttcatcttggagcaaggagaaaattgtttctcttcttcccacttccccattttttaagagtagtgctcgagtcacacttgcacttccacgctgaagccttctatttgtatcaacagtgtgttctggaatgccactttcacattcccacacttggcagacccagcttctcaggttttctctatttcttgactttattcatttttgtttcagcctttcttttttttttcttttttttttttaattatactttaagttttagggtacatgtgcacaacatgcaggtttatatcatatgtatacatgtgccatgttggtgtgctgcacccattaacttgtcatttacattaggtatatctcctaatgctatccctcccccctccccccaccccacaacagtccctggtgtgtgattttccccttcctgagtccatgtgttctcattgttcaattcccacctatgagtcagaacatgcggtgtttggttttttgtccttgcgctagtttgctgagaatgatggtttccaccttcatccatgtccctacaaaggacatgaactcatcattttttatggctgcatagtattccatggtgtatatgtgccacattttcttaatccagtctatcattgttggatatttgggttggttcctacccaaaggattataaatcatgctgctacaaagacacatgcacatgtatgtttcagcctttcttataggcgattccattttccagatattctattctagtccccatgcatacattttggttttgatttggtttggtttgggggtttcttgcctaacggtacagacgaacaattaaaagcagttctctcctcctcctcctcctcttcttcctcctcctcctcctcttcctcctcttccccttctccttctccttcgtctccttcttctccttcttcttccttcttctctttcttcttgccatggccttgatagggttattttaattgctctccccgtttcttatgagcaccacttaaaagatatccacagagctgaattgcaggggtgtgtagtggtatattcaaagatgaatgtaaagatgtaactctaggtgtttgttttggggatggcataaccagggaatgaatttaaatcactgtttctagatggattaaagcaatggaccttcaaccaggaaagatggcagctattcttactttgcatatttattatatttgttgctatactgaaattttcagctgacaacagcgaacacggacttctgacttgagagttacgagatacaagcttggttcaggcaatttccaagggattgtttagagagagacagaactcaggtcaaatcccacttgactttaacttaaattccttaagattttattttcctacctgtacaaataggacaataatatctgcctcataaagactaaatgagttcttgcatggtaaggagctgtcagagtacctaatatgtggtacgtgctccataaatgccacccacccccaccacccacttcagctcaccactgtcaccatctctgggacttggcttggctgaagtaatatcaaaggcttcctctgagtgcttcagtctgtgagtggtcctctcccagcccctcaccacctctgtcctgatactattttaacaaggaatttatctgtttgctttagaagttgctggaagtttacaaagaagaaacccagtagttcagaagaaacgtatctaaatctgattttaaaattatctgttttctctggatttaaactagctatattacttacctattgctgtataagaaattaccccaaactcagtggcttaagacagccaacatttaatcttgcagtcactgtgggtcaggaactcgagaacatcttagctgtgtggctctggctcagggtccctcatgaggccagcatcaagacattagccagggttgcagtcatccgaaggcttgaccggagatggggaacccatttccacatccactcacatggcttctggcaagaggcagtctaacgggtatgagcctcagactctccatggggctgcttgagtgtcctcacaacatggcagccagcttcctcagagcaagtgatatgaaagacagcaagaaggaagccacgatacctcttataagctggctgcagaagcctaacaccctcactgctactgtattctgttcatgagggtcactaagtcagccaacactaaagggtacagaattaggttccatctcttctcttctctctcctcctctcctcttccccctttctctttcctttatcctcttcttctctttctgtgcctcagtttcttacctgaccaaaggtaacttctgccccctagggatgctatgaaaacaaagtgagatcaatcatatgaaaaggcggttttggagggagagttcagaaactctatataatataccatataccataaccatggaaacctgagatcagctctgtctagcttcctgctcttgcatctgaagaagccgttccagctcacacaggcatggcttagtcacagtgcagcatggggtcctttaatgggtcctctctgagcggtgacctgctcaggacacaggagccagcaccaggcccttccttccttctcctgggcaagcagcaccactcatcccggcagaaatagaaaaaggagttaagttcctgtgttccttattagattgctgtagcagctccataaagctctcctagacagtcctgtctgttagtggctgtttctttatgactaaagcagcactttcccatctgctgccctcaaagcaaggggccccgggccgcatatttctggttcaggagtctcaagatctctgaaagcaccagattgttgggatttaagtgctgttgtttatttttatatctgggtcctgttcctccaaataactccaagaccattgtgattttcgagaagttaattcagtggtgcaggctaggtagggaatggtggtattagcaaatcctacctgttttctttgcaagctcatttccatcattggtcctccaaatgcatttccctgttcaaagtactctaccttggatatgtctgcctttgcctccacgtccctcacctattatctttagaaaggtggttttaaatgttggtcactgaacatttagccacatagggcaccagctctcagaggtttcacaagtaaaggaaagggttgggggaaatgaaatatggttcaacgcaacagagtaacccacatattccgtatgttcgacaaggtctctacccaggaggctggcgatgaaggatgctaacatttcttgaaccgccatcttctcccttcttttgggtaaccctcgaattctgcttatggttatctatggattgtggagtcatttcctggctcaggaggttaagaaaggcgtccgagatttgagggttacaggagtttggaagcactgtttttctggttttctgttacctccattttaaagccgtgatacttccaactgcccttttttcagtaagttcttgttgactactctcttgaaaccaaaagatgcatatcccgttgtacagggggtcaaaagtgtgcccaattaagcctgccttgacttcaatattgcaactcactgaagacacacagtggaatttctggtggaccccttcccataacccacagggaactctagccgtacatgggtcttactgacccgttgggtctagctgacggtgcctgatggtctccaatgaccaaggtgtcctcattagttctgtgctatatttagttaagcctgaaatctgtgcccctaatttaatcacacaccaggtagccatggagatgacatcaagcctctggctgccctataaaccattgcaaatgctgaaaataaaataaacaggatatgcaaattgacttcctaagtaaataaaagactttgtctccaggtgttgggattagctgcttttggttcactgatgtttgttaggattcacagtgatttgaaaaatatcatcgtaacagcctttgtctcaatgcctaccttttttcctttttgtctgttgcagatatatcaacactcgtatactggatattacgtcctgagcaaaattcctcatgggtaagagtgttcttttctttcttttaattagaaatatgcagggcaaagtgaagggtagaacatggacgagctgtttaacccttagggcgggaaatggcgttccagttctcacagccaagggtgctggtatcgtggcacctctgggactctccctagataatgacactaaggatgtcagggggtcacttgagtccactcacttccccatttgtgaagcccccttcctagagcaactctgccctcttcctgtgctggttcctgcagttgaccctggaggttcttcagagccggacattcccctctgctttgtaatcacctgcagcctcctctcaggcaaggtgaggtggcccttggcctcccacgagggttcctggttatacccacactagcagaatagaagcctctctcagcccaccacatgtcatcagagacaaatctggaacatatctatgggattacggtaaactactctggtcagacattcagcagtgcattgggaatgggttgggcaagtggtattagtgctgctctacccatcactccgagggggtttcagcggcgtgttgttcttgttttattgtcctttctgagcttggctgtgctcccagggccgggtttcagtgcctgcttttgactgggccccccggcttcattctttcatgacctcacattgcactgctaacctcatctggtctctcaataatgtattgtccagagcaggagcgagtttagttttcagtgctgggcaggcgtcccccacacgaccctcagatgcctgatcagcttcacctttggaacccagagcagaaaagacattggttagggtttggtgaaaccacatgttgagtcagacacagatgaaaaatggttgcagaactaggaaagtctgtcgaggagaattttttgttgttttatcttcattatttcttcgtctcctcttccctcctccttccctcccctattctcattcccttctcctggccttcctgttccccacctcatgtttctctttcctgtcttctgtggtttctactgtcatgctttgcaaaggtgaggtgctcaggaaaggttgataaagaaactgaattgtgctgcagatagtgtcatgtaggctcctgtgaatatctaggttgaggcatcctcatttcccaagcaaattttaacagcaggagtggctagaaagcatttttccataggtgagcattaatcacagcatgagcgtttatagctgctgctctctgttttctactcagcttagaatacaggcaagtccttggaaaacaaactcgaataaactaatttaatgtgggctttagacaaagggaagacgcatgtggatcttcagcaaattgtgaccaatagtttctgttagattattagaaaagtgaagcccaaagaaagcaaagatggcccaagttgcaaaaataaagtattcatacaaatttttcattaaaagtatgttttaaatagaaacccaaatattcttcagtaaagaggaattatcccattctttcccaagcagatatatatcttcagaggtcatggcaggcaggactataattatgccttgagatttatctgccccttctgggaacaatagaatttgttgtagatgatagatatttcgttccatcttatatcaatttgtaaaactcgaaactctaaaagcagttgatgcctaacgtattgtgttaatattttactgcatcagtcagcatttggaggaaacagattctaggaacttggcacaggagtttgctgaacaagctagcaaagctcaggccatgatagtctgtgttgaaggctcggcttctgcacttagatacctggagcctggtgatgatctgccttatagatgaccccaacacggagggagctgcttctggtgtctttaatggaatcagagcaagaataatgcccctggtttattggttagctttcatatacctttatccctgttcaacaacctgcaagaaaagcatccttatttccattttaagtgagagctccaagaggtcatcaccttcccctcacctcctagctactgtatgcttgagtctcagcgtaagtcaggctgactcgaaatcccatgctagtaaaaaaactcgtggctcacacctgtaatcccaacactccgggaggccaaggtgggcagatcacttgaggtcaggagtttgagaccagcctagccaacatggtgaaaccccatctctactaaaaatacaaaaattagccaggcatggtggtgcacacctctagtcccagctactcaggaggctgaggcaggagaatcgcttgaacctgggaggctagaggttgcagtgagctgagattgcaccactgcactccagcctaggtgacagagtgagactctgtcaaacaaaaacaaaaacaacaattgggattaattcaaaggtcacaatgcagagaacaaacgtgatagctataaagatgagattttttagtgacatactactttctcttcctagggttcttataggattgaaagatgtagcaagtacatttattggaaaacaacctctgggggtgccaaagtcagtgtcccaccctgtcaccatgtcactgaacacagcgcccctgaagcggcgttgctcaacctgctcaattcttcctctttgtcataaggccattgatgagaaattagccaattaattcattgcaaatattgtcagagtcttatttgtcttaatgagacagtggatctctgagcggtatctccgtaggcctggagcttcgtgaccccttggtcatcactgtcaccggtgtgcgtgctccaccaggtggcagaaaaagaacacagcccggagctctaagtctgaggatctaggtgggttttggatagggaggaaagcacaattgtcttttaaaaataaaaatgtccctactaaaatatttgaatatacattattcatgtagaagaaaactaagagattttcttaatttagaaaacacatatctgtacctttttcactaattctcatctttcctttcctcgctcctccctctaaattaaagccagaggccgtgcaatcttcaggatggttttgtcatttatagcttgatttttttttcttagcttcagtctttgcaaccagccagagaaaatggtctaattaatgttctcatgccctctgatttctgttgtccttccttttggcaaatggcaaaagagtttcaggacggactacccctttcccatccccctctcactccccagtccccgctgttagcttccttcctccgatggctgtgacctctatagctggggccaggtagagttctttctgtgtggaaggtgggagttgcaatgagactcccaagacagctgaattttgatataatcaaaaatctattacctaagggtaggtttgtttgactttgacataccaagcttccaaaaattgtattcttaaattgtatcctaaaaggacatatgccttttacaacaaatctatattttagcggaactaaagctagttatttttaacataaagcatttcactagaagtttttatatcagaattttaataaaataaggaatcttccatggtggagtcaaggatctgttaggtgtttccatataagtatttttgtagacttggctactgcatgacattttcctggcatgacttctttttctagaattagttttgtctttatattttttagggtctaaagccaaaggcaaaattatctatatttatgtctattatctatctacctagctttctatctatctatacacacacatatacataatacacacttttaataatagtaataatatatttctaaaatgtagtctcatatccaataggattgttctgaaagacatatggacttttttctataaccgaaatcaatttgaagaaaaattggtcctatcactttattatgtaatgttggcaattaggggtctggcaaactcagaactgtaatagaatagaaactgctgggtgttcaaaggcatttttttacgtgactggccatgttctgtggatattgttgctctaactttgcttacctactcgtaattttcaggcaccaaacaaaactgtgaaaaaattgtgttcctttagaattgtagttgactttttaaagccatattctgtatctgtggaaataggaaactgagacatcacttccttctacctggaactgctctctaagtttatagactgagatccagaggagcattctgtttatttgggaagtagatatctaggtcgagaatgtacagtgcccagtgccagcctaatagcatcatgccaggcagtgacttagaccctgcagccacatagacctgaacttgaacccatcgtgctgctgacttctggttgtgtgaccttgagagttgttctacttccataggtcttaggatccatataagaagatcataataatagtgcccactttggcctggcatggtggctcatgcctgtaatcccagcactttgggaggccgaagcaggtggatcacctgaggtcaggagtttgagaccagcctggcctgttgcaaaaccccatctctactaaaaatacaaaattagctgggcatggtggcgggtacctgtaatcccagctactcaggaggctgaggcaggagaatcgtttgaacccaagaggcggaggttgcagtgagctgagattgtaccattgcactccagcctgggagacaaagcaagactccatctcaaaaaacaaaacaaaacaaaaaaattagtgcccacctcataggcttgttagaagaattaaatggaatggctgggtgtggtggctcacgcctgtaatcccagcactgtgggaggctgatgtgggtggatcacttgagttcgagaccagcctggccaacatggtgaaaccccatgtctactaaaaatacaaaacttggccgggcttagtgaggctgaggcacaagaatcacttaaacctgggagtcggaggttgcagtgagctgagattgtgccactgcactccagcctgggtgggagagcgagactccatctcaaaaaaagaattaagtggaatgatatatgcaaaacacccagcaaagaattttgcatctagtgagtgattagttaatattgtagtatgtacccaatatatatttgtagtcttataattaaatattatcagactttagtttctagccatcttgaaaatcttttctgttacaaatgaaggaataatataatcctaaaatcatacaattctctttaataatttttctaagctgaggcttgtttcatgacactcaggtaattataatgtctttgtaattttaatttccctcttaaaagaagtatctatggcctcaactgtctacaattctcaatactcaataattttttttatatcatctcattctgaccttctgcaattaactttccagcattcttgttttgcctccaatggaagcagaaaagatactgtgtcagcaaatacttattgaaatactgtctggagcaatgaaagcatggttgctatccttaagaaattaaaaatcttgttgcaaaggaaagatacagacttatataataaaatgttataaagtctgttaagtgagtaatttctttttttttttttttttttgagacagagtctcactctgttgcccaggctgaagtgcagtgatacgatctcagctcactgcaacctccgccccccaggttcaagcaattctcctgcctcagcctcctgagtagctgggactacaggcacccaccaccactcctggctaattttttgtatttttagtagagacggggtttcaccgtgttagctaggatggtctcgatctcctgacctcgtgatctgcccacctcggcctcccgaagtgctgggattacaggcgtgaagtgaggatttttaacactacccaccaaagaaggaggggagggttgaaggtgtcaccatcataaacagtctcaagaaggaagtttgacttgaagtgagcctgatagctgagtttttgtttgtttgtttctttactttttaatagatgacaggagggagatactccaggcagggtaaaacatgaaatgaacttgacctttgcatgagccaacacttcctagaattaatgaggtgccctgccaggctgctgctggagtgttcacgtgggactcagcatgggtaggcatagggttaggtaggctttaggaggtacctagagtgcagacaactgaaatactcagtgtttaaaacccagtagtattggtctttacaataagaacatagcaaccttttggagcagaagaggaatgtgatgaaaacagtaggcgcagattagttttgtgcttatgtatagcatacactgaagaaaaaggaagatcaaaattctggattcaattagcagccaggttggaatggtgggtcgggagctcagccaatgtagaaaccacactaattgtgattatgagtagctggtgttctcttggaaaatgaagacagatttcaagtgtttatattccatgtccctctaattaaatctgtggcagcctgggctccttgtgagttgagcctggtgccatcctgagaggtctctctaccatgagtggtctgtaggtagtgagttcaggagggcagcgatgagaattctcagcacccatgttggttagtgcattcctttccagccctttcttcctgtgtgtgagtctccagggcctggctgctgcacacacggagataggctttggctgtgcagagcaagctaccttcacagctgccggaagttacagaactaggattgtgtgtgtaaactggggaagcaccagtgtgaagcaaaaatgcagaagaaatcttaaaatggctttttttttttttttttttaagatacagagtctggctctgtcaccaggttgaagtgcagtggcgcgatctcggctcacttcaccctccacctcccaggttcaagcaattcttctaccgcagcctcctgagtaggtgtgactgcaggtgcacaccgccatgcctggctaatttcttttgcattttagtagatacgacgtttcactgtcttgctcagggtagtctcgaactcctgagctcaggcaatccacccgccttggcctcccaataaaatggcattttatgtgtctgtaccatggcattgaagaggggagaattccactgttacttgctttttttgttttgtttatttgttggtttttttttttttttttttgagaggaagtattgctctgtcgcccaggctggagtgcagtggtgtgatctctgctcactgcaagctccgcctcccaggttcacaccattcttctgcctcagcctccggagtagtagctgggactacaggcgcccaccaccacgcccggctaattttttgtatttttagtagagacggggtttcaccgtgttagccaggatggtctcgatctcctgacctcgtgacccgcccgcctcggcctcccaaagtgctgggattacaggcgtgagccactgcgcccggcctgttacttggttttatggattttcagaactgtgaacaactcatacatctgcctgtaagacttggtctcagccatttctccctccccttctcccttcccctcctgtcctccttctatccctccctcctgctgaaatccagacttctagtaaccatcaccaaaaaatgtggactttagagtcaaggagatctgggcgtaaatccccagtcttcgtttctacttgtgtagtcatgaaacagttcctttgctcctctgggcacacttactccatccatatattagttgcctaatgcatggggtttatggtgaagtttctgtgaaacactgtatgatgaggtgatgtctttaagggcctgctttggttcatagaaaatactgagggttgccaggcgcggtggttcacgcctgtaatcccagcactttgggatgccaaggcgggtggatcacaaagtcaggagatcaagaccagcctggctaacacggtgaaaccctgtctctactaaaaatacaaaaaattagccaggcatggtggtgggcacctgtagtcccagctacttgggaggctgaggcaggagaatggcgtgaacccgggaggtggagcttgcagtgagccgagactgtgccactgcactccagctcgggcggcagagtgagactccgtctcaaaaaaaaaaaaaaaaaagaaaatactgagggctctattcatggtggacaccaagaccttccataatatggccaaatctaattagccacccttcatcaaatttccctaaatttgggacagaaaataaatctcatactcactgttaactctgaccaattgacaatgacttcctggagctctacatttaaaaatagactaaaaccatgcccaggctctttaggaaagaatgccacaatcagtgagttttgcctctgaggtttctattctcccatccggctgtgtaagaatgaatcacatcacgcaatgtgtccagtcattgctcccaaacccggaatgtgtttctggttatccacacctctattgacttcattctcctccccaccacacgagccccctcccacacatgcgcactacagaaatgtcctggtcattgtgcctctcatactcaaatccttctgacccttcaagccacagcgtcaaaacctccttctctaaaaaaaacctgaatgctgagagtcaatactgcttcttatttcacgctagaatttatcgttttgttagatggctacttccattgttgtagatagaatttttctaaaggggatatttaggaatgctttccatatccatgtattgcttgacttctttctctccgtcattctaagttgtcagagagaggggttgggtgggaagggtgtggactctgcctgtaataccagtagctgttgcacagggtgacactgtgactttgaattgcaaaagtggcgaaagaggctgcaccaacaggtcttatgctctttccaggtgcaggtctcagataacaagctgaaggtagtcagtgactggaatgtcatcggccacctgcaaagggagtcattgcagctactcttttcagtggaatcatttagttccctcagggactttcttagaaagtctaaaagattttcaaacaaacaagtctctttgaaaatgaggtgaaaatgcccaggagtcctcatttggtcaggctccttgttcatcttaaactctacacccatgtccctggttcctgatactgggggaccccataaatgttggttaatcactggaggaaatgaattaaggaactaagccatgctgaggagcaagaatgtgtgtgctggggccccaccacaaatgggttaaataagagcctctgaagagggaacctcaggatggctttgaaggctacctgggtgattttggtgtccagctggggtcatctggcctgctcgcccctttacttgctgcccttgacaagtgacacccaggattgccgtggaagctgagaaataacacttctgtctgaatatgccagtaaagtttcctctcaggcattaatttccttgtccactcaagaaacttggagaaataagggtagatctcagattaaccatgttcttggggatttacttaatgatattcagtaaaggggttatagtatcaaagtctgcagcatggagatgaagcagagccggctcttccggggtctgtccacatcaaggggcaccagacgttggttgtgattgttcctgagcctggccaacctcacatgtgccctgggctccctctggtgagctccggtcttcaccttaaccgcgcatgtttgcattgcggggaatctgtgcttcagacagacacgccagatgttacaggtcactgcatctaagatggaaggtgttctgtttatttatttatgttttaattttggctgttgatcactttcttgtgctggtgaatcagcacgcgtgttgaaccagccattaatctcctgggagagagctgttgacatcctggagggtggcactcttcctgtttacagatgttaaagagaaaggcccatgggtgtctccctgggtggccaagcctggttcatgtgtgtgctgtgctgtgtgttccttcttccacacaatcactgagcctggccgggcacagtggctcacgcgtgtaatcccagcactttgggggaccgaggcgggcagatcacctgaggtcaggagttcgagaccagcctgaccaacatggtgaaaccccgtctctattaaaattaaaaaaaaaaaaaaaattagccgggcatggtggtgggtgcctgtaatcccagctacctgggaggcagagacaggagaatcgtttgaacccttgaacctgcgaggcagaggttacagtgagccgagattgtgccattgcactctagcctgggcaacaagagcaaaactctgtctaaaaaaaaaaaaaaatcactgagcccctcgcaagtgccaggcctgatgcgaagcactggggatggatagggaaaggccccacctgtcccttgctgtctagtttattttgttttgtttctacgtcacctcctctctcccctgtgctcctgcagagggttggacacaaataccccactgtgtctgcgctggggacattggcctaaatcaaacatctagggcagcctcagccaggaaagggcatcactcaaggagagggagcaggtcagtctgtctggatagtggtgggaagagcatacaccaacaccaactgtacgtatgtgatttcaagtttattgtggtacaatttacttctaataaaaatcacgctttcggccgggcgtggtggctcacatctgtaatcccagcactttcggaggccaaggtgggtggatcacaaggtcaagagatcaagaccatcctggccaacatggtgaaaccccatctctactaaaaatacaaaaattagctgggtgtggtttgggtgcacctatagtcccggccactagggaggctgaggcaggagaatcatttgaacccaggaggcagaggttgcagtgagccaagatcatgccactgcactccagcctggcaacagagcgagactccatcttaaaaaaaaaaaaaaaaatacactttttaaaggcatcgtttagtaaggtttgacaaataggtgcaatgaatgacataagctccccacaagcaagactcagggcagtcccacctgcccagagcatcctccatacccctccacccaggcgagcgctgccatgccatctatcccacacttttgccttttgccttttctggaatgtcatgttgagggggttgtacagtgtgttaccttctgcagctggcttccttagcataattgcttttgagattcacccgtgttgtgacaggtgtctgcattcatttgtttttcactgctgaggagtggtctgttgcatggatatcataatttgtttcttcattcaacatttcattgatatttgagtgtttctaattcggggctagtatgaataaaagtgctgtgcacatttgcacacagattttcatccaacgtgttttcctttctcttgggtgaatacctagatgtagaattcccagatcataagtaaatgcacctttaactagattctaaagtgcccaactgtcttccaaagtggctgcaccattaagaactctgcctttttcttaactcactaccccaggactgacttttttgaccccctgccctccgcccggtcactgtgtatggcaggtggaatccaccatgccctgggggtggttccacctgcagctgtggggagaagcatctgtgctcactgcacatagatctgtgccctcaatgccagcctgcacctgcctttctctacctggcacctggggcctcatgggggatggtgtccggcctgcaggagcagcagcctgactgtgccatctctcatctctccaaatgatctctctgtggaactttctaaatgacatatcagccgcgaagacaaataggaaataagaggcaggaggcaagacagacactccccatggagcggattccacgtggccctgggcactcacctcaggagtggttgagaaagcctggttcctgcttgctccatgaagtcctcactccttgaccagattttggagagaggaaggtttttcaataactgcccctcttggtagtcctcctaaggaagagcaaaagaaataaaacagattcaaaactgtgggcctgcgcagtgattcatgcctataatcccagcatttggggaggtcaacgtgggaggatctcttgagcccaggagtttgagaccagcctgggcaacatagcaagacacccatctctacaaaaatacaattaaaaaattagtcggatatggtggcacgtgcctgtgatcccagaaacttgggatgctgaagtgggagaatcgcatgagcccaggaggtcaaagttgcagtgagctctgattgcaccattgcactccagcctggacaacaaagcaagcaagaagagaggagaggagaggaaaggagtggagaggagggcagaggaggggaggggaggggactatgcatatcccagtagcctggctctgggctgggtctgtctgttgcttaaaggcttaaaaaaagagcacagagccatctgcacttggacatcctggtgacgtggcctaacttccgacattggggtcctgtaaaagaagataagccatggtgtttccttaatgagaaggccttaattccaaagtgagggctggcaaacccaacagcacagcactcagaggagaagacacagttgttgattgagtcgagctgtctggcttcccaggaccctcagctcagtcacagcacagcgttaccaggatgtcagacacccaagggcagtgctgacatgcagcctgccactgtggccacagcactcgggttaaaaagaaaccagataaaattcgtgtttctgcttgtccagactagaaattaattcaaacctggcctgtagcagctgtcttctctacatccaactggatggatgaaggccgtcctacctagtagagggaggttggaaggatgagaactgtctacaattaaccttttcattagcacagaaaatttagacaaccaaggtcccaatttctaatgtaaaggtcaatttcttacatctctgtgtacatcctaactgattcaccacaccattgcccgaaggtacatttctattggttttttgaaatgctaagaggagctctcaggcagtgttaatgtatgcactcacgacttcataggtaccagtactgcactagcttccagtatagcactaggtactagtactgcactagatactagcactgcactaggtactagcactgcactaggtaatagcactgcactaggtactgtggatttgaggggtcagaggggaaggaaaccattctgattgtcaaggaatttcctatatagttacagaaaccacattcattagagaatgagtaaattacctttgtgctcctattagactacataagaattgtacaatgtgatgtcctggggttacataagtatagttttaaatcaactatatctgcagcctgtgaaaaacctattccccttttttcctagttgcagttcactccccagttcgtctgcaccctacctcgatgagatctccccttccgtgggctaaacaaaaccccaagcagttagctgttaatgatacgagcaccatgccggagctagggccaaatgagtcagaagaatcctttgcagtgccgcggggccctaattgtgtcaggtattttgcccaaattagcatggctgaggatcggctgctggttctaaaatagtctcgaaggactgtctccaaattgcttcggcaacattactcattctcagcacgactctggtttccgccgtcccaatttacagatgggcagccgaaagggaaaggatgagatggctaaactgaaagtcacaaaggaaatcctgggccaacatcaccccttggggcttcctccagctgcggtctgtgcccccacagccccaggatgctgggcggttttctccaagaattggaaaccttttcccagggcatcctcacacaaagccccactctgaataacacgatgatttcaggcctttttctaatcataagcccccaaattagataagatcaacatgaaaggtctcaggtatcccttaagaatttaaaggaaggacagaaaaggttgagctctgtagtgcgtggaagaggagatggcatgatcaggatactgtcctgagaattagcagtaggatcttacagtgaaatagggggctcctccgcaggctcccaacacatcagctggtaattatgcccggcaccaggatactggggcaaggcagagccactggaacacatcctcgcctgcaccctgctctgctcattagccatagcatcaaaatcacttttgctccaaaggcgttttttttttcctatactgtacattcttttgtgctttctaatttattactttttttcccctacctgagctgttggagatttagtgttgaatggcttctctgtatttttctttagtctaattcattatcactaagtctgtggtttttttttttttttgtgatcaatatacacacttagattggtttaaaataatcccatggagagcctcattagtgtccttggataatagatgcagctctctgggagaagggagcgtttatcagggaccacagtgacagagcccacaagcacacctccctgtgtgtgtgttgaacatgctagaacatgcacatgtatgttgtcaggtcctcaggctgcatgaagctgctacatgtgcaccatgtccctgctgcgtccctgctgttcgttctgagcactgtgagagcctgaggcgtcagagtgcagctcattgagacccagacgccactagattctcagtcttctgcatgtttttcacacctcttatgtttactgaaactacatcttgagctgagtgtttgagcaatttgttctcaaggccaatatgggcaaactccctgagtcggagctgataccagcgaacggcttcagaaagtaaaaaacatgggaaagaggctgagaggaaagaacgctctgagtgggaagagaggagggagcacctgtctgaactggctccgttcacgtccattcattctttaaggaacttctctttgtccttcataaactacagtgttcccctgtctcccaggctggggtctcatggctcttgccacaggccaaaaagaaataagatttcctcttggcaacattttttgttctgtaatgggattttactgaaaggcaggaggaaaaagcccttgaggtgaccaaaaacttgtttttaacacatatgatgtaaggtaaaagctttaagaaggtaaacagagctgggcatggtggcacatgcctaacgccccaacagctcgggagaccaaggtaggaggatggcttgagaccaggaggttgaagctgcagagagctatgattgtgccaatctactccagcgacagcatgagaccttgtctctaaacatagatagatagattgacagattgattgataaatgatagatagatgatagataaatgatagatagatgatggatagatgattgataggtagatggatagatgacagatagacatatagctagatagatcaatccatggatgatagatagatagataatagataaataggtagatagataaatgatagatagatatagatagataataaatcaatccattaatggataggtgatagataatagactgattgattgatagatgatagactgattggttgagagatgattgatagatagaaaacaaacctgttttttagtttcttcacagagtggcacaagcatcatctcattccattttagaacattccacccccacctccaaattatgctttagcatttactgaaccccccaaactcatttctgcttccccgtcatgtcttcatttcacagagtttgttgagcactgatcttgatattaggtttacagtgacagagaagacacaagctccctttaattacaaagattccatttccgtgtgactgtgtttactacggtcagccctccatatccatgggttctgtatctggagattcaagcaacctccctcaggtcaaatacctggaaaaaaaaaaaaaaggatggttgcatctgtactgaatttgtacagactttcttccttgtcattattccctaaatgatacagtatcacagctgtttacattagcaattacattgaattagggattataagtagtctagaggtggcttaaaggatacgggaggatgtgcttacattatatgcaaataccacacattttatatcaaggacttgagcatctgtggattttggtatctgcaggggtgtcccggaaccaatcttccatggataccaaggatgactgtgctcatatttgtgatcatatatgttaaaagcatctctctgaattagagagggaatctgtcacatctgtcactaatattttagaacaggccaccccgatccatctttagtgagtggagcatctctgcctgaaaacatctatatccaaatctttctttctttctttctttctttctttttttgatacagcgtctcgccctattgcccaggctggagtgcagtgacgtgatctcggctcactgcaacctctgcctcccaggttcaggcgattctcctgcctcagcctcctgagtagctgggattacaggcgcatgccaccacacccagctaatttttttatttttagtagagacagggttccaccatgttggtcaggctggtctcaactcctgaccttctctgatcctcctgccttggcgtcccaaagtgctgggattacaagcgtgagccaccgtgcccggcccaagtgtttcataaggaaaggaacttctgatacaccatagagtgtctgggaaaattttaaaattactaatggaatatgtgctcaaatattggcccctgaggaagcatttatgcccatgaggattcctgccctcaaaaatttaactgtgtcatttagatatacacaaaaaatgaatatatatgaatatttaaatgctacatgagtttaaggtattactgaccctagccactcagtgactggagattagactagacccacttattaatccacccatccactaattaattattcaattaatatttattgagcatctaccatgtgtcaggttctcttttagaactgggagtgtatcacacatttttatattaccttccatgctaagtacataggaagactcagaaaacacatatgattagacactgagaatgctattttttggtgcctttggtgataaaacgttaggatccaggaaagcaattgttaggtttgccccctcactcccaaatgctgttgctgttataaagcttttcagtccctcaaaatcacttaggaagataaatgagtaaacttcgctgcactaatttactcttcaaatttcagcatgatttatgccctgttttgtttattgctcaaataagcaaaatcagaatggattgtgtgattattttgaaatatagttaagtccagatcactttattcttccttcatcatttttttttaactaatccatctctacccaggagatgattcatcacacagctgccagggctgctttaaaataaaggaataaataagaagaaagaaagaaaagtgaaggagggccactacatagccccaaagtaaatcactgtacaccttcctgcattctctttctctctgcctgtcttcctctctgtcacacacacacctctaagaatttcagcagaatccgggacatgctggaaaatcatttgatgcgaggaattggggcttaagccaagtgtgctgccgtggcctaaatgtgcaaggtggggccagggacttctcccgcaggaagccggctcaggccagaagcccagggggtgggcagggcaggggtcatctcccccagggtttgcctctgccttgctctctgagggtctccactttgtcccttcaggctttgactaaatcttcacgcagacactggtcagctacctggccctgagcaagtcgctttgggccttggtggaactgggaaatgaagggacattcgcttcctagggctgcggtgagaaatcgccacaaactgcgtggcttaaaacaacagaaattgcccctcccagttctgaaggccagagatgtggacacagttgaaatgacagtgacagagaagggtgtggaggagaggagcggggctgcggtcacgcccaggacactggattttaaagggtgggcagagaagatcccacagagacgaggaccagagagggaggtggggggagagctgggagaaggggcagtcgagagggaggtggggggagagctgggagaaggggcagtcgagagggaggtggggggagagctgggagaaggggcagtcgagagggaggtcgggggagagctgggagaaggggcagtcgagagggaggtcgggggagagctgggagaaggggcagtcgagagggaggtggggggagagctgggagaaggggcagtcgagagggaggtcgggggagagctgggagaaggggcagtcctgaacatcaagacagagaagcagcagccgcagcatgtgcagggagagaccacccaggcccagcacggggaggccacggactttggcacctcgatggacacagaagatcttcagagaagcaatttcagctttaaaaatggatggaagccatattgcagtgggttagggacaggagagaaggtcagaaagtggccctcagatttggaccactcactggattggaccaagaccggtaggcgttgggctgatgatgggttagaggctgcgtggggaggaggtgctcatgggtgggtggagaggctgcgtgggaggaggtgcccagagatgggtgagaggctgcgtgggaggaggtactcatgtgtgggtggagaggctgcgtgggaggaggtgcccacagacgggtggagaggctgtgtgggaggaggtgcccagtgatgggtggagaagctgcgtgggaggaggtgctcatgggtgggtggagaggatgcgtgggaggaggtgctcatgggtgggtggagaggctgtgtgggaggaggtgcccagagatgggtggagaggctgcgtgggaggaggtgcccagagatgagtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggagatgctcgagtgggtggagaggctgcgttggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcataggtgggtggagaggctacgtgggaggaggtgcccagagatgggtggagaaactgtgtaggaggaggtcctagttgtctgcatttcctttgggagaacagccttagggaaaggaaagagactggtggagcaaaatccgagaggctgaggcagcataaaagtctctcctccatggaaaaacttggagccaaaagcgcacattcctcagtgaaagacgccaacctgaaaggctacactttgtatgattccaactatgtgacattcaggaaaaggcagacttatgggggccttaagcagatctgtgcttgccagggtttggtggggtgggaaggatgaatcggccgagcacacagaggtttggagacccaaaagacgtctgtatgatcctgcaatggcaggtgcaagacggatggatttgtcacaactcacagaacacacaggcaaagggtgaaccctaatgtcagctgtgggacttagttaataatgtttcaatattggtttatcaattataccacatgcaccacactaatgcaagatgtttgtaatttggaaaactgagggcaggggaagaaggaggatatgggaactctctgtagttctgttcagtttttctctaaacatgaaactgctctaaaaatataaagcttattaattaaaaatagtaataaataagaaaagtttaccaggaaggtaaatggaaagtatttgatagttctaggatggaacaaaaaaggaggtacaggaggaagtgctggccgagacggaaaggggatgcctggtcattggagactgagaggagggaggagcaccaggtacttcagtgtgtccgggaggaagccttctgcagggaagcagggaccctgggccaagctggagcctcccagaggcaaaggctgagagtgaggctgatggagagggaagccctgtaggcaaaagggagagggagtgggtgtgggagggagagccttcagtgctcctctgtctgccccacacctccttgtccctttagagtaagggggcagtaggtacaagagagatgtaaggagagcaggaaagattggaattggcattgaggacagacgtgtctcacactctgggtggttgtgatgatgggaatggttagtggtcagctgaggttggagacattgcatttgtcattcccaaaggtcattctcaaaggtcaaggtgttgatgtggaggaggtagattcggcataaaaccaagttgggcattcgctagtctgggcagagaaggagttgtgtgaggaaagccattcagtaggggattggagcagaggatgaatgaccaccaagtggctcatccaaaagggaattcccacagtggagaagaagttggaaaagtcactctcaaatcctcttttaacttgaaaggaaaagaatctgataccctgcaagaaatcaaattccaatgcaaaaatataggttcctttcataggaacagatgtggagaatatgattgaggattgagaccctaaacccagtttcccacctgacacagggattgagcccatttgtttttgctacagagttccatagagtaaacttgtcccaatatctgacatattactgggcctttaaaagaaattacatatagatagttgttgtaataacattttatcaatattcaaccattgatccttcctaattaagtgaagggttaagggaacacacatatacatctacacattcacatatatacgttgtgtgtattatattgcatggtcaaattatttaccagtttatcaatgaataaaccagcatttatggaatatctgctaggaagctctgtgctatctattttcacatacaatagattattgcgtccaaccctacgaggcaaacatgattattttcattttatacacaggaaacaaacttggatccagttactctattgcctcaagccctttgcttctagtggcagagttcagaattaaatttacaccttcttggaattatctccaccacttcacaacttcctccccacgaggaacatcctggtgtttttgaagacagattgccacgactcacttctggcatcttggagtcacttgtttaacttatagagactgagaaagattgagaggttgagagagtcactagctagcaaaaagaaaacaattacctctttggactatggtagagtttataaattaatagccattgtttctcttgattttcatgaccattctgtaggacgagggtagctattgtccccataggagaaaataagacgcagagagttgctgaaggccgtgtgatccacacgtcataaggttgggactaggatgcaaacttttgattcctggtgtggatctatggaaactcctgtaacgtgttggtggtgagggaagggaaatgcatcttagcttatggaagaagtaaaggactccttgagcacaggtgagccaggtaataaaagtggaattagtgaatcaccatcgcatattggccctagtgttcatgcagtgatggtgaatcaccatggcatattggccgtagtgttcatatagtcatggtgaatcacgatggcgtattggccgtagtgttcacgcagtcatggtgaatcaccatggcgtattggccgtagtgttcacgcagtcatggtgaatcaccatggcgtattggccgtagtgttcatatagtcatggtgaatcaccatggcgtattggccgtagtgttcatatagtcatggtgaatcaccatggcgtattggccctagtgttcatgcagtcatgatgaatcaccatggcatattggccgtagtgttcatatagtcatggtgaatcaccatggcatattggcgctagtgttcatatagtcatggtgaatcaccatggcgtatcggccgtagtgttcatatagtcatggtgaatcaccatggcatattggccgtagtgttcatatactcatggtgaatcaccatggcgtattggccgtagtattcatatagtcatggtgaatcaccatggcatattggcgctagtattcatatagtcatggtgaatcaccatggcgtattggccgtagtgttcctatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtattcatatagtcatggtgaatcaccatggcatattggcgctagtattcatatagtcatggtgaatcaccatggcatattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggccgtagtattcatatagtcatggtgaatcaccatggcatattggcgctagtattcatatagtcatggtgaatcaccatggcatattggccgtagtgttcatatagtcatggtgaatcaccatggcgtgttggccctagtgttcacgcagtcatggtgaatcaccatggcgtgttggccctagtgttcacgcagtcatggtgaatcaccatggcatattggccatagtgttcatatagtcatggtgaatcaccatggcatattggccgtagtgttcacgcagtcatggtgaatcaccatggcgtattggcggtagtgttcatatagtcatggtgaatcagcatggtgtattggcgctagtgttcatatagtcatggtgaatcaccatggcatattggccatagtgttcatatagtcatggtgaatcaccatggcgtattggccatagtgttcatagagtcatggtgaatcaccatggcatattggcgctagtattcatatagtcatggtgaatcaccatggcatattggccgtagtgttcatatagtcatggtgaatcactgtggcatattggccgtagcgttcacgcagtcatggtgaatcaccatggcgtattagccatagtgttcatatagtcatggtgaatcagcatggcatattggcgctagtgttcatatagtcatggtgaatcaccatggcatattggccctagtgttcacgcagtcatggtgaatcaccatggcgtattggccctagtgttcatatagtcatgtgaatcaccatggcgtatcggctgtagtgttcatatagtcatggtgaatcaccatggcgtatcagccgtagtgttcatatagtcatggtgaatcaccatggcgtatcggccgtagtgttcatatagtcatggtgaatcaccatggcgtatcagccgtagtgttcatatagtcatggtgaatcaccatggcgtatcggccgtagtgttcatatagtcatggtgaatcaccatggcgtatcggccatagtgttcatatagtcatggtgaatcaccatggcgtattgggcgtagtgttcatatagtcatggtgaatcaccatggcatattggccgtagtgttcatatagtcatggtgaatcaccatggcgtattggccatagtgttcatgtagtcaagatgaatcaccatggtgtattggcgctagtattcatataatcatgatgaatcaccatagcgtattggccatagtgttcatatagtcatggtgaatcaccatggcatattcgccgtagtgttcatatagtcatggtgaatcaccatggcgtatcggccgtagtgttcatatagtcatggtgaatcaccatggtgtgttggccctagtgttcacgcagtcatggtgaatcaccatggcgtgttggccctagtgttcacgcagtcatggtgaatcaccatggtatattggccatagcgttcatatagtcatggtgaatcaccatggcatattggccgtagtgttcacgcagtcatggtgaatcaccatggcgtattggcggtagtgttcatatagtcatggtgaatcagcatggtgtattggcgcttgtgttcatatagtcatggtgaatcaccatggcgtattggccgtagtgttcatatagtcatggtgaatcaccatggcgtattggccatagtgttcatagagtcatggtgaatcaccatggcgtattggccatagtgttcatgtagtcaagatgaatcaccatggcgtattggcgctagtattcatatagtcatgatgaatcaccatagcgtattggccatagtgttcatatagtcatggtgaatcaccatggcatattctccgtagtgttcatatagtcatggtgaatcaccatggcgtatcggccgtagtgttcatatagtcatggtgaatcaccatggtgtgttggccctagtgttcacgcagtcatggtgaatcaccatggcgtgttggccctagtgttcacgcagtcatggtgaatcaccatggcatattggccatagcgttcatatagtcatggtgaatcaccatggcatatcggccgtagtgttcatatagtcatggtgaatcaccatggcgtatcggccgtagtgttcatatagtcatggtgaatcaccatggcgtatcggccatagtgttcatatagtcatggtgaatcaccatggcgtattgggcgtagtattcatatagtcatggtgaatcaccatggcgtattggccgtagtgttcatatagtcatggtgaatcaccatggcgtattggccatagtgttcatgtagtcaagatgaatcaccatggcgtattggcgctagtattcatatagtcatgatgaatcaccatagcgtattggccatagtgttcatatagtcatggtgaatcaccatggcatatcggccgtagtgttcatatagtcatggtgaatcaccatggcgtatcggccgtagtgttcatatagtcatggtgaatcaccatggcgtattggccgtagtgttcatatagtcatggtgaatcactatggcatattggcgctagtgttcataaagtcattgtgaatcaccatggcttgttggccctagtgttcacgcgatcatggtgaatcaccatggcgtattggccctagtgttcatgcagtcttgcaaggcactgcatattatttccagttagcatttatgggaatttacatttgtcgtatcaaagaaaagttaatcccctgctgtttctgaatatcttagatacctactgaaaatcataatctaacaaactgaatttcaatattaagtaaggcaatggagtttaagtctttctgatgtcccactctgccctctgtgcttagaaaattccaaataaacacaggtcaagtgaatttgttaggcttgtctctaaactttcaaaaggatctttgctgagagccacctctcgaacctacctttatttactaatttatttgtttgttcataggcacataatgagggcctgtgctgtgctccatatggaattctttttttttttttttcagtttttaaaatcaagatcacagtatgttgggagggcaattatctgacttttcattcctatttaggataatttttaaagccaatgagatataagctatgaaattctttttaaaaactttttattttgaataattgtagacacagaaaagttgcaaaagtagtgcaaaaaaatctcccatatttctcatgtcaccactcctagtgatagcatattgtataactttggtataatgatcaagaataggaaattaacatgggtgccatattgttaactcatctacaggcctcatttgaattctaccaatttttctaccaattttctacctgtgtcccaggaccccatgctgcctttagatgttctttcttcttagcaccctccagtctataacatttcctccatttctccttgtctttcatgaccttgcacttttgaggaggactggtcagttatgttgtagtgtccctcaatttgggtttttcccagtgttttctcatgattggagtaaggttctgcattttgggtaaaaaatatcacataaatgattatttgtccttcccattgcattatatccaatgggctccagtgatgttggccttggtcatttgcttaagtggctgtctgccaggtttccactgtaaatttgatgatttgatttatttaattatttatatcagtaaagactcatgggtatttattttattctatgggttaatccagtactaacattaatttttgttgttgttgatcaaactgttctagtatgagtcattagaaactcctttaggttagctttcatgttctctcaataaacccctatttttttagtattccattgctttctggtttcctaaaatattcctgactcattctgtattttccctgccccagcccagatacaattgctcctcccagaagccctattttcttttactgggtgatggtatttagacaccaagatctgggtgctaactgtgctcattgctactggggtgtcattgtttctaggccttctcagtggacagacgcaggacatatttgtatgtatactaacccatggacacacacatatctatattttggatctatctgtgtacatagagattaaaaaccatgagtttatacagatacctctgatttcaaacttcacagtttattttagtgttccccttttccttataacgttttttttcaacagtgaaaaacctggctttcattatctccaatatatttacatatttgtcccattctagcatgcacacagtctcaaaattgatcctccaaacccctgggagaaacaaatttactcacggaactacagagaatcttccttctctcagcagtcccatctttccaccctatttccacctataccctataggtaatcaatctggttcctggtttctgcttcctacatttcctttttcacaaaagactcgattcatatatattctcatatccctttcttctatgatatataattatatcatactatatacatacatatatgtgtgtatatatatatatatatacacatatacatacatacatacatacatacatactataacacatactcttgggctttgttaactctgacatggaaatcactccatatctgtttatagagttattcattctctcttacacctgcaccctacttcattgtattgggggggtatagttttggggggttttataaattgacaaatgataattatatatatttacagggtacaatatgatattttgttatatgtatacattatgaaattattaaatcaagctaattaacatctctatcacctcatatacttatcttttttcattgtggtataatagttaacatctattctcttatctattttgaaacatgcattacattcttattaactataatcaccatactctgcaacagatctcaaaaacttattcctcctgtctaactgaaactttgtatctttttatcagcacccccccaatccctcccactcccagcctctggtaaccactactactctactcactgctcaatactattcagccttaaaaaagaaggatgtaccgtcatttattcaaccacatattgtttccaatatttgcaactacaaataaaactgcaataaatacaaacttgtgcacatgtatttgtgcattgtttgaggtgaattctctaggagtctagaagtggaagtgttgggctgaaagttaagtgtgtactttattaggtattgtcagatgtctctctgaaatgattgcaccagcttgcttcccgacaagcaagtctgagagtgcctgtttccctacagtctccccagcaccatgtgtcatacttttttcttctttttccaagtctcataggtgagaaatgatatctcaattaattttaattcctacttccttaatttcatatgtatttgagtacctttcatatgtttgattgagggccatttttatgtctttttgtgaattgtctgttcatgtctttttctcatatttttatcttttttttttataaccacatttttcaaagtattttgtatgttagggatattagccatgtgttgtaaatacttttctcctggtttgtaagatgtcttttgtttatgatgcatctgtcatgcaaaagttttatgtttttatgtagtccaacttattaatcttaatttctggctcctgaattttgagtcatcaaagcttttctctacaccagggttcaagaggaattaacctatgcttatgagaatactttgaaacatcataacatacaaatgttggctgggcacagtggctcacgcctgtaattccagcactttgggaggccgaggcagacggattccctgaggtcaggagttccagcctggctaacatggtgaaactctgtctctactaaaaatacaaaaattcgccaggcgtcgtggcaggtgcctataatcccagctacttgggaggctgaggcaggagaatcacttgaacctaggaagcagaggttgcagtgagctgaggtctgccactgcactccagcctgagcgatagagcaagactccttctcaaaacaaaacaaaacaaaaccacgcaatgttaaaaactcatctattaacagaacctgcaatattaggactcgcttgcatcttccgatcactgggcagctgccttcccagctggtttctaagcggcaatgtcttctctgaattggcatcgtcactctaccctcaggcttcctggcttctccaaacccagacacttcatctaaaactacctggggcattctagactctctagcctcccccatctgtctttactctaaatgtagtccttgtttttcctggtagttttattcagccgttgcttttgtattttctattgattccagtccaccatgtccttagccccttcaccttccttcccttcctgcctcatctcctttgttcatgcaacccctgaagtgcagcatcctccctttccaaaggccattcaaccatttctttctacagatgagtgggtgcattcccagctatgtgtatattttatatatatatatatatatataatatacacatttttttttcaagacagagtttcgctctgtcacccaggctacagtgtagtggcatgatctccgctcactgcaagctctgcctcccgggttcacgccattctcctgcctcagcctcccaagtagctgggactacaggcacccgccaccgcgcccgactaattttttatatttttagtagggatggggtttcaccgtgttagccaggatggtctcgatctcctgacctcgtgatcgaccgcctcagcctcccaaagtgctgggattacaagcgtgagccaccgcgctcagccccacataagaaattatagctaagtgatagggcgcttacctgacagagcccagcagactcagcagaacacagatatcattcttcacgtggaggggtgtcatccaaaagaaacatgaaaatgaatcttttctacacgttggagacagcagtagctacaaaatatactgaaatatttaatacttataaaatgttagcacttttcatttttcccaccatgacctttactcactataacctttaagtacttagagaggtttttgttgtggtggtattggtatttaatcagtacattaaggataaaaaatataaggaggtttgaaaggaaatacatctttcaatttatccccttcctccctctctctctcgacttgtatctgtcaacacaaaccaacacaaaacctgatgccaccaggtttgtaaggtcataatgacctgcgttatacctagaaaaaattatcttctaggagaaccaaagatggagatacaaattgtggaggtagatcactgcatggttctgcattttaatttttaactttgactgttctggagatttaagaagttgatccaaagacctcactgcatgtcctctcttaatgagtatttactatttgggttaagcaatgatggacctatttcagcttcatataaattatatacatctgaagaaacctaatagagactaaatgagacatattacttagtaacacaagagacaagctcttgaaatggataccatggaaggagaaaggagttaagttataggtaggggataaaattgcagcagcttaaattcttggttcccaacattttgctttgtttttgtttgtttgttcaattttcagggatcctcaaagtctggacccaccagaagtcagcaatgcaaaacttcagtatgcaggatggggccctaaaggccaacagctggtaagccaatcaagttcagtaactatacttgggttttgaggaagtttctgttttctaagctgaatggatctcactgtactcagcctgtacatggtgttgtgtgtgtgtgtgtgtgtgtgtgtgtgtaaattaaaatctggagaggtacaccagggtgtctgaatatgtaaaagggtcatttctttttagatagcaaattctcctaaaattggaacagcatgtgcttggttcctacatctgacatggttaaagtggtgcctaactgtagctgtgtctatggactccagatgaatcatgagctcaaagagatcaacttcattaaaagaactgcagatgagaatgatccgaatgattttgtcatctaaagatgctctgggaactcagacttcttcctgtggagggtttttttttgttttttgtttgtttgtttcttttgagatggagttttgctctcgttgcccaggctggggtgcagtggcacgatctcagctcactgcaacctccacctcctgtgttcaagcgattctcctgcctcagcctccccagtagctgggatcacaggcgtactccaccacacccgactaatttttgtatatttagtagagacagggtttcactatgttggccaggctggtctcaaactcctgacctcaggcaatccacccgcctcagcctcccaaagtgctggcattacaggcgtgagctaccgtgcccagcctctgcggagggttttttaagcaagtagatttgctggccctgatggagccaggccagtcccgtcaacatgcaaaaccccccgtggtcattgcagccttctcggtttctatcagctatcttcatggattccttctcaaattggcaaaactgctgggtttctgtgaatgggaaggacagtgcagagaaaaaggccctgaacactatttctaagatgagggctcccaccctggttctcactgccgagctggccttggacagcacctcccgctgtcaggctgtaggcagcagcccagccatgtagtgaagaatttggataatacggtccttcaggtttgttccaactctagccttgcgtttgactaaaacttggttatatttgtccattctgggtaacatttttttaagacattgtattgccacgtgcagaaagtccctcaggtttgaaggtcagatgacatggttgctgttttcaagtcaccattttcttctgcctctttaagctgattacctaagcctgcatttgtaaagctcctttttcctaaaatagcacaaaaaatgatcgtatctaaaagctcccacagaattgtatcggataggctgtcatctatcttacaaatgaaaatagtcttatttctccccatagtacaatcacattttcttggttatatattaattccactgccttgaattggtttgaaaaagcaagaagatcgaggcggtgaaactattaatattttagctattattaacatgtctctaatgctaaaactgataacagaggttttgaaaagcatatgtaactgatcaaaatcacagggtgacaggaggaagtgaggcagctgagagctgaccttgaccgaggaacaccaatccatcagttcagtcacaacaaagagacaaaatttgtcttttctcaaaggcattaactcttacacagggaaaaaaatgcaatttgataagagattgtagaagatctaagttttcaggactgatgcgcaactgaatctctaatagttgactttaaaaccctctgaaagtctgtgattgaagagattttcaatatccatcaaatcatctgtgaaagtggccattacacctccatagagagctctccctgcctgctgcggatccattacaagccagtacccacagctctgcacctggcctcatcaccccactacagggagaaggatgggaatgtgtaaccttactgagtgatcattgtccagcctttttatagtagtcaggagaagaccatcataatgtgaccacatgtcaaggtctctttccaccatacctgcggcctcgcttcttatcacccagcggctgtaactcagtgtgtggactcctgcctcattgtctgcacatgcaaataaaccgggtcccgtagtagagttggtacttgtcctgcctctgggaacagcttgtaacataaaggaaatttaacccacaactgtaaaaggagttgctgtgcatgcatatgtgtgtgtgtgtgcgtgtgcatgcacacactttagaattaagtctataattgtcctcttgaacaactgaccttcactcatgtcatgctccgttggagatgaggaggggataagtgattatagaagttatcttgtttaacctcttacagaataagtagcaacaaaacaaagtaaatgacaacttctcagagaaggcttcctgacacctcccccaacacacacatgcacacacacacacacacacacacaatggtagctagccatcctggggcttcaggtttcaccgtgcaatctcccagcacacatgatctcttgttgcctgtagacatgtctctctccttggttaggtggtgatatggtgtggctctgtgtccccacacaaatctcacctttgaattattataatccccatgtgtcaatggtgggaccagatggagataattgaatcatgggggcagtttcccccatgctcttctagtgatagtgagttctcacgagatctgatggtttccccctttgctcgacactcactctgtcttctgctgccctgtgaagaggtgccttctgccgtgattgtaagtctcctgaggcctccccagcaatgcagaactgtgagtcaattaaacctctttcttgtataaatgactcagtctcaaatatttcttcatagcagcatgagaacaaactaatacaggtaccctgagtccacacagtgagactgtttcatcttcgtattctaacacacccagcacagtgtctggtgcccagtacacatttgttgaggtaaaagatgaaagcacaaacagattgattaattcattagttaatacatttttgtggtttcaaaccacttcagcatgaagaattggatggtggcaaatagccagcatctatgaatatgttctaggacagtactagaggtgacagaaatttgacttcctttctgcttcaaagaaatgaatgttcaggtaagtaataactgttaatacttgagtttagtaccaaaggtgctatatacttgtggaacttttgagtttttaaatccatttgacctttaagagcgttatgatacatgcatgtactgagcttaagacgcaatatagctcattgttgagtgagtaccctatgtgctggagcaggggccgccttcttctgcagaaggtcagatagcacatgtttcagtctttgcaaacagatagtttctagcacaatgactcatctcccttactgcagcatggaagcagctgcagacagtatagacaagatgggcatggctgtgttccaataaagctatacttcccaacacaggtggcttggcctatgggttatagtttgctgacccctgttttaggggatcatatgctgtcttggttgttctcatggggaaagcctgaccccagagccaccacctcatcacaggtactccccacacctgctccgtctgcacagaaaattcacaactcaagagcaggccttgcaagccctaacctattaagtgatgccaagcaacacacccctcattgccattttattttaaaaagtaaatattgctccctaaagtcaacctactctaattataatgagtcagattgaagtgagtaattctcctttgggagcagagaacacagctgcagttgaggtttgcaaagagctttgggaacatgtagcctcctgtgctgactgatttcagtgatgcctttgggtctggagcccctatatcacaggtgatgacccagggaaccagggatgggtgagggcatcttttcccagtgcctcgatgtggttgccaattagctcttaccttttagagtaagtgttgtgagacccatagaacatttctccggtagtaatgactgcagggggagtggcctgtgtgttgttagtggagtgggtgggaggaggcccccaggctgccagaagccacttctgtgatgatgctggtctggggctggagtttatgacaaatgacaagattgcttccaaacgtttgctgaggacccaggatgtgatctaggaaatagacttggccagattaaataggattaaatgagaaatcctaggtaaaatgttaacacagtgtctctcctttgcttcctcttcctccaaactggagtggtcagtcgggaaacataaacgttcaaaacatatgctgtttcaacgtatttctctgtaccacttctttcctcattgtgtcctcttcagatgaatctgcctgaactgagatttcctccatgtttctttcttttttttttttttaactggaatctccctctgtcacccaggccggagtgaatgttgcgatctctgctcactccaacctccacctcctgggttcaagcaattttcctgcctcagcctcccaagtagctgggactacaggtgtgtgccaccatacgtggctaatttttgtgtttttagcagagatggggtttcaccgttttggccaagctggtcttgaacccctgacctcaagtgatccacccacctcggcctcccaaagtgctgggattataagcatgagccactctgcccggccatccatgtttcttttctttgatcttttcatgaagtcctgcccccgaccatgtgtttgtctgtttatgggaggttttgtttctgctgacctagaatgtgattagttgtctggtttaggaatgtccacatatttcctgatatggtatttctattagagacatttcctggaagcacacagactttgaggcagccgcggtggccttccttgttcttggcacatgcacttggagttgaagctgcctcagggtgcatttgctggttgatctgcaaggggagggagggcatgtgaatttggtgcatcatcacgttttcctttggaaacaagtgccatggaaattttcccaagaaagactgtgcagcattaggcaacattaagaattcaaagccggaatctttgctggtacactcggaagatcagagacaaagtgaatgggtctctctttggttggcttgctaccatgatagtgataaatgaagagctttgaatgggaaatttaatgagtccattgggaagtcttcaacgcagagagcgtcaaaatgtgacagatgaagagcagtggagtagttagccgggaaacctgctggaactggggagagagctgtccccaagagatagcgttccccaaaggagcaggtgcaattacaaacaccatggagggaaactaaggaattctcacagccatgcttcacagcttagaaggaaaggccaacttcctcatcatctccagaccaagagaggctgaggggtggtgaatatcagtgagcaactgtcctgtgtcagtcaggagaaaaacatgtttatcaaaatgggagatttgagtcagactttaagaagaattgccttgattatatggcattttagatcctggaatagttttccacagaaggtcacagaatagtttatcggagaacgtcaataaatccgcatttaaattgtgctgtgttttactgcatgttctcactcataggtgggaattgaacaatgagaacacatggacacagggcagggaacgtccacaccggggcctgtccgggggcggggggctaggggagggatagcattaggagaaatacctaatgtaaatgacaggttgatgggtgcagcaagccaacatagcacatgtatacctatgtaacaaacctacacgttgtgaacatgtaccttagaacttaaagtataataaagaaaaaaagaaaaaaaattgtgctgtgttttaatggttaggatggcagctcccttggtgaagtcttaggagcaggtagactggactcccaaagatgttcccagccctagggctctctggaatggcacatgtggccagcgattgccatggtcacaagctagcttagtgcacgggaccctgcaggccggtcctgccgtgcatgtactttcctgtcattctcttatgcactcgtttgtttacggattcaatcaactcttcttgaatacttcctgtgttctggatactgcctgatcccggatgcagaagaaggacatggtccctttcctcactagcttctgcttctgatggcacattcacctattggcacattcactcgctctccccaaccgcgaatgctgcccgttgccctgctctggcacggtcactctcataactgtccccgtctgttcacactgcccaagctttcctctcctgtccacagcaggggctgtcacactatgtatttgatattcttctcatttttcaccaagatccttagatcctcaagtcttaacaaagtgatgcccctgaaaacaaagccatccagacaggcctcatcgcctaaggggtcattccgtacttgcttgatacagggcccatgaggccaatccagctctgagaaaaacttctctccaggggcggggacatggccatggggtgtgctgtctggaggtccagctgtccttacctcctacacaggtgttccgggctacagccttgcagcatgctgtctggaggtccagctgtcctaaccatgtgacctcctacacaggtgttccgggctacagccttgcagcgtgctgtctggaggtccagctgcccttccccatgtgacctgctacacaggtgttccgggctgcggccatggggcgtgctgtctggaggtccagctgcccttccccatgtgacctgctacacaggtgttccgggctgcggccatggggcgtgctgtctggaggtccagctggccttccccatgtgacctgctacacaggtgttccggctacagccttacagcatgctgtctggaggtccagctgcccttccccatgtgacctgctacacaggtgttccaggctgcggccatggggtgtgctgtctggaggtccagctgcccttccccatgtgacctgctacacaggcgttccctgactgactcacacagacactgtacccacaccctgcaccggccccaccttagtgattgctacaccctctcaagcctgtggcagttgtggctctctaagccacacctcagtgtgaagcgggatttaaggaaccagagagaccggatggagtgcaggagggtgtttattttaaggtgtacacaggcccagtggacatgtgtcctaaaggctgagcccagaacaaagaaaacgagtcccttttaagcattttgaggcaggaactacgtgaagcaggcttacagaagcgagaactaaaggctgctgtgacacttttgcaacatggcttacatctctgtgagaacttggtttgcggcttgtgcttatctgtcttgtgaccttgcagttgtggggggaagaaagaaacaggagtttacagagcctacaaaatatgtggaggatagatatggttattgtttcttgggacagacagttaatatactcttctaacttttaacttcagcggggctgcttaaattctcctcagccttggttaatacagaatttcattctatgagctattgttatttttcttactattattataatttttactattactacttatgctattattctgttgttttcttaatttcccacttcaagtggacggagcccattccaagcaaactattccaaggatagctgtttttcttcttaatacgccaacagcgagagagcgtgagccttcctttacctacccatgagcatctgccagtgatccagcgggcactgcttcctcccagaaccgtgtcttgacacttttttctatgaatcagtgaaagattcaagaaaattggagttgaggggttttttttgcactcgtgctgacttaccttatggcattggggtttttgccttcaataaaaataattttttaaagtagcccattaaaattgtaaaaatccatgccttcaaaatgtcagtaattcaacctaagatatggaggaagagcttgcgcttgaaactccaaaacgctttgttagagggacgaaagggcagtttgatagcagatcggagggatggagggcctttgcttcacccatcgctcacgtgtgggcgtctgcacggggaggagcgcgtggggagaaccatcagatttcagtgtgacagggaggccacgtgggtggcactgcagcagcagcacagagccagcgtgagggcaggctgggtgcagccaggagccagctgggagtgggaacccagccaggcctgggatgtggaagcccccactgagaaactcccttgtagggtcccaggccacctcctcagcctcagaatgggaaggtcctaggtaagaggtgaagccggctgggcttctgggtggggtgcggacttggagaacttttctgtctagctaaaggattgtaaaggcaccaatcagagctctgtctagctaaaggtttgtaaacgcagggatcagcactctgtaaaaacacaccaatcagagctcctgtctagctaaacgtttgtaaacgcactgatcagcactctgtaaatacgcaccaatcagtgctctgtgtctagctaaaggtttgtaaacacaccaatcagcactctgtaaaaacggaccaatcagcactctgtaaaatggaccaatcagcaggatgggggcgggccaaataaggaaataaaagctggccaccgccgcccaacagctgcaacccgcagctcgggttcccttccacgtggaagctgtgttctttccttcttcacaataaatcttgctgctgctcgctctctgggttcgcactacgtgtatgagctgtaacactcactgcaaaggtctgcagcttcacttctgaagtcagtgagaccacaaacccacagggaagaacaaacaactctgggcgcgccacctttaagagctgtgacactcactgcgaaggtctacggcttcactcctgaagtcaccaagaccacgaacccactggaaggaagaaactccagacacatctgaacatctgaaggaagaaattccggacacagcatcttcaataaccctaacactcaccgcgagggtctgcggcttcattcctgaagtcagcgagaccaagaacccaccagaaggaaccaattccggagaaacttgttttaagcgtgagaaggaaaagaatattttattttgtttgttttgctcttaaagggtcattagtaacaaaagctttggagtcaaaagggccagattcagatcgtggttgcagcacttactagttgcgtgaccttgactgagagacttaatccctgagcttccatctcttagtctgttaactgaagtaacagtgcctaccttgtagggctcatggtggagagtaaaataatctactcgaagtacaggctgtggagccttgtgtaaataacgttctcaataaatgtctttgattgttgctgcttttactatttgggttaatcgtctgagaatgagaaggaaaataagcatttcatcagatggaagtctggtgtgtgtcagaaggagagttgggctgcccttgataaagcagagaaacgcaggatagagacagaagctagggttggtgtccagagggcttcatgacgggccagcccccttgtccatcaccatccacagtgtacctgtgtggactcacaccttgctcttctcccactcttagggagggagggggaatgttcagaaaacaacatcaatttctacctcctgaagtcgtcagccccttgtaactattcaggagcctgtggctttagaaaaggccattgtcaggtgacagcaattcccctacgctaatgccacgccagaaattatcccttgaatggagagagtatgtttcttataagaagctgggtgtcctgcttcctgtatccagtccaggaagcctgcatccggtccgcagttccccattaccacctgggcaaccaccagggagctgagcagaaatgggcccgtcgcctcctcctacaagttacagcctggctcagggttagcgctgcccacccagtcccatggctgtagcaaagggggcagggagcactttactgaagtggacaaatccagcgaggggaggaagattgatctttccagcaagaggagagtctttaatgaaatgtcctatatgtggagaagaccagactaaagtgacatcccattaataacttataaaagcctctaatcagcttgggttaatttggtattcattgtaaaaacattcatcatgggcactgaggtctgtgacagtagccaagaaattaatatcccacggatggaaatggccttctgtaccctcagataatggatggagacagtttggtgagtgatttgttagcactaccaaagggacccttcaaatgtaacacaatatgttatcacttcctggctctgtggggctaaatcactttaatattcacttgcactcaagtaaataagctgagtttttggtaattaataggaatggatggggtcgtatgacagagatacctgatggtcatggttaaagagtgaggagaattaggaaataattatggggccctttcctgccaccaagaggctcttctcctgggatacagggatttcagaaaggaaatgcgtaatcataggattatgggggaagtgagagaagaaaaatataagtaggacatcaggaggaggtggagatttgttttaactctgtgtaaatggaggaggcataagagaaaatttatttataaaacaatatgaaaatatgcagaaagagtcatcaagacattcctatacaagatcacagaaatccctctaaaaagaagcccaaagctatatcaacaaacacattcataacactgttatccataacaggaatttctaaaagctggaaatgtcctaagtgttgagagctgagccatttgctaaatcatggagtatccataggaagaggtattatataaccatttaagattatgattaggaagactgcatgggagcatggagcatatatcatctatcaaacaatagcaggactaaaaataagccatttggtatgttggcatatggaaaggattagaaagtaatatattagtcaaaataattatttggactggccagactgggcttttttcccccttctaaaactttcttggttaaagcaacattatatatatattttttttaaaaaaaaattaaaaagagaagaaaatgtattgttaaaaatgggatttaggaactctactcaataaacatgtgctcaagtagtgttgagggtaaagaagaggcgctttttgcagagaatccaaacatgaataagccgcccatcaccctccggggatcacagtgccgttaattccaccggtttgaaagctctgttgcaaacccttcagagatattttctgggactcactctctttttgaaggagagaaagcagaataacaaaattcaaggtcacagattatgagtgtttaatatctaaaaattatttttaattgataagtcatcatcgtatacacttacgggatacaagaggactatagtcaataataatgtgttgtatatttcacaataagagaatacatttcaaaaaaaaaatggtaagtgagccttgagactcactcttaagccagaacaaaattaaggaaaaggtggatgcagggttaaaaccgggcctgacctgcttgcccacgttggccggtgaagataaaccctattttcttcctcatagcttccttaattcaattgcgactgaaacagtgtatcatttcttaggaataatcaaatttagaagggtgcccccacatcagcctcggcaatattaggttagagaatttcaagatcatttatcaaatagaatttaaagcaggaccagagttgtacattaaggaagagtgcacttagtgatagattcttgagagaatataacaaggcagttagttataaatgaacataaccttttgagacctttggatgatggggcgtggagccgcaccacacttgcggccatggcagatcctgtttctcgtcctgtggagggagcagcttctgaacatttggaggcttttccggtcgcctcgggtagggcgggggagggctgtactcggtgctgccaagaattctccttcgtgcacctaatcgggttctgtagattactttgtggaattctcccgtttgggtggagggaacacctcttcatcataattcctaaatgtttcaccattggaaaatatcaaagtaaaggttccatctcctggtctttgtagaataactgcgaccttttcttcctttaaagtgctgaaatactgtcagtcccacttactgtagcagttaatcttatgcctctttgttttattattcaactattttgcttttgaataactttatttcccagaccaaatgtaagctgttgaagaacaaagaatgtttttcattagacttttgtcttccacagcccgttgctcagcattgtgcagagtgtaggttctcaacaaatacttgtgaaatgaatgccatccagaagggaaagtaaaattaaatgtcagatttatagacataaggtccaacattcatggaaattggaaaactttgacgttataacctaaaatttttgagatttaacaacttgtctgatggcaaattaattcagcagttcagattcagttcagattgtgagcaataccaaggaagaaaatctggattttcgagtcagacatttgtcttaaaatgtttgttatgctgtgaaagatcttaaaaggaagatagagagtgctcctgattaaaacctgtcaggatcaggctgaactcaacaaggcgaaaggacctgaacttcttgtctttccaaggacgtttcagaggatgaaagcgcctcacttcttgtcccactaggacaccgaggtgatcgtctccgcagtgtcataaggaacagtgaggcctcgtgggcttgtgcccctcacgcactctccggtttgaaattggggtcggccctcattctaatgccctgtgagggcctcagaggttattgtctgggttgttaaacgtggagacagagagggcacagaacagaagataatttgctcacttaaaacaagaggtttctaagaacgtttggagaaattttagtgtgtccaagtcagttatttgtgaatgattcttctggacctttctgcaaagtagacttcacagggctcctcctttgcagaattttgttagccctgattgattattagaggttaattatcaatactggatactaacgtacttctgccctttgacgtgggtatttgcacagcccacgaggttttatttcacttctctgatgtgtggggaacacagtgccttactcgtgctagagcagtgatagacgtgagcacagataatcaatgagtcaatttcaatgacagaccactttggtttttttttagactgtgggttttacttttgttcttttgtttcatttttttgttgttgttttgttttgttttttgtgtaatagctcacatctagttcagctatttccactctaaaaaaagttagcaaattagtgaattgatttttctgtttgttcttcagtttgaaaacctcttcatttatctgaatggttttagttttccctttaatggcttttatggccaggaactgtttgaaatatgttttaatttcctccattaggccagatttaattaacgtacactatgcatgttggtgagctgagtgtgccgtctgacctccagcctagatcgctctagagcctgcgcctgtcccgtgagtgtgaggccaactgtgcactccagactcagttcattcataaatctaaactcactattgtttctgccaaagctctgccctgtaagtggtaccaccatctcttctgtgccaggtcagccaaattcttgactccccttcctcccccaccggcttgatccactatacattttatgaattctgctttcttggtatcatgaaaatccaccttcttctttctgttcccaccatcacctcatgcctaggttcctgtaacagctgccttcttggtttttctaccccaaaactacccctactccagaatgttctccatctctcactgagtgatctaaaatgcaaatataatcatgtccattttcccatgtaaaatccttccactgttttccactgcctttaggatagaacccaaaccccttcacatgctttgtgaagcccacctgaggtgccatcactcccctgacctctcctgccacccagtactcccaggctggagaccagccataatgagctacatccagttccgcaaatgtcccagaccacctctcactgcgaagactttgtatttgctattcacaaagtccagaacacactctttttttaaaaaatgttttaaaagaccatgtctagctctatcacccaggctggaatacagtggtgtgagcatggctcactgcagcctcaacctccttggctcaagcgatcctcccacctcagcctcctgagtagctgggacctcaggcacgtgccaccatgcctgtttagttcttgtattttttgtagagatgggggtctcactgtgttgcccaagctggtctggaactcctgcactaagcaatccttctacctcaacctcccaaagtgctgggattacaggcatgagccactgtgcccagcccaggacacactcttaatcccccacccctcacccctaactccaatccctgaagattgggcttgagacccctctgctctgtcccctgccactctgccattgccttatcaccacactcatcactctctgcttttgtgacctgtttccttgttattctcccccagccaaatccaagctccttaggaacaagcacctctcgtgttcactgctgtgtcctcagccactttgtgtagactgttagtaagcattaaatacgtgttcaaaggttgaatgggtgactcagtcaattaaggcatattatttacccaagatgaaaatcaattacttttttcaatttaagcgtaaactcgatttatgaatttttatgaaatttgtttctgtgttttcacctattggagatgttggctgacctttcatctctagccacaccctgtggcatcctcctttaaattttagccttttcagccaccacatgggtcccaattaccatgacaccgtgttcaaacccaggctcaccagtttctagttacccttcagataaaaaggttatgattgcacgtacatgtatctatttaattaagctagttttctccatggccatacaaagtcgtgtttctaaaattagctgggtgatctgactgtttagtggaacttgagtctttagaaggtcctcagataccactgctgtctacttcctgtaaatctaatcatcacaggacaaggtgcaggataggcttgcttagggaatgctgccttttaaatttcctatgttactgcatgacaagattagttgactctgataactccctacaaaagactcagaataataaaggaataaattaatcagtcaatggaaaagcaaacgatctataccaggctgatgaactataatagaacatctcattgttacacagagtcagccgtctcccactgccctgctgaatcctatctgaacagtaaatctgtgttgtaacagagccagcatggcaagcagctgctcagctggcctttcccctcctgtctcataaagaaaaatgccaatgtattcgtaatttcccagtgaggtggcagagtctgtaaatccttttttccaataaccctaaaattttactagccaacggttcaacagcctggtacacatttagggaaacaaaaggtttatggtggcagatgattgtttagaataatgtttcttaactcagctacacttcaacttgtgtaactacgaatgctgtggctgcatgcccagaggctctggttcgtttggaccagggtggggcctgggcgtcagggtatttgaaagctccccaggggcttctgatgtacaaccatgtctgagcatcctgggtttagatgcttacaggcgggactgggactggatgacctctttaataaactttgaagtttcaaggtcaacattccaacttcataataaaatatagaatctcttagattatatttttaatcaccaggcccatcacaagggaggtgctgaatataaaattgctggtcattaaaacattgccagggaaattgttgcttcaaaaaggcagctgtacttccttagatcaacatgcatggcttggccacgttgtagtttactttgctcctggtcaattcaacttaattcaactcaaagttaagatcaggatgtgataaaattattttgttttctttttctttgaatcctggatgagaagtcattgtccaaatcattaggtgttttatgcaatattaccaatctttagtgtgattttccccccatcaaacctataaacaataaacttttctaaaagaaagcctgccatgatggaagcactgggtttcagacagcaagtctcactgcatggctgtgcaggttgggacatactaacttgtgataacagcggccttttagatagggctcacaatgttcccaccaccatgctaggcactcagtgtattactgtctcttttgctcacaatatctctattcagcagtgagaaaatagaaattcagaaaatggaagtaattttccccgggtcacatatcagggatggtgtcagaactgaaactgaagaagtcgtgtcccagcttcttcctttggaccgaactcttaagtctggactctgttcagaatgacttctctcaagaccaaatgttctcaagtctatgagaagcctttgaacacctcttaaatgcactgtaaatacagtgttattaccatgaacgtgatatttgtatatttgtattcaaggccaccataaggatttttttttttttggcaatgcacagaagctggatgtctcccgatacagcatctggtgtaattaatccgacacccttatctctccccactgagcattctcaaagggaatgaaacattgacctaactgatatttccctctaaaatctttgcaggttccataaatgagctgtcagagccccagggcagacactgaaccccaactggaataaaacgttcctcctggagagggtgggtcagttatccagcacagcattcctcacatcccaggggtgtgcagagccctttcagagctggatcaaacaaatgaagcttgtatgtctccttttccagggggtgacctaagtatttgatgttagttttctacgcttcattattttttttatttcggatgcattttaaatgttaatgaaatattttatgaataaagagtaataaaatgagcactcacatgccctccagtcagcatgaaatacagagcattcccaagcatgcccagagctcggactccaggtccaccgggttccgggtccctcctccaccagaccaaccactcctctgaattttctttatgtttccctgccatttatggatctctaaacaatataccatttacattttgaacattatgtaactgttaccagacagtatctatactcatgtgacttgaggttacatcaacatagtatagatactgtctgtcttgtcactatacagtaacatgagtgtagacgcttgatgtaccctgagtgtacatactgtctggtaacagttacatcaagttatataaagtctcctatattatcttgtatgaacatgtggaagcattagctgtaattgagtctttttcagttttctgtcatagtccattatacaaatgtatcacaatgcctttatccagtcctttgtccatggatatttagttttctatttttaaatgtatttacagttttgctatgtgcattttgctcatgttttctggtgcacatgtggcaaagtttctgtaggttttgctgtgtgtatatttcattactgatggtgctgaacatctttgcatgggtgcattttctattcatgtcacaacttctgtaaaacacttgttcatgtcttttaacctatttttccttcgggttgtttgcccctttcttattgatgcgcatcatttctttatacatttaagattcaattatttgtcaattacattatttccaagatcttctctcattttacagcctgtcttttcactcttattttgatattctttggcaggaagatacattgatttcaatgcaatttattcctttatggtttgcatttttaagtcttcttgaagaaattgtccctaccccaaggacatagtctcgtagattatcttgtaacatttttttactttcatctttgacaattatgtctttagtccccctgaactggatttttgggaagggtgtgacgcatgcttacaattatctttccctaggaataatcaattgtcccagaacaatttattgagaaagtgttcctttccttactgatctttggagcctctgctatttatcaaacttctgtgtatgggtggatttgctttcagactctccactgtgttccactcatcttttgtccactgttgtaacaacaccacacgttcttactacagcttcaccacacagatggggcatttggtacagccagtcacctgggcatgctgctcctaagagtgtcctggctgtccttggccttttgcatatgtgtatatatgtgtcactcatgcacacacacaatttagaataagtttgttcagttcctctaaaaacactattgggagattagtgtgaactgcattaagtctatataccaatggagggagaatttataaacttcagctgttgaaactttcaatatgtggtatagttcccagtttatttacttaaaaaatactttctccataaatttttataattttctccaaaacagcttgcaaagctggtttaaatttactcttacatatcttctttggatatttttggtacatgtttcattttgtaaatgtaatttttagaatttatgtctgctagtgtattagtcagggttcagactaattagttagagggacagaactaacaggatatatatattaacttacacgatcacaaggtcccataataggctgcaagctgaggggcaagcagagccagtcccagtctcaaaactgaacaacttggagtctgatgttggagggcaggaagaggccagcactggagaaagatgtaagcttggaggtttggcccatctctctttttcatgtttttctgcctttttcatattctctggaagctgattagattgtgcccacccgattaagggtgcatctgccttccccagcccactgactcaaatgttaatctcttttggcaacacccacacagacacacccaagattaatactttgtatccctcaatccaatcaagttgacactcagtattaaccatcacagctggttaatagaattgcacttgacattttctattgattttgcatccagcagccttgctaaactcatttacttccaataattgatctgtggtttcttttggatcttgtatttagataattacaccctctccaaataatgacacatttatttcttcctttttcatcctcaactctgccttatttcctgatcttactccactctccagaaccacccacactatgttgagcagaacagcaatagtgaagatgcaaccctcgccttctagctcatcatagaggaaatgctcccaagtttttgccatggaatgtgaagttgctgtagattcatttgggaatgaccttggtcagtttcaggaaggccatttctatttctagtttgcacgatttatttgggaatgacctcggtcattgggttttgtttctttggttggttgttgttgttggtcttgtggtctgtgttctgtttgtctttattttgaatggattttgaattctatgaagtatgttttctgaatctattgaaatgatcatgtgggttttttttcctttaatctgtcagtgaggtgtattgtattgtcagtagaaaaccagccttatgtgactaggatagatgtgattgattgggatgtactttttaatatatacctagctagatttttttaacatattttctttaggatttttgcgtctgtgttcatgggtgaaattcgtctacactgtgggacattattgaatttaaaatcagtttattagaatggtaggtacttaagtaggtacaaacacaaaactatgcaactataaagccatatataatttaccaattcacttcaacaaatctacgaaagcaggaaatttaaaaacaattatatcaatttgcagtgctgatgttttactgaaagtctctggcagctggaatatgatgacaatgctgactgctccatgaattttcctttcttctcctgcattaccacgtgacttgtcatgacttaatttcccatgcattttctttatttgacctatagagaaaccttctttggaacaatacagccatgttattgttgctttgcttggcaggaatacatctttcgcatgtcaagtcccttttattcttttctcactggcccacaataactaaagcagtactacttggcaccagtgtgcttataaacataaattcaggccctaaaatcaggatagaaggacttgcttattggatagtcatccaggtggtccacaatatgggatatacattttactaagattctcatcaaaatgaacatatgaaatgtcagtgttttataaggacctgtgtcctcagattcccaggttgttatcactcagtttgagaagcatcccatccagagtttttacagaaggaattgttagtacagtttgctaggctgcatttgaaccaatgtcggccttcccttaggaccagcagagacggtaagcagaacttaggtgagtggtaaggagtcttttagagaagtcctcctccctcgagggcctcactcaagatctgactttgtagaaagcagaacttcacactgactttgagtaactgtcttccatgatgagctggggagagaatggaacggtgcccatgagactgtaggacttcatgaccttcagctgtttctccacacagagtgctctcagcctacagcgagagaggaatgatcccaccagctggaaatagagaggactgcaacccaaaccaccccccaccccgcatcatgaggcagcaagagttggacatatcttctccccatcttcccctggacacaccctacagaaagtcctgtggaaacaccccactatgaggctgccttattctcatgttagcctgatttgcaatagggaaaatgttgaggacacaaaaaaccctggctttatttgccctgatcacttcatcctcatggtggtaaaaatgccccatccatgcaacaagtcttcaagcacctctcatgtgccaagcagcccctgccttaggaccacccgctgttaagtgttcactggtgatgccactgtcttaccttatgagcactaaatgcttaagcagggctggtaaaacatagaacatttctcaggttattgtttcaaaatacactgtggttgtcaggcggaaaaggtttccctcttaggatcacctgtgacgagcaacgtcaaagtgttttggtgcaactcaaatgctttgctggaactgtttttctccatacaatgtacggggaaggcttccatgtcatggaacaaagtggtgaatgttcaaatggtcagggtgtgatttcatgggctgcatggattaaggaacattgaaacataaagttgaggacattgctctgttttcaattctctcaaacttctgttttccgatgaggagcatgattttgacacctcctaattcttgctcatgtctctttttaacaaatggagagtgagcctcaggcccagaactccaagcaggactgggcagaattcattatcatgttttggttttttggtatttattttatgcttatcattacttcactgcaaagaatactggtgttccatttatagtagtaatacaaaatgtccctgataaatgaaacttgtttacataaagagggaattgactgaaaagaaaataaagcagccgggcgcggtggctcactcctgtaatctcagcactttttgggaagccgaggcgggtggatcaggagttcaggagatcgagactatcctggataacatggtgaaaccccgtctctactaaaaatacaaaaaattagccaggcatggtggtgcacacctgtagtcccagctactcaggaagctgaggcaggagaatcgcttgtgcccgggaggtggaggtggcggtgagccaagacggtgccactgcactccagcctgggtgacagagtgagactctgtctcaaaaaaacaaataaataaataaatgaaagaaaaaaaggaaaagaaaagaaagcaaataatagtatcagaggtactcacaaaggtggttagtgtttaaccagccttgggaagtgctcctgtcagggaaggaagccagggtttagcaacaacacacgttgggtggaaacccagccctcactggattgatgatgtgtataacccctctgagcctcagtttccccattcatgaatagggcaaaaagacctcccagggatgctgtgaaggttaaaggcaataacttataggcagcattccttatgtggtaaatgttagttccctccctgatgttggaggagaaatctattattatcttgaatctgggccaaagacataataatatttgcataagtgatgaaagatgacaaaatggaaaaacatggacttgtagcaagacaagcctattagctttttcgaccttgaaacttctgatttgatttcctaatccataaaatgaggaagattaagatacttattttgcataattattgggcaaatctgaggtaatgtatgtaattaagtcacgtcctagtgatcacatcaagtacagagtaggcctcaatcaataacagctgtttgttatggtcctcactggggaaggaccatgactttccttcctcatgtgagaacctcctttatctttcaaattgtatcctcatgtgcataaaatattcttcagagtttgtagggaaatcgtttgattaatgttggggtcaagaagcaacaaggtgttgcggggacatcctctagagccttgagaatttggggtgtgaaattctaatttctgagatgctgatgtagctacagattctacatagagacccactcacctcattaattcaaggttcagggcactgaaagcgcatctacccatcatccttttctctttttcatacttttatttgaaaactattattctctctctcttttttttttttttttttgagacagggtctcactctgtcatccaggctggagtgcagtggcacagtcatagctcactgtagcctcaaactcctgacctcaacctcaagcaggtgttcctcccatctcagcctccctagtcactgggactaccggcacacaccactacacccggctaatttttaaattgtctgtagagatgaggttttgctatgttgcccaggcttgtctcaaactcctgggctcaagtaatcctcctgcctcagcctcccaaagtgctgggattacaggtgtgagccactgggcctggccctctttatttttctactgacaattaaccttctacttgaccagaggtctttttaaggattaaagagtggtaatttggctcccctaaaattcacagctgtgagtgtgctgtgagttgtgtgacagctgcattgcagttgcaattgtgtgctagtttctaacaaggggaagcaaacgctgacgtggccgagaaggaaggcccttactatgaggcttccgttaagtctcctccaggtcacattttcataacaccaagtgatatttttcagcttgaatgtctcctgatattataaggagtttgaaattttcctttattaattaacattttcattttgctcacattttggagagcactgattttccagaagtgctaattaccaagctcacagcagaaggttggctgcattttaaactatttcctcagatgctccctgctgaactcagagatgtcctcattcagccgagccagcctcccaggtgggtgggaggcccctggctggtgccactcacagactttgggcttcttctgaacccgcggagccctgaaacaccaataggcccacactcctgagggggttctggccacatctgcctttaggaaagatctgttcattggtgtaaaaccctgacgtgtgacatcagaaaaccagagcacctggccatgccccaaccctgtagctccaggcagacctccctatgatgtggcctgccatagtcatgtggctcgtgatgagtctagaaggcctggaagtttctgtctaagtctgggcaaaaacagagggactcacagcaccccttgtggtgtgagagtaatagatgcatgcatacatgtgtgaaggcttgtttgcagatgtctccatctgttatgtctgagcccattcaggctgctctaacaatatcgtagactggggtgcttagaaaaaacaaattgatttttcatcgtcctggaggctggaagtcaaggttaacttgctagctgattctgtgcctggtgagggcctgtgtcctggctcatagactgccttcttctgtgtcctcgcttggtggaagggacaagggacccctctgtgttgtcttttgtaagggcactaatctcattcgtgagcgttctcccctcatgacgtgatcatttcccaaagacctcacttcctaataccatcccattgggggtgggatttcaacattggaacttggggaggacacgaacattcaatgtgtaacaccataaagaagacatgggaggccaggctcagtggctcacaactgtaatcccagcactttgggaggccgaggtgggtggatcgcttgaggtcaggagttcaagaccagcctggccaacatggggaaaccccgtctccactaaaaatacaaaaattagccaggcatggtggcgggtgcctgtaatcccagctactgggaaggctgaggcaggagaatcgcttgaacccgggaggcagaggttgcagtgagctgagatcacgtcactgcactccagcctgggcaacaagagtgagactccatctcaaaaaaaaaaccagaaggcataggaatctggtatgtatgtactaatcttcaacattgacggtccccagcctttcaatccttgatgtaagtgatgaagatgagcttctgatctctcaaggcccggcggacccctttcctaaacctggggttaccattttcccatgcctgggggttttcccaggacattcatgctgataccaggacagtcccgggtaagcgggatggttgctcatgctgttgacaaggctctggggatcttggcgccaccaccttctcctcgtgccacacacacacatgcacacacaccacccatgccagacttctgaatctcatcttatgagtccattaattcactgttccccacctgctatatgtgcccaaagatttgagatttgcatagacaacattttgaaaagttttatcctctgttttgtcattaaaatagaccccgtgggtgggtcagcaagtgatattaggaagacgggggtgagatggtatcaaatgaagggaagactacagggctggcggcaaggacacagatttggggtagcagccagacttgggaatttggtgagggtgcatgacgcccaagactattgcagagcctgatgcctcggcccccgggtacctggaccacagtggcagggcgccagaaagggctgtgagggaactaggtcagcaaccaaaaactcacaggagtcaaacgaatactatgagccactatgtttgcccagagctgtgctagtgtgtgtatgagatttttaaaaagggaaaacgttactgttgcctgaaggagattaatatgtggataagacatacatacatgacagaaactaagaaagttattacaagattttaaccagagtcttaccaccctatttttaaggcaggagaattgtatgaaatgattgctatagttcagagaggtgaagtaatcctctaaatcacatagtgatttggtgttttgtgagtttggagaaggagaggtgaaggtggttctggaaggcttcctccaggagatggggcagactcgggctctgcagagcaggcaaggtcatcagagaagcggagcagcagagacctggaggcaggctgtgaggtggctggcgctgtgtggatcagggaggtgccgagggtaggagaatgctggcctggttctaagtcattggccctgcggcacgtggcctgtctggaaatgagttcctgcagacactctggacaggcaggagacctcaatgggcactggggcaacctgggccagctgtaggcttccttcctgatcaaacaagcggaccgtgctgagacacctccccgaaagccacaggtctcagccccttcatgggtgaccctgtgttatccacctgagaaagggcccaaaagaggcctctcagaggaggcaggccctgtggcagcacgggccttgaaatcggcccccggggcccctgtggcttcagtccagggactccatgccgggcgctgaaccacctccacaaaactcatgcgatcctcagagccccgcctcatcagccggaggacaggggtcacctgacagtgtgtctgaatgagcggaagcttccgttctgtgagagctctgggcttttgtgaactgacacggggcacagccacccgggcccctgggtgtggagtaacctaagaagtcgtgtacccctggggtgatgaggattgaggctaagatgggcagagggagaggaaaggttacacgggacccagtgacaggagtcgcagtgagttcagccctggtctgcccagagcagtccaagtttacccgggagtccaggggaagtcacaaatagagcttcctttcatgtgcaaatgtcccctcatttggatgataggttataggaccctcctaagtttggtgacttctgaggtctcaggctaagacatttctttgaccccactacagatgaagtacattgtttaagtgttggagggagtggcctagcccagggcccagagctggagcctgccagcctggtccccatccaggcccttccactcatgggctctgtcctgttgggcaaatcacctaggctgtctgtgcctcattttcctctaatatggatatcaacatagcgcccacctcatgggcttatgaggatgtgactcatactatgcgtgatgccgtgttagcctttgttaatgagaacctcctggtcagagctgtgctgtgggcagccaaaggccgattatggagaaccacccagagtggagttaggagccggcctcggggggccggtcacagagtggctcagctggtcagaaatcatgtctaagtctcacacaggcaggaaaatgcgacagtgagaaagggtcctgtcccagcccctgagagagtacgattctacaaagaccctgacacctgctcttgtgactgagttgcataaagtaggggttgaattcctgagtccactaaagacatgtacttccagaatggtaggagtgaaagaggggtgaacatagatggagaaccaagggttttcccaggtgctgtttgtaggtcacacaggggcacagtattgatgggaaagtcagcctcaggcatcatgtgcatcattcaaggtgtcccgtcatgttcctggcagagttggcttcatatccaacttgcctgactccacagcagcctccctttaaggaggcttggacaacccaggccgccatgaccggaaccccagaacctgcccacgagaagttgctcctgttctcctcctcccctgcgaggctcctctcaggccagggcttccaagtcccatgtaggcctccagagccaagacccctgcagcaccctgtgcactcaggcagaggaaagagcccaggatcctgcacagccccttggctctgctgtggcctctcatcgggccccttggcattccaggtggccctgccatcccacagacatcctccaggaagccaaggatgggaaggattctgaggtctgtttggcagaggtcacatggatacgttatgggagaggagtggtgttctggcaccccatggcttgaaggtttccattgttttctctgttgatataaagactggttttcagacagaggcaataagggaagaaacaataagtgagaaggtgaaagaggtcagtgttagacgtaaaaatgccacttcttctgcaaggttttcttgaactcccaggttcgaattcccaccaccttcagccatggcgtgcgcggctctgtctgtacactcagtgtacagtaaacatttgtctacaggtctttcccgtaacttgtgatatcccacacagcttaggatggtggcatatttattattttatcaccaattcccagtacaggtgctaggttcattttaggcatttggttgaactttatcatttatttattttcccattataaaaataatacagaatatagtaaaaaataggaaaaaaagcctttttaaaatagcatcaatagacccagtatctaaaattactattaatattttagtatgttttctaaatctatttccaagaatagatgtatttttttagttacaattattagttttacatcccaaccttttgatacaattagcattgtatacaattaaatacttattgttaacataattttcatagttacatagtatttcattgagtcgatctaccaaaatgcaattaaccattttccagctagaccagctggaccatgtataatattccctgttatcactgatgctgtgaagcacctttgggtctaagatgttccttgagtggaattactgagtcaaaaactaggaacacttttttatatacacttttgatgtatatttgcgaattgtcgtccgtatgcctcatcattcatcctgattccatgctcaccagcatcaggtgaatatgcaattcgttttaaagagaacttgctaaggctatgattttttaaaaagatctctgctaatataatttaattgcatagctatttaaatcagcatatatttaattatattctatagttaattaaattcacatatatttaatagtaaattgattttctgtaaagtaataccagtgatatctttcttgtgattttattcttgctccatttatcttttaatgtcttggtgtgtaaataaccaaaaagctccctgaaggggaaagacagcggaaatcggaaatcacctctgagtccttcacggtccagccaggagctagtctcaggcgtagcggagcccctgatgcccatgccagaggcagcgacttctgagctgggttctgtgattcccctgctcatcctctaggaggcactaatgagcagcagtgagctgaggaagacgaagagccagaggactccaaaacctggaagatctgagtaacctacagacgggataacgagcccctgtaggctgcagagaggttggctgctggtcacaccaccctggagaagagcacggttccaagatcagccacccagggaacctgggagggaagcagacactgtctgagaagggaggggattgatgacttcactgaaccctgaaactgatctcatctgctccaaatacctgggatgatccgggagacttagccaggaacatctgaatgatgtttcatgggtagcattttactcttgctagaagccggaggccactcgtattaggactgtatacaaaaaggcccagaaacttaacaagaaaaaaatagattttttcatcaccttagaaagatattgaaaattcattcacttctttgcagtcagagggtgacttctggcagctgacaagtctcggatctaactgcaatataaaaagatttgtggagtgagagagtgcctcccactgctttctaccagtcaataaatttgtcagtcctctgaaagctttcagagagaaaacgttcacaatatttgtgttttggttcagacctgctcctataaaggccccgtggcccagccttgttactttcagctgcaagaggcagcagctgagcccagtgcaggggctctgagtcacctggggaacttgccgcccccagacagccgggcccctgtgcagagtgtgtgactcagtatgtctggggtggggcctgagagtctgcatttctaacgaatccccaggtgctgctgagtggctgggcccagagtggccttggagaagccctggcatgattgcttgtgccatcaggctgcctagttctgccccttatgggcagggcgaccttgggtcagggctggcttctccaagcctgcatctcagttccataaagtcagaacagcaccttcctttcctaggtgttctgacgaggggagtcttcagagtgtgggctctggagtcggacagcctgggtccaaaccctggctcctcacctgaaaagggtgtcctcttgggccagtgggctccttcagcaccctaggtaacatagccctgaaatgaaaatcataatccataataatgcctatttcatagaattataatggggattaagtaaattaatattttaaagtcttcagtgtttggttaataacaagtactatgtgaatgtaaaataaaataaatatgtgcaacacatccatcaatgcatggcaccattacgagccctcaacaaagagtggttactatttttggattcattggtacatggttccattaatcaataaatatttagcgtcaagtttctacaaggttctggtgtaggcattgaaagaagcacaagatctggtttcccttgtcttaaagattataattttgtgggcagacaacataaaacagagttcagtaacaggagtttctggagagtgctaccagcacggttcacagagcagtgggccagtatcattttttgggagagatcctcaggcagtggagtgacaggagaaggtttcagaatgttcagactcaagttgggcctggagcattttaggctgaaaggactgagaagaatgatgcttcagggagtttgctgctgttgcacgtgattttcttgggctggttcagccttcttcaaaggccatgttccaaaatcagcttcagttctttaagtaaattctcaatgagatcgtttttgcatgagcatcaaaaactgttgacctagcgaagaaaatgtgcatctacttccccaggatagggcggtggcccctcgaaccccatcacacacacagacctcatctgtccaggtaaatgagattctcaatgagatcatttttgcatgagcatcaaaagctgttgacctagcgaagaaaatgtgcatctacttccccaggatagggcggtggcccctcgaaccccatcacacacacagacctcatctgtccaggtaaatgagatgcccagagaccttcccatcagacagaccacagtccagcccttgcccaagggctcagatatgacagcaaacacttaaccctccacccttgccatcaccatcactcatccccatcaccccccatctgcctggatttgtctccactcaccaaaatagcccagagatacggcaggctttttggaggatctggttgacccatttcctatgatcctccaggatcctcctggagttcccaggtgaaggtcaggccgcaagaattaacctgcactctagagtcgaggaaccagccagagctcttccagtcttcctgtcccgctttgcacgctcaccacagactgggctttccaggcctttctcctctgcctctcatcaacagcccccttgtgctgataaccacgcaggctgtggtccagtgctgtgcccaggtttggtcagctttgtttagatctaagcctataccttttttaaagtataacccaacgctacctagtttaatttgtccaaaatgccaagtgatttctccacgtgttttgattttgaaagctgaacatccttatccataggcattttaatttggagagttggagagtgtcatgagctttgtcatttgctagggtgagggtgatccaggctgagccgccaggctgagtgcactgtgaattagcgtggtgtgcggggagttactggagtagtccctgactgccatatcattgcttcactcaccagatcatgcatcttcccatcattgcttctgttgatttatcctcatttctatggctgccacctgtgaaaggttcataaatctccagactgcatcgggctctaccttcattgggccagaaaaaaattcaaacccacaaagttattccttggaaaatgtagaggtgagatctcctccagaaacaagcatgctgatagttgaatgtggcacatgagatgtcactcactatccatctgccatcaccttatacaaatgcaggcacgtctcatctcattgcacttcactgtattctgctttgcacatattgggttttttacaaattgaaggtttgtagcaaccctgctttgagcaggtctgttgggaccatttttccatcacatgttcactttgcatctctgtcacattttggcaattctcacaatattttgaactttttcattaccattatatctgttatggttatctgggattagtgatctttgatgttactgatgtaattgttttgggagccactaactgtgcctatataaggtggcaaacgtaataaacattgtgtgttctgactgctccacaaacaggccatttccctcacctcctcttgggcctccctattccttgacacacaatattgaattaggccaataatatcttataaaatggcctgtaagtgttcataaatggaagaattgcaggtctctcactttaaatcaaaagctagaaatgagtaagcttaatgaggaaggcatgtcaaaagcaccacgataggctgaaagccaggcctcttgtgccaaatagttagccaaattgtgaaggcaaaggaaaagtctttgaagaaaattaaaattgctgctccagtgaacatgtgaatgataggtaagggaaacagcctggttgctgatatggagaaaggtttcatgctctggataaaagatcaaaccagatacagtattccctgaagccaaagcctaatccagaacaagatcctaactctcttcaattctgtgaaggccaagggaggtaacgaggctatagaagaaaagttggaagctaacagagggtggttcatgaggcttaaggaaagaagtcgtctccataacataaaagtgcaaggtgaagcagcaagtgctgatggagaagctgcagtaagttattcagaagatccagctaagatcattgatgaagatggctacaccaaacaacagatttttagtgaagacaaaacagccttcttctggaagatgatgccatctaggactttcatagctagagaggaaaattcaatgcctggctttaaagcttcaaaggacaggctgactctcttcttaggggttgaagtagctggtgactttaagtcggagccagtgctcatttaccattctgaaaatcctagggcccttaagagtgatgttaagtctactccgcctatgctctgtaaatgcaataacaaggcctggattatagcacaactgtttataccattgtgtaatgaatattttaatcccactgttgagacctactgctcagaaagaaagatttcctttaagatattactgttcaatcccagtatgcctggtcacccaaggactctgaaggagatgcacaaggagataaatgttgtttctatgcctgcccacataacatccattttgcagcacatgaatcatggagtcatttagactttcaaatcttataatttaagaaatacatttcatggctggcatggcggctcatgcctgtaatcccagcactttgggaggccgaggcaggcagattacctggggtcaggagttcgagaccagcctggccaacatggcaaaaccccatctctactaaaaatacaaaaattagccaggcatgatggtgggtgcctgtaatcttagctactagggaggctgaggcaggagaatcacttgaacccaggaggcagagattgcattgagccaagatcatgccatggcactccagcctgagcaacagtgagacactctgtctcaaaaaaaaaaaaaaaaagaaaagaaatacatttcataggctgggcatggtggctcacgcctgtacttgcagcactttagaaggccaaagcgggcagatcatgaggtcaggaatcgacaccatcctggctaacaccgtgaaaccccgtctctactaaaaaatacaaaaaattagcagggcgtggtggtgggagcctgtagtcccacctactcagggggctgaggcaggagaatggcatgaacctgggaggcggagcttgcagtgagccaagatcgcgccactgcgctccagcctgggtgacagagcgagactctgtctcaaaaaaaaaaaaaagaaaaatacgtttcataaagctatagctgccatagatagtgattcctctgatggatctgggcaaagtacattgaaagccttctggaaaggatttatcatcccagatgccattaagaacattcatatgcattagaggaggccaaaatatcaacattaccaggagtttaaatgaagttgattctaaccctcataatctttgagagattcaagacttcagtggggaaagtcactgcagatgtgataaaaacagcaagataactagaattagaagtagagcctgaagatgtgactgagttgctacagtctcaggataaaacttgaatgggtgagaagttgcttctaggaacgagcaaagaaagtgtttcttgagatgaaatatactcctggtgaagatgctaagaatattgtggaaatgacaacagaggatttagaatattccataaacatagttgagaaagaagcagcagggtttgaaaggactgacttcaattttgaaggaaattctgatgtgggtaaaatgcaatcaaataggattgggtgctacaggaaagcttttgtgaaaggaagaatcaatcaatgtgcaaacttcattattgtcttattttaagaaattaccagttatcccaaccttcagcaaccagcccctgatcagtcagcagccatcaacatcaaggcaacaccacctgccagcaaaaagacgatgactcaccgaaggcttagatgattgttagcattttttagcaacaaaacatttttaataactcacatacatttttagacataatacttttgcacagttactaatctacagcagagtataaacataacttttatatgcagttggaaaccaaaagatttctgtgactccctttattgtgatattcactttattgtggtggttggtggtctgggactgaacctgccaaatctttgtggcatgcctgtatatggctttctgtttttatctttgagatagagtcttgctatattgtcgaggctgggtctcaaactcctcaagcaattattgtgcctcagcctccagagtagctgagattacaagcacacgccattgatgtgtatgtgtttaagcatggatgaaccagacaaggagctcctccagggcaaagaccatcattattcagaaacctggtacaaggaaaagctcagggagaggagagggggagaagggagggcatagaaaatattgtaactgtagccaaagaagtggatatatttgtcaggattttttagtgataaaagacaaaatgtcaagttaaactagactaaacaaaaaggggaatgtcttacttacctgggatgatcagaagtgggtttggcatccagggactcagacagcatcctggggcatgtctctgcctccatccttatctcctgctattttcctttcctgctttcccttttctgtagtctctcttcagctctacttctttctgcgtgttcatctcgctctcttccagtgcaaaacgtcttccatatggccaggaagacaaatcacccctgggaccctgaggtctgtatcattccagtgccaggacccagaggcaagaagcagtagactctgaagctccaggaaaggcatgagaatacctgacccacccagggtgtgtcagaggccatcactcagggcccatggctggggtggcagggatggaatcctgcagatttacatgcctgagtggtatgcccattgtgggggccagggctcccagacagcccctgagtcacaggcataggggagagatggcctcaaactaggcaaacaaaaagtggaggtcaccactacagcagttagccagaacatgtgaaagtaaaacataggcaaatactatcttaagtcattaatccagtgaatatgatcttctatttgttggtagaatagagcaactgtagctgagctagtgattacagcaacatctgatcaatgctttcaactcagacaaagtggccagtttcctgcgtagaagggttggaaggcctgtgaaggccactgttgttccccatctggcccatcctgcagatgtcccccctctactcggcccctatgcagcaatgagggcggtcatggaaaacaaaattctcaccttctcccttgtttggaatgtcctggaaccatgatgacaaccagcgcccttcagtgactcccattgttctcacacaaaagcatggagtcaggagtgtaacttctaggatcctgcgtcccctgccacttctccagcttatcctctcaccgcctgccttggcccagctgctgtggcctcctcccttcctcggaggattgtcctttcttgccttgcccagggcctcggtgaacgtggctccctctcctgcgatgctctcattccccttctttccctgggtagcctctgctcacccgtagatctcagctcagatatgattctcagggcagacctcacaaccacccagacaagaccctcagggtgccctgttggcactttttaaacttcctcccagcaattcccagactggagaatgtcaggatgcctggccaggccactcctagtcagcccctggaggctcagtgactccctgtgaggagggggagtttatgaaatgcacagccttgggcagggcctgatgctggttcctgtcactgttgtgcccacctctccatgtccctggactcattagaagggtgccatctcttcagtcagctaggaacttctggagctcctctgttacactaaatagcttcaagtggacactgaacacgtactatcaaatgcttaaaagcacaattttattttgagaactttttctcagctttggaaaaataatacctcagaattctccaggttaaaatgtgggttcaggaggtgagaaagatcccaagagatttctctgggtgggtgactctgaaaaggaaggttttcctttagcgtttgaaagctgcattgatgggaaggtctttagagtggtgttggggcttttcatcttgattttggttgatgttttgaaagaaggaatgatatgagtactttctggtaggaagagcaattttagattatctacaagcatttctctttcttggcactacactctgccctttggcattaaatcctgaagtaatttgctggagtggaaaatgatgtaatacattatactggtttttgaaggaaagggcagaggggaaaagtggtaaagtgagggaactacaagaatcctgtgattaaaatgcggtcctctgtggtaaggattggataggttgatgacacttattatgctaataatatgttacctttgaaagtgttttataacctccaggattttctcccataaattatctgctttcatcctccccacagcaccatgaggcaagcacggcaggtgtaattatctgtattttgtggataagaaaatcaaaatgcagagcagttaaatgattttttttgccatatcctagagctgcctaggcaagaaccaatgaaagaaccaagcattctggattttaggctgatgggttaatcatcagcctaaaatatgaaatactcactcagaataaacagttatagccattgcaaaaatgagatgagcccttgcatgccaactgctcagcacctcgccaggtccatcggacatgccccgagggtgtttgtggtgttgatgatgatgatgctgaactaaatgagaatcatcaggaatcttaaacctctcattgatcaacagctttgacatctcctctgtattagtctgttaccacgctgctaataaagagatacctgagactgggtaatttataaaggaaaaaaggtttgattgactcacagttcctcgtggctgaggagacctcacaatcatggcagaaggtaaaggagaaatgaaagcacgtcctacatagcagcagacaggagagaatgagacccgagcaaaaagggagaccccttataaaaccatcagatctcccaacatgtgggaattatgggaactacaattcaagatgagatttgggtagggacacagccaaaccatgtcatcctctatccatccgttacaagccagtataacaaaaggttgtgtatttgcccagctgagcagtgaaaagggaaaaggccaaaatatagggaatgtgagggcaaaatagagtcagtatttagtaactcacagattgaatgttgtgttcctgaaatagagcattgggtactctgagaatgactcctggcaattttaggactacttccatgggaaaaagcacataaccacgtgtatacatacatatgttattaaccttttagctcaaaggtaactgggctttccactaccatcagtttctgtatacaaggcttgaaggccaattatactttatttccagcagtctcttcatgtaatctctgcaagaaaagtctcttttgataggatttgccgactttttcttcagtgttcacctatgctcccgtcaggtgagcacactgcattcttagcagtgctgggtgtcattagtgttcagtctttcataatctgataaacaaaacattgtaataagatttctttttgttattttttagcaatttgtacagttctttgatcgatctgtttgtgtccttcatacacatatttatagctcagtgatcatgattcatgctttccacttgtcggaatttatcccagggaaatatcagagacacaggtgaaaatttttgtgccaagatgcacacaatagtattttattacgataaaaaaaccaaaagactgtatgtcaaataataagggattaattaaataaactgtcatatctcttcaagggcatgtctcaaagaatgtttaataacatggaaaagcatccaggtgtggtggctcatgcctgtaatcccagcactttaggaggcagagacagacggaatacctgaggtcaggagttcgagaccagcctggccaccatggtgaaaccctgtctctactaaaaatacaaaaatcagctgggcatggtggcacatgtctgtaatcccagctactcaggaggctgaggcaagagaattgcttgagcccaggagacagaggttgcagtgagccaagatcatgccactgcagtccagcctcaccgacagagcaagactctgtctcaaaaaataaataaaaataaaataacgttgaaaagcattcctaatataaattaaccattatattatatggccttagttttattaaaaaccagatttatacctctcctaccaacacacatacatcttgaaggaaatgaaatacaacaaagttgatttgtgtatgttttgtagagacaggatctcactctgtggtccaggcaggagttcactgcagtcttgacctgctggactcaagcaatcctcctgcttctgtgtctcaagtagctaggactacaggcgtgtgctatgacactcagctaattttttaatgttttgttgttgttgttgttgttgttgtcgttgctatttgtttttgtagagatggagtcttaccgtgttgcacaggctggtctcaaactcctggcctcaagtaatcctcccaccttggcctcccaaagtgctaggattacaggcaggagccaccatgctcagctcgaagtttattttaaggtggtattttgtatatgtgtgagtgtgatctgtaagacaacgacatttttcttttttttttttttcaaatattccacaaaaaacaaatacttgtagtcacagtttggtggcttttgctgtgctgttttccagcttgtaactggccagactgattctatgatctcaagccagcggttcacttttcaaaaaaacccaacactcctttacccagccccatctttgttgttggtatatctctctcgcttcttcttattactttgtagtaattttacttcagaaaagactcagaattcccaccatcatccagtttctgacatgaacccatggaaggcatactgttcaggaaggttggcctatgtcaggggcctgacacctgctttgaagcacccatcaggggccatgtgtggaccaagcatacattccggctctgcctgagtccacattcagcatcacctggactcagtaggatctggggcagcaacggtcagccagcagggtgacgtcacacatgtgcacctctcctgcagtattcaatgctgctgtccccccaaccacacaggagctgccttctcccccagcactgctgccagatgacagcttggtgcagggagcaggacatccacaagtgggtgtggaatcttccctgcccgatgcctctcaggagccaggggcatggcttcagggccccaccaggaatgtgcacgagggtcaccagactgggagaagtggcagctgtaactccctcccagtactcatggttctccttatctcaatgcaacttatcataaataatgctgtcatgaatagaggtaatattcaacccttatcaggtttccagggcaacaaaagcaggaagtcagctgatggtcaaattcgctgcaaagaggactcaccttaggttctgagtgccagagtgtttcttcaatctttcagacacagctggtaatcctaacttgctgttatatggcctattgatgaaaccactcgggaccacatgtggcatttgtagcacacccagaaattaaacccatgcagagaaacgagctcaccaggactccttaggttgtccttggagggcttcctcacctcacttgctagcagccactgcccaaggacctgctgtgttctctggtcagctttctgctttcagcagggtcttctaaaaggtacgtctacaaggttgcagatttggaggaagaattcctgtatcctggtgaagtgttttgtgtgtgtagagtgttccagtgacaggagttatttgcaggattggcacagtctccagtgaagactctcctgtgggcttcaggagcagtaacttgcgtatgatcattgctaaaccaatggggatagccagttccatggccagccaacctgttctgtgcttcgccctataaattatgttctatattacatacaacaggatctttcacttttatttactacagaaatgtcagtaaatggttcctgatgtaattagcttgatcaggaaatgtgataactcaagagaagccgtggaatagagagagaaatgcaattgccaaatagtcactactatgtggatatgtccttgacattaggaaagccgctataatgtgtcaattaaagaaacctaggcaatgtgataattgaagtttttaattgatatagagagagaatctatttcccccttaataataacatgttgggttcactatgaatgtttaatttcctttccatgataaatagttttccctagtctgggcatggtggcccacacatatgggaggccaaggcaggaggattgcttgaggccaggagtctgagaccagcctgggcaacagagcaagacccccatcttaatttaagaacaaataataaataaataaatagttctccttttcaacagaagtttggtaatataactaattaatttgctgaatatcttttactgatgtaaatatgaatgtaactattgaatttgacaaagtgaaaaatgaaagaaatctcttagagatcatccaacccaacctctaatgttatagtgaaggaaattgcattaaacagtgttgaataacctgctcacagctggacagctagtagtttcagactggaattcagggttccatttcaagtccaaggttctttcttttttatcatctcacccttagtagtattgctatcattttgtcaaatactgagctatgcaacatgtttcccttttggccttgattttccagaactaaaaaccaaatcgtgcctgattatagtaattattccatccctagttcctgatgtaattagccccctctttagctatttgtgtctcttttatcataaccattctgggaacatgcagattgtgcttttattgtaatttactttgaattggtttaagaaatattaagggtgtaaattgtcacttaatacacacacacacacacacacacacactcttcttctcagtaagttacctggaagttgtactaatcttttaatttctctttttaaattatcttagtgatgtaaatattcatgaaacttttggatttatttgacttttggaaaagtcaaataaagcctcaattagttaaaacccagccaactcacatgctaaaccttgggatagttttcctgtatacaacatacatggaaaagaatagcaataacacagataatatcaaggaaaacagtttctgggaatagatgtatatttgatctaatccatttttgtacatgcacaccaatagttttggacaatgaaaactgattatcttagtcaataataattccatattgtatacctcattctatctaataaatcaagaaagtataaagtctgaaaatatttccctaataaggactgaaattgaaaagatctcttctttagttagaaaattcaccaagaaagtgtatttaactgaaacttcccaatcctctagagaattccagtgtattagtccattctcatgctgctatgaagaaatacccaagactgggtaatttataaaggaaagaggtttaattgattcagttctgcatggctggggaggcctcaagaaacttacaatcatggcagaagacacctcttcacagggtggcagaagagagaatgaatgcccagcaaaggggaaagccccttagaaaaccatcagatctcatgagaaccagctcactatcagcataacaggataggggaaaacaccccatgattcaattatctctacctggtccgtctgaagacacatgggagttataggaactacagttcaggatgagatatgggtggggacacagccaaaccatatcattctgcctctggcccctcccaaatctcatgtcctcacaattcaaaacaaaatcatgcccttccaaaagtcccccaaagtcttcttccagcattaactcaaaagtccaagtccaaagtctcatctgagacaaggcaagtcccttttgcctatgagcctgtaaaatcaaaagcaagttagttacttcctagatacaatgggggtacaggcattgggtaaatatacccattccaaatggcagaaattggccaaaacaaagaggctgcaagccccatgcatgtccaaaatccaatagggcagtcattaaaccttaaagttccaaaaatgtgtttcacgtctaggtcatgctgatgcaacaagtgagcgcccatgggggcagctctgcccttgtggctttacagggtacagcctacctcccagctgctttcatgggctgacattgtctgtggcctttccaggtacctggggcaagctattggtggatctaccattctgggatctgaaggatggtggccctcttctcacagttccactatgcagtgccccactggggactctgtgtgggggctctgaccccacatttcccttctgcactgccctagtgaggttctccaggagggccccacctctgcagcaaacttctacctggacatcctggcatttccatacatcttctgaaatctaggtggaggttcccaaacctcaattcttgacttctatgcacctgcaggcccaacatcacatggaatttgccaagatttggggcttgcaccctctgaagcaatggcccaagctgtacgttggccccttttagcgatggctggagtggctgggacacagggcaccaagtcccaagtctgcacacagcagaggggccctgggtccaggccaggaaaactatttttccctcctaggtctccagacctgtgatgggaggggctgccatgaaggtctctgacatgccctggggacattttccctattgtcttggtgattaacattgggttccttgttacttatgcaaatttctgcagccaacttgaatttcttcccagaaagtgggattttcttttctatcgcatcatcagatggcaaattttctaaacttttattctctgcttcttcctgaacactttgttatttacaaatttcttcctctagatactttaaatcatttctctcaaatttgaagttccacagatctctggggcagaggcaaaatgccaccagtctttttgcatagcaagagtgatctttacttcagttcccaacaagttccttatcttcatctgagaccacctcagcctggacttcaatatcagcattttcatcaaagctattcgacaagtctctagtgagttccaaactttcccacatcttcctgtcttctgagccctctaatctgtaggaagttctaaactttcccacattttcctgtcttcttctgagcccttcaacccgttccaacctctgcctgttacccagttccaaagtagcttccacattttgggatatctttatagcagcacctcactctccgtagcaccaatttattgtattagtctgttctcacactgctatgaagaaatacctgagactgggtagtttataaaagaaggaggtttaattgactcacggttctgcatggctagggaggcctcaggaaacttacaatcatggtggaacctcttcgcagggcagcaggagagggaatgagtgcccagcaaagggaaaagccctttataaaaccatcaggtcttgtgagaactaactcactatcatgagaactggatgggggaaactgccccatgattcaattatctccacctggtccctcccaagacacatgagaattatgggagctacaattcaagatgagatttgggtggagacacagccaaaccatatcatccagttaattgaaccttcacagaatttactataaccttgagtgtataagccatatttatgctaaaatgttcatttttaaaaatgaaactaatgaaaatgtcatgtattttgtaaatacccagagggggcttgcccaaggtagactgagtgggcttacttgggaaataacaaagagatgagtctggcagaaagaaattgaggatgagaaataacttgggataggctagtgatggctttgaatcccaagcagaggccctcacacttttacctggtaggctcagaagaagaaggactaatatgataactattttattttattttatcttatcttattttattttattttattttttgagatggagtttcactcttgttgcccaggctggagtgccatggcacggtctcaactcactgcaacctctgcctcccaggttcaagtgaatctcctgccttagcctcccaagtaactgggattacaggcacctgccaccatacctggctaatttttgtattttttaagtagagatgggttttcacctggttggccaggctggtctcgaactcctaacatcagatgatccacctgcctaggcctcccaaagtgctgggattacaggcatgagccactgcacccagccaggataacattttataaaaaggaatatttgttgagctaatgtacattgaggcctactttaatttcaatatacttttcagacaaggaatcacacacttgtacaattttccgaccttatcattggaacacttgctaatatgatgcagatgaagtgggattgtgataggctattttaagtacttgaattatgagacaattttcgactgcagtagcccaaatggtaccctgcagccgtcaaatgtgaggaacttcagtgtgagtgctgacaccaaatggaacctcatccacccacctgatgaaaattgatgttcccctggctgtcaccctcagctgtacgctttgctcaagaagtactttgttttgagggactttatgttgtataaaatatggttttgcctgtcatccataggtgatgaacctgccatctctgtctcctgtctctctttaaacactaacttccagttgcctatggagcaactacctggaagtctcagaggcatctcacagtcaacctgcccaaactccactctgacttccttctccaaaccttctcttccttcttcatttcccatcttaattcttagtaacccgtacattctgtcacctaggtgtgaggatgagaaatcatatttatttccttctgttcccgccacacacccacaccctgtagattctgaatcctaatatttttcaaatccatcttcttttagatctcatttttgtagtttgtgctttcactatttcttaggcctccccacctccagacttctgcctcccatctcccctcagccgtcatggtgatatttctgaaatgaaaatctgattttctggctcttctatgactttgctttccaagtttacccatcacaaagaaaatgaagccccaacttccctggaacacaaggcttctcccacctggaacacaaggcttcccatagcctgacctgtcccccactcttgctgtgtcttttaccaccctgcatccctacccacttactattttacagctcttaccacctacttgtagtcccctaaatgcatcagatctgtgagcctttccacacatggatgctgacatctgaagagttctcccttcaactctctcccatgcacaccgaatgaattctccaggcccctcctctaaagcgttccttcttcacccccagctatagtttactgcccctttatattatatgctgctcctggatgtgggacagcaggtgcatgcctgatcaaatgtggtatctttaatgatcaacaaatgtcaggtaaacagatgcatgggttagttggttccagacatagaatttactcaaaaagagagcattttttttttctcctgaatggttttcaagatagctcaatatattatgccatttttaaaattttattttctttttagattacacataataattgtacttatttaatgtggtacagtgtgatttttgtttgtttgtttgttgttattgttgctgttttttgagacacagtcttgctctgttgcccaggctgcagtgcagttgtgggatctcagctcactgcaacctcagcctcccaggttcaagcgattctcctgcctcagcctcccaagtaactgggattacaggcgtgcaccacaacgcacagctaattttgtatttttagtagagacagagtttcttcatgttggtcaggctggtcttgaactcctgacctcgtgatctgcccacctcagcctcccaaagtgctgggattacaggtgtgagccaccacacccagataagtgtgatgtttcaatacatgtatacaatgtgtaattatcaaattacagtaattagcagattcatcagctcgaacatttatcatttatttgtggtaagaacacacaaaatcttctcttctagatattttgaatagacaatatattattgttaaccattattacccaactgtgtaatggaatactcggacttattccttctacctcattgtaacattgaccagtctctccccattacccacttgcacacaaacacacacacacacacacacgcacccttcccagcaccttcccagcaccgttctactctctacttctatgagagcaatgttttagatgccacatatgagtgagactatgtgacatttggctttttgtacctggcttatttcacttaacctagtgtcctctaggttcatccatgctgctgcaaatgacaggatttcattcttttctttggctaaatactatttccttgtatacatgcataccacattttctacattcattcatccatcgatggacacttgggttgattccatgtcttgcctgttgtgaatagtgctgcagtgaacatggaagtgcacgtatctcagcttactgatttcatttgctttggatgtctacccagtatacaaccatatgattgctggatcatatagtagctctatttttcattttttaaggaacctccatacttgtttccctaatggttatagtaatttacatttccaccaacagtgtataaaaggcccccccttatccatatcctcaccagcatttgttaatttttgtctttctgataacagccattctaacgggggtgagatggtatgtcattgttgttttcatttgcatttctctgatgattagtgatgttgaagattttctcctagacctgtttgccatctgtatgtcttcttttggaaaatgtctattcagttcttttgcccattttttaatcaaatgatttggtttttgctattgagttgtttgagttccttatgtattatggatactaacccctcgtcagatgcgtcgtttgcagatatttcctcccattctgcaggctgtctcttcactctgtcgattgtttcttttgctgtgtgaagctttttagtttactgtaatcgcctttttctatttttgtgtttgtgcctgtgcctttgagttcttttctataaaatccttgcccagactaatgacacgaagtatttccactgtgctttcttcttgttgttttataactttgggtcttatggctaagtctttaaaccattttgagttgatttttttaagaggtgagaaattggggtctaatttcattcttcacgtcaagattactttgaataaaacttctaaatgaaaattttaaaagttcagccctttgctctgagtttttgtctctattctactcccacaccccccccaactttagtcactgtggaacccacagtgaggtcctctttaaagctggcttgcctgggttttagacttcctcctccttttttttttttttttttttttgagactgagttttgctcttgttgcccaggctggagtgcagtggcatgagctcagctcactgcaacctccacctcccagattcaagtgattctccagcctcagtgtcccaagtagctgggattacaggcacccaccaccatgcctggctaaattttgtgtttttagtagagacaggttttcactgtgttggccaggctggtctcaaacttctgacctcaggtgatccacccgcctcggcctcccaaagtgagtcttcctcttctttaagatctttatctctctgcctttgggtcacatctaggaaatgattcatccccccactgctcagaagcaccactcttcttgtgtctgaacatcttgggactttctaggttttaccccattgctctttcaaaaattccagatattctactttccatatgttttctttttggttgtgaatcagagagtggtagccttctcccatcgcttatgactccttctctcttgttcttcaaactcgagtacagaggctactgtggcggcgtgtttgggtgattgatgggcttcctacacttggatgttatctatgccgggcttgtcttggttacatcccagcctctccagagcaatgatgttctgctgggatctgggggctccaaagtgggctgtatgggctggggatgccagcaaatcttccatccttccatttgcttgaaattaaagatacacagaagtaatgtggccacgggggtggaaggaagggaggatggaactcaaagggaaaatgacatgtggaccctgctctcataaaatttgaaatctagtcagtggagaagaccagatgatcccacaggagaaatctggggtgtcaagtatggatacacagtgggaatgattcatgtgactcactctgctgaggaatttgcccactgccctgacacagacctcactctactggtgaggtctgcagaggctactgaatatttgtaaagagtcgagtctgcacagttggcttccagcaggcattggacagggccctccgtggaggccaggcacccggcatgcagttcccctgcctcccttggcctggagtcactgctcttctccgcaggtcactgcccccatcagctgtggtggtctagtgttcagcagaaatgggaaacggagtcttctgaggctgtgccgattgtcattgctctgaaaagagctcacttgtgcttgagtggacattgcttcagcatcaacgtgaaggcctctgtctgtgggtttcagggggtgccagggaccagactggagagcaggcctcatcctgcgcccacgtccaacctcccttatcctctcccccatgctcctgcatctgcttcccagaacctctcggcctgtaggatctgttctgttggtgaggagggagtacagcataaacacagaaggtctgtgacggagagagattgttgaggcttcctgctggaaggttgagagctgagcagaggcttacaagagggcaggatctggatagatgccaacgaaaacagagcatttgggtgaggagaagagtgaatcgatggactgaggagggaacacacctgtgctatgcccaggagaggaggcaccagcaggcagagcttccaggcagggcgccagggcagggcagcatggaggaagtggagacagtggccttgcctgtcctggaaaagcctgcgagtgtccccatcacttactagtgggggctggatagtcacacatgaggaccacaaagcagatgttatcattctcctgggccttatgtacatctcagtatgtttgggagacctgagcatttaccttgtaaaagttttctggaagaaggaaccaaggtttgatggcagagagtacatgccctgctccaggatggcagagagcacatgccccgctccagcatgtcagagagcacatgccccactccaggatggcagggccccccggctgcagcatggcaggggttccagtggacagtgggcttgggtgtttcaacagcatctcccactgcagggccccagtgccacagttgggttgaggccacagaatccattgcagatgcaggtactggctgagtgcccacagggcaaaggccatcctgaaaaaggggtgggcagccccttcaccagaacggaatgcaagtgctgagccagctgacagggtccttgactgatgggtctttcagtgagaagggtctcctgccagtgtgggcctgcagtcaccgggcagctgacgacaaaactcccagcaagaggtctttccccaataagcctcgagaagagggcagaatggggccagctgctgacgcagctgccatgtctgctggagacatgctgtgacaatgacagggaggcatccttccgtccccacctggttcttctgtatgggtctcatgagtgtgagcttctgacatcaggttccttctgagtgaggaagagaatgtgagaggtggcatcctgattaaagctgtttatggtctggtgcatttttggttaaaaatcacacttttcatttatttagcacattgctgtcaagttgcaacacgctgtaattatcagaccacaagttctggaacctgctgcgtaaggtccaatcctggctcctccttccgctaactgctgaccttgggcaaggcatttaactgcctcgtacaacctggtttcaatcccagccgcacccctgacccaccagctgctgggcaagttgcttaacagctctgtgctcctgtgtcttcatctacaaagcaggaatgatagtacctgccccatagggttatttttaaagattaagcgagttaatgctcataaagcactttcgaagtgtctgcccaacatatacaaaaatttacccgaaatacatcaaagacctaaatataagtgaaaactgtaaaaatcatagaagcgtaagggaaatgttcatgaccttggatttggcaatggatttttagctgtgacaccaaaagcataaaaaataaaagaaaaaataaaaagaagtagataagctagacctgatcataattaaaagcattaatccttaacattctagctcacatgacacctcctctgaagcctgttctaaccccttcagagagaatggattttttataagggagacagtaacagcaacagatgtgactgagcatttacttcattcaggccagccactgttttacgtactttgagttggttgactcacttgctcttcacatccatttaagattagattctattggccatgcacagtggctcacacctctaatcccaacacttgtgaagccaaggcaggaggatcacttgaggccaggagttcaagaccagcctaggcaacatagtgagaccccatctctaccaaaaaaaaaaaaaaaagatacagatagatagatatatagatagatgcctggccgtggtggtgtgtgcctgtggtcccagctacctgggaggctgaggcaggaggattgcttgagcccaggaggttgaggctgcagtgagctatgatcacaccactgcactccagcctgcacaacagagaaagaccctgccttccaaaaacaacaacaacaaaagatgaggttttattattatctctgctgacaaatggagaaactgaggcagataacagtccagcagctggcccaggccatgcagcacatcctctgtgctcccagcacgtgttgcagacaccatcgtgtagtctggagcacactgagctggttagatccagattcccactgtgaatgggaactccttagggccaatgacatccctaaccctgaatcatgggacctcaatgacttctgcaggactgaaagttacatcttgattctggagggatttgggtcgcagactagagatttaaactttattctgaagtaagcagaaagttatttcagatttttaaaaaatacatgagaaaaatcgtgtttcagtaaagacaaatctggtgtgcaacgtatgagataaatcaggggcggcagcaggaggcagggagttgagtgagggtggcccacggttgtgagtggctccaggtgggtggggtgaggccttggggatggtgcgtggactaatccagatagtgaaggccacacgtagggaggcttcaagtccctttaggaacaagaatctcaggaactcagaggagcctgagtgctctgccagccatgcacatggtggataaaaagtaaaaattcagtcactcacccaatatttgatctcagcatccaggatttctcagcctcttgggggttagcatcgcaaaaccacaggcagaacttgatgccttccatcttcttttcttcagatatcttaatctgaatatcaaaaggagaatgtgaggcacagtggcttatgcctgtaatcccagcactttgggaggctgaggtgggtggatcacttgggctcaggagtttgagaccagcctgggcatcatggcaaaaccccatctacaaaaaatacaaaaattagccaggagtggtggctggcatctgtagtcccagctacttgggaggctcagtgggaggattgcttaagcccaggaaacaggtttacagtgagctgagactgagccactgcactccagcctgggtgacagagcaagactcctttctctcaaaaaaaggaaaatgtgaaagatcttcaaagcaaaatacactcttctttatagcttgttctttcattttccttccattagaaataaaaccaaagcaaaaaaagaggatttaatatccatcatagcaaactttactaactgaaaataataattggctatggtctgatttgattcaaaaatccattgtaggcttacaacacatttatttttaaaaaaaaaaaaagctaaaacttagtaatacatcttacccttaggcaaactcataagaacagctgctgaaattaaattaggttgtatacttgtttctggaagttttccacctcatttctggctgaagtgaatccttgaagaaccaggagggctgagcagaaaacaaatatttgccactgctttcagatccatccctctgtgggaacaatctggagaaactgcctttttcatattttcagtaaaaaaaattccatattcatgccatttcctgtattatgcaaaataccttccctccatagtctcttaaatgacactgcaatatttttcctagaatttcctaaaagaaaacagctggtttgatccccactcttggtccgcatgcctgatttctgtagacactgggtatttgcagtctgggctgcatcagtttgtgaggtacccataaggatgtgggcagagagtttagagacagaaaacccagggcagaattgatccatgcaccagaaaatgcattgtgtaggacaatttatagcttaggagcttcaggagacatgaggtggttcctgggtcacaggttctcaaatttggctgcatattgtaatcacctgggatgtttctttaaaatgctgatgcctggattccattcctagagattctgactttgggttggtctggtggattgtgcattaggtttttcaaaagctccccaggccatgtaatatgtatcaaaatctgaggaccaccaacatagaccatctccccctcctccccagagagggggcgacttgcccaaggtcagaattataatatcttccagtgtaccccaactctgcagatggttctctatcacccagtggcccaagagatcagtttgagaacaactttgcctcatcccacaacttcaccccagacctcaggtcacttcccatggtcaatgggttcttctcatagtctcaatggctgatccttctccatctccatggttagtgctcctcagatgatagcaacaggctcctctcatttgaggcctggctcccttctcttcgccacaccatctgcctccatactcatcttcaggagacttgagtgtaaacatgttgcctcctactcacacctctgtcaggggcttcccattgcctttgggacaccttaatgtggcttccagaccctccaggagctggctcctggcctcctgagtatcccatcttgcccctcctgtatgattccgcttgtatgaggtccctggagttgtcagacccctagagacaggaagtagagtaggggtgccaggggctgggggagggatggggagttacaatagtatttaacggggacagagtttcagtctgggaagagggaaaggttctgcagatggatggtggtgatggttgcacaaaaatatgagcatacttaatgcactgaactggacacttaaaatggttaaaatggcaaattgtatgtaatgcatattttatcagaacagtaaatttttttcaatagctttctgagaaagaccttgcctgccctttgcctgagttaggcagctctgttttgtgtttccagaactccacaatcttcctatcagaccactgtcctgcttagagtctggcctttttacagattgtgactagaataaaggcgcattggagttctcgcctatttaccactgtgatcccccatgactgcagagtaggtgcccactgcataattgttaatgaatgttgttgaatgaataaaacccagaactacagtgtcccagcccgtcaatcttaattgctaggaaaaattggattgcaaaaataatccaatttgatattgtattagtccattcttacattgctctaaagaactacccaagactggatcatttataaagaaaagaggtttaattgacacactgttctgctggctgtacaggaagcatggctggagaggcctcagaaaacttttaatcattgtagaggggaagcaggcacatcttacatgggggagcaagagaaagagagtgaagggggagtgctatacacttttaaacagccagatctcatgagaattcactcactatcaagaagagcaaggggaaaatccacccccatgatccattcacctcccaccaggccccacctccaatattagggattacaatttgacatgagatttgggtggggtcacaaatccaaaccatatcattccactcctgtcccctcccagatctcatgtcctgctcccatttcaaaatacaatcatgccttcccaacaatctcccaaagtcttaactcattccagcattaacccaaaagtccaagtccaaagtcttatctgaggcaaggcaagttttttctgcctataagcctgtaaaatcaaaagcaagatagttccttccaaaatacaatggggacacaggcattgggtaaatactcccattccaaatgggagaaactggccaaaacaaagggctacaggccacatgcaagtctgaaacccagcagggcagtcattagatcttaaagctccaaaatgatctccattgactccatgactcatatccagtgcatgctgatacagcagtggtctccatgatcttgggccactctgccctgtagctctgcagggttcagcttcctcagctgctttcacagggtggcattgagtgcctggggcttttccagatgcatgctgcaagctgtcagtggatctaccattctagggtctggaagacagtggccctcttctcacagctccactaggcagtgccccagtggggtctctgtgtgaaggctccaaccccacatttcccctctgcactgccccagtagaggatctccatgagggcttcaccccacaacagacttctgcctggacttccaggcatttcatacatcctgaaatttaggtggatactcccaagcctcaactctcacactctgcacacccacaggcttaataccaagtggaagccaccaagacttggggcttgcaccctctgaagcaacagcctgagctgtaccttggcctcttttagccatggctggagctggtgtgggcgcaatgcagggcaccaaggctgcacagagaagtgggactctgagcccggcccatgaaaccattctttcctcctaggcctccaggcctgtgatgggaggggctgcctcaaagttctctgaaatgccttggaggcgttttccttattgtcttggtgattaatatttggttccttttacttatgcaaatttctgtagcaggcttgaattcctccctagaaagtgagtttttctcttctaccacatagtcggactgcaaattttccaaacttttatgctcagcttccctttttaaatataaattccagtttccaatcatctatttgctcatgcataacaaaagtgaccttggctgccattctcaataagttccttatctccatctgagaccatctcagcctggacttcattgtctatatcactatcagcattttggtcacaaccatccaacaattctctaggaagtttcaaactttccctcatctctctgtcttctgagtccttcaacctgttccaacctctgcctattaccaagttccagagtcacttccacattttcaggtatctttgtaagaatggccccttctcagtaccagttttctgtattcattcccacattgctctaaagaactacctgagacttggtaatttattttaaaaagaggtttaattgactcatgattctgcaggctacatagaaagcatggttggggaggcctcaggaaactttcaatcatggtggaaggtgaagggaagcaggcacaacttacatggctggaggaggaggaagagagcacagggggagggctacacacttttaaacagccaaatcttgtgagaactccctcactatcatgagaacagcaagggagaaatctagccccatgatccagtcacctcctaccaggctcagcctccaacattggagattacaatttgacatgagatttggacggggacacaaatccaaaccatatcagattttaagtagctagaagtatcagaccacaaattgtccagtcatggtaagtgataacattgggtgaagaatgtggaatttcagcctctgattaatccttacaggtatattctgttcgaggtgggtagacctccaagaattttgagactgcctttgttctgtctaataaatacaacaggaaaatgaaaacccggttgatgatttcagattttttaagaacagcctatttataaccacttccttgcttaatattatgcttttttctctttccaaattagatatttatttttgaaaacaatatctactactgtgcacatgtcgggaaacaggccatccgtgtggtctccactggcaaggaaggtgtgatttacaatggcctcagtgactggctgtatgaaggtaagatgtgcacagagagaaaaaaggaagatttgtggttgctgctgctgctacattggagttgggttctttttcatttttctttgactttaactgtaaattaaactccagtttcttgaggttctgcaaaatttaaaagattttgttagagcttttgggatcaggctgatcagcatcagagaacagcatcaggctgttgtcaggggcctgcagtgttgtgcactcacctgggacaggtgtgctggctttgggctttgcagagctctgcaattcatccctgaagggcaggaggctcgttaatgggagatttattatgtcaggaggtgacttctgggaacgctcagggactgcaaatgcatgtgtctctaccccactccaagacataagtgcctcgttttgccttgggaaggggacagttggaaaagaaagaatgagttgcatctttccaaataaatcatcagagtgacttgctgctgagagcgcctccaccttgctggacattttctaccactggtttgcctttggcaccagaagactcatgctgtatacattattaaataactagaagtcagagggggaagctctcttcttaaactttgataacctgtctccatgctcatgacccttcatcgtaacaataacaaccaggtattgattgctattagctgtcaggcactgctggaagcactttgttttctgttacttcattccaccctctgtcttagtttgttcaggctgctgtaacaagatataacaagattccacagactaggtagcttaaacaatgaatatgtatttctcacagctctgaagcctgggaagtccaagatcagggtgctggcagacccactgtctggtgagggctctcctcctcacttgtacatggctgtcttcttatgtcctcacctggcagagtagagagagctctggtctttttatctctttataagggcacaaatctttttatctttttatctctttataagggcatgaatcccattcataggggcaacaccctcataacctcatcaccttacaaaggctccacctcctaaccccatcaccttagggatttgggtttcaatatatgaatttggggggacacagacattcagttcatagtactgtcataacaaggttctattttatagatgaggcatggttaggttaaataattggcccaagtttacacaaggtaaggaatatttattggggaaaggcgttgtccaagctcagggtaattaccttttttgaattccacatgtggctacagtaaccgtatgctttccagcatggggctgatgaacaacccaagctcttctcagcctcctggcctgaaaccgtgtggtcacagcaataactcaccctgctaggctgggtcaagggagggtcagggagattctgggtgctttctcaagccagtatcactttctcctagtgctgtgcatgcctcattctgcattttagtggctttatgcatcataaattataaagcagatggatatgcaagcttagtgttacctcctaggataatttctctgaagccataaagttctatgacttgatttttaatttttgtaaatggaggtataatttgtacataataaaatgtacatcagaaggacagtttgatgagtttggcaaatgtatatactatatagccccagtcaagacatagaccatttccatcagtctagaatattcctacaagtccctttccaagggctttctccctaaatctgtcttccagagactgccacggtcctgggggctaagcagcccattctctaacagacatactggaacccaagcatccacatgaggctgtccttccctgtgtggtcaccatggaagccccatgtttattccaatgtggctgccggtgctcagagcatgctgaagagtccagtttccttctgagccccaggagaatcaaccctgagattttattgtcacatgagtccttggctacacctgaaaaagccactggaatgaaagaggggacacagtctgctgtagttatgcctgttctgtgcagaaacagccctagaaatggtgtgcccggagatgtccccagctccaccaaagaggtacaggcagcagcacaaagggaagctccggaggggctgcacctctgcctggggtgcaatccctgagcctctggggcttgcctgccccctggactcagtagactgttgacaatgaggactctaaagccccttgtgtgctgcccttttgtgagaaaaaggccttatacctaggagcaactggaaaactgggtcctgtttgctccctgatatctgagatcccactaacagctcttttgcttgggtgtgagatcagctcaatatctggatagggaagggaacccaggggctggagatcagaacatgagtggttcaaagtaaggctgtggagctgcagggacccagggaggagacctggcccagtcacgggacatgacaagggtcttccactccatcgacctcaacatgctcatgtgtacatgggaagaatgccccaaacactacacttcctgaggactgtgtgagacttggagtggaatacgtgcagcacatgacatggtcagcaagggacagttgctgctgttgtttcttatcacaataaaaataacaataattatgtatttattactattattgtaattatttgttagtagtatttttatcacaaaggaaaaaagatgtttaaaaaagaaaaaaatggcatagatatcaaggcaatgttacccaggtggtcattctgccacagggcagaaattgtctgacctgaaaattcaagagagatcagtgcaaataataatgaacccaaggtgtgtcccccgtccctaagagaaagggcccctagaattttggctgcaagagcctaggcattctctgggactaatctccctcaaaaatccataaccaggagatttaaaatatcttttttagtatcttcttaataaaataaaaagttcattgctttgccattcacattaagcttttgctttagcaaatccattgaaaggacttttttcttcaaggcatttacacgaaattgtgttgatgtgataacagagccctaaatattttaaatcaatcacagttgatgtggcagcttaatctacttagtgttgttccctggaaggtttatatgctgatgcttagatttctgaggctgggagcacaggagccctgaggattcttgcttccttttttaataatgggaaagtaaactttgatgatcgcttttgcctactctgtgacttaactgtttcaattccaaacacttcctttaaaaaagttagggggtggggggagattagaatgaaaatgccctaaagcatttgcagaggggctcatttgcttggagatgttagttctaagaagataagctgtgtacgtgggaaacagccactgcagtccatagcttgttggcagaaaaatgccttattgatttgttttgtttcccagaaaggatcttaaacatactaaacattgcaaaatattggagactgaggaagagaagaggtgggcagccatagaggcttctgggagtctccaacccttgacctaagctttaaacacacaaagtgggaaaagctccagtttactgaagcagtcgcccacatgccagaatgtgagctcaacactggctgtgaactcagcactggctgtgaactcatcactggctgtgaactcagtgtatctgtcttgctgattctctaaagagagtcctgtggctcatggtggccacaaactgattttgataagcaaaatgcatatcttcattttattcttctgggaaaatgtcataaaattacatcgaattttgattttaataaaaactaaagacagcttaatagagtcctacaactttttaaagtttattaaagtttgtttattcataaactaaacgtaagatgttactgaagatgaagattttgaggcctgtgagtgagtgttctgttaagaatgtgcactttgatgcagggctcagtaattttgcaaagttcctagtatgtaggcatatgggcaaagagttggaattctccaagttttgatgaaagttctttgttaccgccattacatggttgattgtgtttccagctgccactctttgtttataaattactctttgtttttcttttgtttgtttttttttttgagatggagtcttgctttgtcacccaggctggagtgtagtggcgcaatctcggctcactgcaagctccgcctcccagggtcacaccattctcctgcctcagcctcctgagtagctgggactaacaggcgcctgccaccatgcccggctaattttttttttttggtatttttagtagaggtggggtttcaccgtgttagccaggatggtctcagtcatcttcgttatcatcatatgcatgagctatagtgggacagcacagaatttttggccaataatttgctaataatgactttaagttattaaatatttcagctaaacaatgagtcatccatacttcttttaccaaagcagtcacatgcatatgcatatccaaaatacatataattattcagtgatatgccattatcatggaatgactcacagccctgtggaaagctggaacatgttagggtcattggaggacaacatctttccttatgtatataaaagatcttatcccctcaaagggcagtggaggtagagtgagggatgatgaactcgagaagatatttatagagctcagcctggagtcatcagcctgggatggcagggaaagtgagaaaagggcccgaagggtatttatttcatatctggtttggcatggatgaaattccagggctggattttccttaactagtcaagaacataaaagtacttgaaaaatgtgatcagatcaggagacccagtttggcacggaagcatttccccgtgcatgtcagcaggaatcatgttagatgagactctcgaagctgcccctggcactagttccccttgcgtggttctaggacccatgcagtcaggcagcccctgacaaggagtagctgctgggaagtctcctgccaacaatactcacttctgctccaccctgcccagtccaccgccctcgcctggactccatggcaccctccccattttctgcagccctgccctgactcctgaggcccccttctcccagtcacagcccttgccacagtccccacggagccaccgtcctggttccacctacctgggagcccccaagagagactgtcttcactgtcccacactaactgccaccttcactgggtggccagcatggaggaagtggggatgtggctagtctggccagaaaggacttccttccagaactgctgctgctggagaggggtttagtgcctcttgagttggaactcagaatgctctcattagcgatgtagtcaggcccactgtacaaggagcagagcctttcctaagctagggccctcagtcctgctggatgagcaccaaaccctggtggtgtgaccattaccctccatctgtgtgtcctgctcatgtctagggactgcaaggccagcgtgaggcaaggcctgctttgcacttctttatagtttctcaaagcatctttaaagagtcagcactcatgacctaatagttttctgttccaatgaagtgctctaagaggtaccagcaaaaggtcaggtgggccccaggcagataaatttgagttaatgaattttgggggtggggcaattccatgctttattgtcttgagtattcaaggaggtggagagtgtgtaggagtagtagtgcagtgtagtagatcacagtggattttcacactttcatggaagaaaacacattattaaaatgaaagccctcctggggatcgtggaatggttttcagggtctgttttccacagggggcacattcaccaaaagaaaagggaactctttgttcatccagattcccataaactctctaaatcccatgaaagcagaacaaacttaagtaacacttcacgtgaaacttgcatattggctttaatttacattcatgacacgttagatatgttgtacactttgtgtgccttgtgtcacgctgatacccagtgtgctgagtacctgcttcctgcgtgttgtgaacagaccagagccagttgtgaccatcgataactggtacagtcttcagtgaatagcggcagccttggacggttcgacgcagatgaagaaaatctagcacaccatctttttatctaagaaagcaatatgctggaaccattagacattaatgacacttatgctacttttctttagagacaggctctcactatgttgcccaggctggcctcaaacttgtgtgctcctggcttcgcctcctgagcagctgggactgcaggaacctgccactgagccccaaccttttatgctgtttttaaaactccctgacatacatttggagactgatatgtgaggtgcttacagaagccccctggagtgtagattcttgattgggttctgcaaatattaactgcctctgaagcacctggctagggcacttcaactgctagcaaactgctcccaggtagtagatcaaagtggatttttacacccgtcatacatcttagtgaccatactgatgttttttaaataagttatggagcaggcagtacaatgggaattggaatgatgttcaaatatgtacattactatgtaaaccatagatctgtagttatttggacctcttattgattacatctcttatttgcatgatgggaaatgtttggttagacaaggacatcactctcagtaaattggcagaaacttgtgattagcttgacaaagctcctttgtggaagagcagggcagagtctttgtagtgatgatgcctgtgtttaaacaaaagcttcaccacgtaaaagctgtatgaacttggatgaatatttgacctctttgtgtctctgctgccttgtctgcaaaacaaagataacagcagtatatgctccataaggtcacagaggaaattgaaataagctaatacacatagagctcttagaatagtgcctgccactggtaacgtctacgtattggtggtacaactactattgctttaccttgtaatttcccaaactcggtaaaataagaggcacctgctcaactatttcatttgcaatgtcaggaatcggaagcattaatgtgtaattaatgatacctatcagtgttgaaaactctgaagctctattcactcataaaatattatctgtagtatgttcacatagaaaatgcactatgagttcccagtcatcctagaaatgctattgataccatgttgaacacctcttcaagagccttctgtccacgtttagattctccaagctgaaatcacacccttagttgccactgatgcctgacagagagacagctgttttccttttatgagccccaaagttcttgtgacttggtaaaaattatgcctcatgatctcttacagaaattgagtacttaaaaaaattatattccacttcatctatgacttctaagggaggatatgaaagtaaaagtaatgatgaaaatatctaaaatgtaatcagtgtctggcgaagctatcagacctatgaggtactgtgcaatggagcattggctcaatcaaatagcaatcattctgagcaggagtctgaatgctttgggtatttcatgtaactaaaatgagtattttccttgtctagtcctagtctccaactctgtaaagtattaatgatcttgacttgaagaacatgttaattttaccttgtagagagacaaggaggaaaagccaagaagctgtttggtagaagttcagttggctctgaccagaaaatggctgagatggcctaagagttccattccttctgtgcttctctgaacctgtgagagatttctgggtttctagatttctgcaaggatcaacaggaaaacagtgttctaaggcaggaaataagaatgtcaggagcataacatagactgtgattgccacaggtaagccaggctggctgccaaggccctcttagccccctgggtccaactgcacctgttcctcacttgaccctgagtcccaccagaccctcccctgccatcgtctgctctcaacgtagcaatcatggcatcatggctgcctcagtgccaaactttaaatccaggtaggtcaccaggaaacaccagcacatcctaaccagcaccatctctctgtttctgcgatcatgggcagaccactatctttctgctgtaacaacacaaagtgtatgccctcacttgcctatgttcatctgagttttcttgaaagaaaaacacatggctattgattctctaatcacagaaggaggtagtgttggagctgaaatggacgttagcagacattgagtccagcagtcagtaaactgtttctgtaaatggctaatagagtctgggtaatagagtcagggttttgcaggacatatggtcttcattgccactgctcaagcctgttgtcatagcaaaacagcagccatacaccataagcatggctgtgttccaataaactttatttgtggacagcgaaatttgaatttcttgtaattctcacatgtcattaaatattcttcttttttaccagctattaaaaaacacaaaaccaattcttagctctcaggtcatacaaaagagacagcaagccagatttggcccaaaagccatagtaagccaatcccaatttgtccagtcatcacattcacagacgaggctactgacatcatgtctgaattcttccagctcttgtcgtctgtatcaagatcatttgtaatgacaaccaattatttcaaattttgcttctccaaataagtctagttacttgaagtcaagaactgtattttatattgtatgtttcccataacaccagtgactctctgagtacttaataaatgttcagaaaatacttttgaatgagttaattcacagagagaaactcacatattctaggaacctccacaaggaaatcatattgtttctccatgatcactcttattagaatttccatttccacaaaattccctcaacagaaaaacacctgattaacaaaaagcaacagtaattgttaacctcgttttaattatgagtttcacgttttatccccaaggataaaggaaaaaactggagtgacgttgggaaggacatggtcttcttaccgtgagcccaggggcacaggatcatagctcatcagactctagaccatctaaattcatgctaagtcatagttcacatactgaatgaatagagtaggaatagcagtatctaagtttcagtgagtctttcttccatgccaggccttacacaaataaacttcgagagcgctatgaagaaagctctaggattgttccttggtatcctcgggagactggttccaggaaccccactgcacccacccttcttcaatcagataccagagtctgaggatgctcaagttccttgtgtgaaatggcttagcatttgcctattacccgtgctcatcctccgggatactttaaatcatctctaaatcacttataaatacctaacaccatgcaaagcctatgtaaatagttgatatgctgtattttttatttgtaatattttttatggtcacactgttatttttttctttaatatttttgatctgcatttggtgggagggtctagagatgtggaatttttagacacagagggccaactctttccttatcctattgcacagctgtggaaactattaagtggcctttctgtggacaaacaaccagtagggagcctgcctgaagctgctaagcactttcctgctgcatatgagttgcattaatttcttgcctatgaaattaggcttgggtccatactcaagttctgggtgcagcatcctgtagatgtgtctgctcaatgccccaggcttgaaccatctgtgctgtaaaaggtgtgtctcatggcacagatttaagagcccaacagaccttgatttaagccctctgtgagccattcagctgcctggtgaccaaatcacaaaccttgtctgaccctcagtttcctggtctggatgataaaacttcaggcacctttctcaaagaattattgcaaagttaaacaagagcgcttctgtggaagcgcaggcatattacagtggaaccataagaaattgccaacaggttcattgtatattagcatgtgcatgtgagatgtccggtgaaggtcaactttcttctcccatcctgctggctatgctggatgagatctcagatatggtaaagtctcagatgtctgcgtgcccagcacagagaatttaccatggaaaaggcgggggtattttttgactggaaggtcagacctattcacctccaggtatagcatctccagggcccccccagcaaacaggagataaaagggatgactgctctcctggtctgtgggtttctcccaagagaaacttgacagagacttccttgctccaaatcttcctcttcgtggctccttgtttctggtactgattcccaccaccctcctaattgccatggtgaccagtcggtttgctatttaattaatgttgtatctgattacatctgtaccctgggagttctccagccaagagttgcaatttaaactcagaaataaataaaacgttcagctgtgaggatgggggaattatcctagtcaatcccggaatattcttccgacctttcttagatgaaaaattatctggtggaagttggagtgaggcagtagtacacaatgaagaaggaacaatattctgcttttggaatatttaaaaggaagcctcagacagcagctaggggtcctgcttagcggatagagctttggaaagaggaaatattagaaatttggttgagaattttctatgaagttcagtgctaagagcagagaccacaacttaggctttgcagccagcattcccttccataaacttcaaacgtaagcctgatcagaacaaggctagcaggaagatgtgctggtggggacaggctaggtcctgctgtgggtagcaaaaaacaaacaaaagcaaacagaacactgcctctaatttaaaacagcaaagtgtatttctcgtcggagatcactcaagcccactctagatcagggatggggaggaggtgaggctctttccctcacggtcactcaaggtcccaggctgctggggctgtcctcttaggcatcgcagccacactagtggaaaggggagtgttccggagggacacaagctggggaataaatgcttggcctgggaatgaccctggcacttctacgcatgactcattgtccagaacacctcatatggtcccaccagggttccaggaagtagcactgagccattgtccagaagagggggaggccagacatgtctgggaggcaggactgaagaccccacatctgggcagctttcttgccaacagtgggcctcaagtttggtgcccaaagcagaagaggaattgtctagagggatgttggggaatctctcagaatcaacaggaagatcagagttgggttgagaaagcaggcagccgtccagggcagctgaggggacgccaggggtccatctggttgggacactgctgtgggggaatgggagtatgggagaggcattgtctgcccggatcacaaatgacgttcttgaatgagctgcaaatagaaatgccatgtcccccatggaatcatcaatatggcaacttgggaagcgtattccaggaaaaagctagggtgtgtaacgttttattgttgcaaactctatcatttcacacttaaatgataatcgcaaggagagccatcagaaccattagtcatcatctcttcaatgcgaaggttcgtaattgtcacatgcaccttgcaataaggcaccttgcaataagctcccttccttcttggcatctccttggagcctgtgaagtgatgaatgcagttcccaatgcacagccctcaaactgcatgggagaaaccccagtgtcccagaggacagtgggggcggcttcagcgtggctgtgtggcactgaaacaggttaaccgcaaacctctagttctcagaaccaaagctgaatccacatttgaaaatccagtagaagctttgttaatattttaggaaggctattgagtattttaattcaacatgaagaggtgatctagctggtcttgtgaaaaatcagtaataaatctaaagggagaatgttctctaaaggtacaggaagaattctcattggtcttgagaaatgtccttacaattaatgacctactcctgagagatcgtgacaaatatcttaggatgttcagtgactatatttttctatctttcaaattatgcatttcattgtgagattaggacaaacacacttttacctttttttatagcgccctaatgaaacttatgtatttgaggttgagatatttgacacccttgggaactctaatttcttttttttttttttccgtcttcttaagtcacctaaggacattagaccatttgccctattattgagagttttactaaaatgcaagctgcaaatgccagaaggaagataggcaacaagacaatatgtacttaaaagagtttcatttgatactcagaagctggaactagacttagctcttttgctcactaaacctgtattctaacctttttgggcctcagtgtctttttcttgttctggaagcatcactagggtggaccagataatgctaaactcctttccgtctctaacccttttcatgtttaattatcagtgccataagcacacagcgttgatggtatgaagtctgtgtccatgccagataacttcacaaggaaatagttaacaattctcggttttacttagtaaacatacgggagcaatgctcctcagttgcaatggtgggggctgggcacgtgggtatctcggcctttttgtccccttcctctcccctttcgtcacccccacacacaggacatttgcgtactgggagaacctttattagatgattctgataaaccttctccttatccccacgtgaaacctatctgccctaaaggaatcagtcttctgtctcctttactccccatttttttctttctataaaatttgcattattggcataacttttctctttactatgggttatctttgggaaggtgtaagggaatgcaaagatagctcacctccacgtcagagctccctgcacttgcaggcgtggagaggacatacccttcgtcactcgttctgtgcgttaggaccagagtggaagaggatgcgaggagtcagatttcaggtcagttgctcttccccagccttcaagcaatggcagaggctgtcctgggaaggtcatgctcttctgtctgggttatctgaagtgatcattgcaccgagtgggagactggacatgcagacctatcatctgcagccatacaagctcatgattctgggcaccctgagtcaagtcccagagcccaggcaacctggcagaacccaggaagggtgaagcctctgcatgctggccactcaggcctacgattagcccctccccagcacatccgtgcattcagcgcaaggccaagctccatccagtcgatggaaatgggcacctgagcctcagaaacacccaaagaagagagcacctttcagctcttcatggaagaaagcgagccagccagcaccttcttctttttgcaggaataaatatgtctggcacctggattattttatttaaaaggccagctgtgtggacaccatgcctataaagtattgggatttttaatgaatgttaaccaaggaagagcccagctaggatacttcctgtaggtgtcactttgtggaggtcttaggtgctatccaaccctaaggacaaggcagccaggccagctgaaggatttcagatcagctctttctctgctcaccaccctcattattatccacttcttttatgggtccactcagatgctcatgctcacagtcttacctcccttctctccatccagaaaggtgaaacctcacccaccgccatgtggctcccacatcccagtgtcctgcatctgtgtctccagaaacatggcagagatagaagaaatttacatgtagcaaaattcatctcttcaagaagatattccaacacctgacagtggcccacacagtcctcatttactagggaatcctatttcgagccccttctgggcgcccagattggatgagtcactatggattgcagtgccccacccaacggggtacctgaaaaagaggaagaaagggaggcagggagggaaggagatgaaggaggtccaagacagggacccttcccttgaggaactgatacacagtcagtccgatggaggccaagaccacctgcaggaagcagctccttccttccattattcgagtgggattcatgcatttattctgcaccgaagccctctaccaggtcctccaagggagacagagatgctttaagatctggacctgccttcacaaagtgtatatcctgcaagatggtattgaaccacatcctaattacatggcacaaatctttcacacatttagacacttttggcagaatggtatcttctgatttaaaactgcagaaacatgaaaattagaaaaccaaacaaccattaatgcattaactcaagagttcattcctaaaatccaaatttccttctctggagataggaccagatcatagctcccaatcttttctccagtttttgttttacgacatttcggatttgagattctgtaagaagtgacctaatgtgagcatttcctgatatggaggagacgcaaaatagctcagggaaaaagttgatcattagaaaaatctgtggttgtcccactgtctcatcgtgccactgggagtttctggcctccgctggcatctctgatgaatgttctatgccaggacaaagaaggcgggcatgggccaggcagtccctccagtcagggaacggtggcctctcccagctgccttggtgtttaggaggccctgtaagggtatttgggatctcaagagcctctgggacttacgggcaaagggcagaccttaagagccagtccctcctcccccaaaatgtttagcaagccagaaattcccctttactgctaagtcaaaggaagatgttctttgactcttcagggagcataacgtaccatcctttgatggtcatacacattaaaagaagataaagccagaaataaaagggaaagaaacagttatatgattttggtgggaatttgcagaaatacaggctgaagctgaagtcttccatcaggtgaggttttttccattgatctcatctctcgggctcagctcttttatctccagcgcattttggatgtggcttctctttccacctgctgggcctttagatagagtacttccttttgtttcaaggtagcatttaactgagtctggaaaaaccatcattaagggaaaataaagctgaaagatgaattgaaaactatgtaaaagggccctttcaggctgccggagagattgcctttccagcctaatgagcctgtgctgcctctgattcagatggtgcaaggacaggagaaaagaatggagttttgtgcactgcgattttccaaagcacataatgcttagtcatttggggtgttaggaaagagagaaagtcggagcggagtgtgtggtgaagtgagagaaagaaagaaggctgaattttcgttaagctgctcaaatgcctgctttaacaaaagtctgccagggctagaggtgattagccatcagtgctgctgctgtttttgctgtcgtttttgctgttgctgaagtttaaaggtcctgtgccccttggtatatacgcaggggattggttccaggacccctgcattaccaaaattcaaacatactccagtcccagtcagccctgaggacccaggtatatgaaggggtatatacgcaggggattggttccaggacccctgagttaccaaaattcaaacatactccagtcccagtcagccctgaggacccaggtatatgaaaagtcagtcctccatatacagggatttcacatccctcaaatactgtactttccatatgtatttggttgaaaaaatctgcacataagtcgacccacgcagttcaaacctatattgttcaagggtctgctgtcccgtccttatgtgggatggtgacaagcggccctgtgtcccatggcgtgcagctgagcggccttggtgcagaggtggatttgcagccagttgtccacacatcctggatcctcccggtgcgtcctgtgtaatgggttaactggacctgcctaagcctgggcctcccacccctcaaaagcagcttctccaagctttcctacttaaatttctccagccacagagagaagcatttattgtctctcaccacacccgccccccagtatagaagaaaggaagactggggaattgatctctcagagcacttggagaagccacacgtcagcagccagtaaagctagaatgaaaatctgagcgatcaaggcaatggaatagaaagtcaaaacccaaacttcatctcttccccactaaaggaacgggaagggacactgccacctggcggccagccgaggcatgttcggggagccgatcctcctccctgggccccccacggtgttgatttgtgggaatttgcagatctctgatgataatgaggggattcgcagtgtgtgatatgcaaataacacagctctgattagtgaaggaggctgcgagccttgcaaggtaaaagctccatttgccttctggcttgatgttcgctgatttcttttttaaccccccatttaattctgctctcggcaccttggataaaatatttagtggcaggaaaaaggcaacagatgcaagcaggaataaataagattttctgtatttagaatgaggccacgtatttcggagcacagatctatcaggcatgttatttatgtcttttgcaatttcccgggacccagatttctcagggtgctttgatttttctcaaatatctacagcagtaggggtccagggagcccagggagcacagccaggcactcactcacagtcagaatccagggggctgtgttatttaggatgatccgaaacgcgaccttgctgcctgcattctgttttgatatgtatcttgcctcattaaaagatgacaatctgcaatactgatattactcaggcagatggatttcccaaatgctgggctatagcctgggctgccagactgcatgaggtttaacatggaaaattaactgcagtcttgttctctggtctgccaggtccagcagtgtagtggaaggagcaaaggagcaggaatcaggagactcaccaggatctgccctctcctgtcctgtgatcctgagaaaatggcttggtctcctcatcctggaggtctccatagtggagtgggctcaacatcacacctggagtcaagtcaaggctccgcacgtcccagtgacctagagccagttgtcaacatctctgagcctcaaaattctcctttataacaaataatgtaagcagatccacagtcactaggaagattacaatagaattgccagagtatctagcattcagtaaatatttattaactagatagaaaaaaaatgtaccaggcttagtaacacccggccttcccatctcattagaggctagaatgctcaatggacacagggtgtgtcttagtctgttttgtgttgccataaaggaatacctgaaactgggcaatttataaaaagaagagtttatttgcctcagggttctatagcctgtgcaagacacatgcaccagcacctgcttagcttctggtgaggcctcaggctgcttctactcatggcagaagatgaagtggagctggttgtacagagatcacatagtgagagagaaagcaacagggtgtttaggaggtgccaggctcttttataacagcccgccctcacaggagtgaaatcaagcgagaactcactcacccttgggggaggccattaaccttttcatgaaaaatccacccccatgacccacacacctcccactagaccccacctcccatgacccacacacctcccactagaccccacctccaacattggggatcaaatttcaacacgaagtttggaggggacaggaagccaggccatagcagggcatatagcattggcatcaaagctagggtgttgattggttatgaatattgttggtcctgcctcatttatcaaggaaagaagaaaaaagaagactgtagaaagactaagttcagggtatacatgagtcttcaagagaagccagacaacattccaggatttcagaaaggggacatggctgagctgggtcttctctttgtggggagacatgtcattgggcctctgagttccaaagacacaacctggaaaaagcacaaaaagactgtctacttagaagatttaggatttcccgcatagtccccagggcctcctctgatcctttgaccaagatatgaaagccctgccatataagaagaggggagctccatgctgaggttaggacacagcactgatatgatgccggccttccttggtctatttgacacctaatgaggtggggacttgttgacaaagtccttccatcgtgaggtctgcacccctcacccccagcttgattgtaccattctgttttggaaatccccaccagaagtaccagcaaatgcttcttaagcttctagaaatttctatctgggattattttgttcatagagcaattctggcagccagagttacttctgcatctttgctttggaccacaatcacccaaaaagcattaggagaaaagagatcacagcaatggttcactcaattttcaacttccctatgctgtttagattttggcaaaagagtattcactgtgactgctgcttttcactataaaaagaagctgagatttcctgccaactatttcacaaaaacaaacagaagattcattgagagaaccaaggaagcatctgatcctacaacacacgaccaaaatatactgtctgtatcttggaaatgaactccctaagaggatagaaaataagtcgttcaagctcttctctaactcaagtataagcaccctataactggaattatgtcttttacctcctgcttattcccagggctgaggggaccattcgtagctgataatatcagttacaatcatgcaggatcatccaggaataaaaacattggaggaaggcagcatgaaagggaaagaaaatcctggttttcagaaaataacatggagacctcatgagctcactctgagtaatcacccttcagcagtagcatctccctatccagtctgctccgtttaagggaagagttcatctcaccacagtgtttcattgaagagctggtttttaattggccctgtaccacttaatttattttcatttgcattccaatgctgtctgccttgtactgctttacttcaaagctggatctaaaaaacataggctcttagaaggttgcaaacctgcaattgtacagaggctctgagaagcgaaatgatttgcccagtgaaatggggtagtgtggaaactgagagagctctgaagtctaacacccctggcttcacaattctacctccaccatttactggttgtatgaactcaagcaaattgattcacctgtcagacctcagtttcctcctctgtaagatggaactagcagcatcgaccttgtggggtcattgtgcgaatcgccatactgtgttagtctagcattgctagtcacttactaggcactcgcgaagtgtagctgactcctagtgttgttgctcttagaaaacacccatatgttagaaaaaaaaaatagaacactttttctgcctctgaataagtgcctaagatcctctaccacttcttgctatgaccacccacccagagtaaggaagacagctgctcccccagcctcagcaatgcggagacggtgtccaattctccactgacaccctagttttttctgtacggtgcatgggaaaatgtataataaaaagcaaagtgcgtcacaaatgataggtagtcctcacgttattagtagtaatagttgctatattgagtgctgtgggtccaggcagattggtttatagtcactgagatatgttgatctaataataatgagaatgaatagataaaggggtacaagctgtcagctgacaataatgtctgaataacatcagtttggtttgcttacgtaatgggtcttacatgaagaggagacactcggaactcaacacctgaactcctcccgcttccggcaaggagagaggcagaaggcgcccacgtggtggacagcagcccatgtagaggggccacagaaaagggtgatgggcatcctctctgcacagggcagagctgcagggtgttgggagtcggcttgctcctctccacctcctcccttctgccatgttcccacctgtctcagtcagtctgcagtaacagctatagaatgtcttcatttggaacttggagaatttgcacaaagggaagcagactggacaaagagctcagatcgggggtctccgggtctgggcacagccgttacccttcccctcccatcctccgttctctcctgccgccacccacactgtgctcctggtgagctagagccagagcgaagtggaacccagagcactgtttgccaacacccgcggcactagacaacgccaagagaatggcttagtaataatgagataataacttaatgaaaaacccctgcgagccctgcggggcggggagggagacctggtgtgtggtgctggacgcttcctgagcacctccctgcacagcctgcctctggagtttctcgcgcatggcggtaagcagggccaggcctcactctttccccttcacagtggagggtgtgagcagggcttcgatgccttttgctcacggtgtccagcagtggatgcgctggttggaacggacgtgcctataaccatgactcccaccgaggccttgtcctgcaagcccagttcccatcaacagctcattctagggagggtggaggcccagtaccgcaggcttgctgcatttgggtatttccaggtggctcaagtcaaacttaagagcgcgacccattcggaaaatcaagtgaataaagcaggatggcatggaaagggatgggggctttactgagagagggtgagggaggataggacgggacaggagagagagggatggaggctttactgagagagggtgagggagcataggatgggaaagagagggatggaggctttactgagagagggtgagagagcataggaccggaaagagaaggatggcggctttactgagagagggtgagggagcataggacaggagggagagggatggcggctttactgagagagggtgagggagcataggacaggagggagagggatggaggctttactgagagagggtgagggagcataggacaggagggagagggatggcggctttactgagagagtgtgagggagcataggatgggagagagagggatggaggctttactgagagagggtgagagcataggacgagagagagagggatggaggctttactgagagagggtgagggagcataggacaggagggagagggatggcggctttactgagagagggtgagagagcataggacgggagagagagggatggaggctttactgagagagggtgagagagcataggacgggagagagagggatggaggctttactgagagatggtcagggagcataggacgggagagagagggatggaggctttactgtgagagtgtgaggaagcataggacgggaaagagagggatggggcattactgagagaggatgagagagcataggatgggaaagagagggatggaggctttactgagcgagggtgagagagcataggacgggaaagagagggatggaggctttactgagagagggtgagagagcataggacgggaaagagagggatggaggctttactgtgagagtgtgaggaagcataggacgggaaagagagggatggggcattactgagagagggtgagagagcataggatgggaaagagagggatggaggctttactgagcgagggtgagagagcataggacgggaaagagagggatggaggctttactgagagagggtgagagagcataggacgggaaagagagggatggaggctttactgtgagagtgtgaggaagcataggacggaaaataccagagtgcaatagagaaggtgcaaaggagagctgcttcccacacccttgctcctggcctgtgtgtgtccgtgatgctgggtcatggtcaaaaacacggatggccgctgacatgggtctttacagagaaaggctccatccaatctgaaaggcctgcagcaggcagaacctatccgtagatgaacaccctcgctctccagaagacaagaagcgggagtcgcagcctattgaagtgtagacatgatgtctacacagccaccctgtgtcctgcaagagcccaggctcagagcgtgtgcaccgtgagggccgcctgtgccggagcaggccgcttctccgtagcaaccacatcccacagtgtggaggttcccagcggcgggtagtgcggaaaacagggaaggcaggaaagaaacttagccaggcactgagtgcgtgggaaggcaaaacactcttttctcctcccacggcgggggcgctccctgggcgatgctcacggagagtgggagggcgtcccgcaccgggcagagctgaagggtggcgggggtcggcttcctcctctctgcctcttcccttccgccacgcttcctacccacaccagccagtctccagtaacagatatagaatgccttcatttggaacacggagagacaagcgtgccgtgtgggaaggagagaagccgctgctggagcaagcgtggtcccagaggagagcctgatttgagttaaagcgagagggcaggagaagcagttgggaatcgaggcagtgggccgaggatggcccaggttcaagaggcacagtgggaggctgcaggtgtaaggagaaggacggctcaggtgagggctgcacaggcgctgaggggatggggctctgggtggtgacatctccaaggcaagagagcacgtagatttcagagcaaaactatctgggtcagaatcccggatccaccctttatcactataaaatgttgggcaagtactcacagtgcctctgctctctcatgtataaaatgtgaggaaccatagcaccaaaatcatggaggtgttaggcagatggatgtgctgggaggaaacctgtttactagggggctgggttggagatggggagcttcttatgatgtctgctgtcagcagctttaaaggagatgtgggtgtctatcctggtggtctccctatcagcctgggatcaggtggtgagtggcttcacctactaagcccaaagatgtgttaggaaaacaggccgatatctatcgataaggaaaactggccggcacgatggctcatgcctgtaatcccagcactttgggagaccaaggcgggccgatcacctgaggtcaggagttcgagaccagcctggccaacatggcaaaaccctgtctctcctaaaaatacaaaaaaaaaaaaaaattagtcgggcgtggtggtgggtgtctgttgtccccactactctagaggctgaggtggaagaatcgcttgaacccaggaggtggaggttgcaatgagctgagatcgtgccactgcactccagcctgggtgacagagtgagactctgtctcaaaaaaaaaaaaaaaaaagaaaatgaaactcaaagggtcatgtcatctccgtcatctcctaagtgctgcaccactaaccaggcagataggacagacacatgtccagaacatcgacgcgggcccatgtgcttccctagagcagcgcccccgaggcagggacggataggacttccacagcatcatcgtcctctgagagggaagaagcaacgtgggagggctgcatggccggtggggggtccctctgggatgtgcatgatgctgggggaggggaaggaggagctggagacagggcaagtcctggtagcagtgtcaccctaaaaagggatcctgatccagatgccaagagagggttcttgggtcttgtgcaggaaggagttcaaggtgagtctcagagtacaatgagaagacagagtttattgaaagttgctcagttacagagcagggcgtccttggaaagcaaagggaggaatgcgccatctttgtttttctcatataggggccttgtctatgtaaagactgaactaagctgtgtctgcttgggtgggggagccgacagcatgacaaaatgtatattattctattgttttaaagaaaaggatccttaacatttcagtgtgtaagtacatcaaagcataactataattatctccaaagtgataatgttaccagtactggacatcaaggctttctgttgttggaggagtttttgtccttgcaggcatcaccaagttgcttccttagctgtaaacatcttaggaccatgggctgtgactggcaaggagcgggccttgctagtttcaagatagagttggttttaaaaagatgttgccctggctctcctgggctcttgcttccctgacagcaggagtctcttctgcattttgtatactgcagctatctagaatctgcacactggaagaacgtaagtgtacaggaaccaggaagcttggagaggctgctggcctcctggtcttcctgtaggtactaaggaggcctcacccttctgggatccagggtctctccctcaaggcttgggttagggacattaacatctaaggaacactatccaccgcaggaggctgtagctctgacgtgcccaagaggaaagccctgacctacagtggcggccgctctgttctaggatgtggatggcacagactggtcagagagagccagaaggttctgggggtgagctgcagctgttggcccaggggtaaatgttgggttctacccagtgccatgttaagaccaagggaaagacatggtggacgggtgtggctctagtgaacgggatttccaccttagattctgttccccttgagccatttattgagcacctgctgtgtgccatgccctgtgcggggctgtttgtcctcctgctggggttgtgtttcttgggggacatagctctggccgcagagggattaatcatgcctgaaggacctgggaggcctccaggaagtgtggccactggacacagtctaattcccttctcttccgagaccttcacgcttgcctcctgcggtcctgcccaggctacaaagttgacattgtctcctaaacagtttctttggtgctaaattgtcaggttgcaaaagctatgagggaataaacgggtggtgcatggagctggtgtcactcattgatcaacgtgctattatacgctggggtacaaagggtgcccggtgacccttccgaatctattatttactcgaaagcagtgaccacatccacacacccagggtgacacagggtgtgtgacgaggcccacagatacatgccgatttgcaggggcacctgcactgggtctggggagccatcatcctccacaggagacagcgaccacctgtggatttttgaaagaaaggagtggcatggatttccccgagcgccacctctcattcctcctctcccattcatggtcacagcctgtgtttgagagaaggctgtccagctggggccatctgggtgtggggcaggatgaagctcacgtgccagtgtggaatcgacaccctcattctctttagtatcatgcagtccccacagcgacttctgcttcaggctagttccgtaacccgggaaattttgaggatggaaaagggcagggacaggagcggtcaggagtggctcagccctgagcccagggttttgcccagccgccttccgtctaggctgtccctccatccgcatccaagaagcggcatgcggacatctgtgactgtggaggatgcccatgcccctgtggggacaggaatccctctcctctacacagaggccctgagctgcttcctggggtcaggacacacctgcacaagttgaaaggccggctcttgttctttgaacaatagaaccaggaataattaatcatcggatatagttgggcagagaaactgcttataatttacaattaattaaccttccccttaaaaaaaaaactggagacctaatttcctgtctgatccacattgtttttgatatccattatttttcaatgtgtttttgttgagattaggaaatatttgtgcagaatatctcagtccgattaaggtgacaattgctcaggattttcgttgaaactgtgtattataatgaggctttctgcagcgcatcataaaaggaaaaattctttccatcatttaatttaaaactaaagccagactatgtaaaaaatattacatgtaattttaaggctataactttgttttgtggcgaaaaaattctaactttcagatgaggacaaaataaggtcagcattttttaaaacccttggaaaatccaaactctggtaaatctcagctggtagttaagtcactgtctaattaggattctaatttcacaatctcaattatttttaactttctggtgaatattaacagaatgatcagttttggcaaaatactaggaagaaaaatgtaaactaaggaaattaaaaatgatgatagggttcacaatccatattacctaaaacactcaaccagtcactgtatagatgagtaataacaaagtcagtctcagtataattgtgaacattccttttgaaattgaacatgtgaagacacatgcacacgtatgtttattgcagcactatttacaatagcaaagactcggaaccaacccaaatgctcatcaatgatagactggatacaggaaatgtggcacatatacaccatggaatactatgcagccataaaaaagaatgagttcatgtcctttgcagggacatggatgaagctggaaaccatcatcctcagcaaacaaacacaggaacagaaaaccaaacactgcatattctcactcgtaagtgggagttgaacaatgagaacacatggacccagggaggggaacatcatacactagggcctgtctgtgggtgggcggaaagaagagggagagcattaggacaaatacctaatgcatgcagggcttaaaacctagatgacgggttgatagatgcagcaaaccaccacggcacatgtatacctatgtaacaaacctgcacgttctgcacatgtatcccagaacttaaagtaaaataaattaaaaaaaaaaaaaaaagaaactgaacacatgtcaggagctgaatttaaaacaatgttttggtcagtaccaggacacgaatgacaggctgcctgcctgtccgaccctgggccttatagacagtgtcacttgataggatgttttgagacccggacatccccagcagcccagcatgcacaggctcagagcccacaggtgcacactggggttgtcatgggagacaggtgaggagactggagacaggcaggtgcagaaatgtctctgtcagtatttcccatgggttatctctcacttactagctgtgtgagcttcggcacattatttaaactttttttcccttagttcccttaagggaaaaaataaagataataatagtgtctacctggagtgattgcgttgaggattaaatgagttaacccatctacgcagttagagccggcttggcgtgtgctgggtgctcaccgactgctgggtgtggccatcaccatcaccacccttctaagaggacttacccggaagctgccaagtcttactggaattcaataagaaaacttacttccaaaaataaaaataaaagccacacacacattttccctgtaaatcttgataggaagaaggaaaaggtcaggatgttgccgagcccttgggttggaagaggtcggagtggggcgcgtcccaggtcgggaatgttaggacaaggtggcctctgtcttcatcgtgtgtcttgggtcccccttcgtaatgatactgtcctcaccacgtctttttattatgaaaaggaagagtggcgaggacttgagtgggactgttgggttgttgtgttgcagaggaaatatgctttttgcagagggcttagaaaacgtgcagtgaaaaaaacaatgagccttcttggccccaaggcctgtggctgctggcaggacagcggtcatctgctccaaccccctagggaagagtgagccgtttgctctttttctcttctccaacttcccagaacaatgagggtgatgaatgaagaggtttcccatgatagtgaggtaactctgtcagtagaagccctgagatgtccagaggcctgggctcaccaggccccaggtcagaaggctcggcagcgccccacacttggctttcggatcatctcgtgctgggctcatcttcccttgcggcttcctctgctccctcagttgggcccctgcctatacgtctccaggcccccgaggctggcatgcagccccatggtcataatcaatgttttatgacacctgcagactacaggcaatagtagacgattttacggataatagttaatagagctctcacatcgacaacccaatgagggcagcctgcttctatccctgtttacagaggaggaaactgaggcacccaggggctgggtcacttgcccatggtcacagctggtagggggcagggccggatttcagcctcgaaagtctagctcctgaggccatgctgctgcctgccacccatcccacctccttaaggtgctgtgttcccaccacttcctaatcctcaatctcctctcccctccccatccaggaagcctgctaggatggtccttgtccatattctccttcctggcctccacctgatgatagcttgttgtgatacttgattcagctcgcgagatattcctagaacaacgagagaaaaatgaaggcgcattaggcccgccacaatcaaagctgtcgttcccttctccatccctcacggcccccgaggaacaggccagcccctttccacccgtcacatcccctgaagaacaggccagccccttctccatcctttatatctgctgaggaacaagccagccccttctccatccctcacggcccctgaggaacaggccagccccttcttcatctttcacggcccctgaggaacaggccagcctctttccatccctcacggcccctgaagaactggccagccctttctccatccctcaggtctcctgaggaacaggccagccccttctccatccctcacgtaccctgaggaacttgccagccccttctccatccctcacgttccctgaggaactgggcagccccttctccatccctcacatcccctgaggaactgggcagccccttctccatccctcacatcctctgaggaactggccagcctcttctcctttccaatgggtgtgcaggtccctccctgcgaggccctgcaagtgtctgcaaatgcaccagctgatgcccactgcccagtgggtgttcagtgcactgaaaagttccctctcctcccccactgcagccctcctgcctcacttggagacaatgcagaaccaagatgggatcaatagtcattgatttctcttggtcttgaatgatttttacacaagtcattttgcaataagagggccttcgtacggtgcctgtctgcactgagggcgtgggatgacagccatttttgctcagatttctgcttcctgatccacggtaagatgtttcctccctagctggggagatcctcatggctgaagacagtgtcctggcctcttatctatcctctggagagtctgcctcacagcactggcatagtcgtggtgagcgcaggcactaggatggaaaatctccggcacacgggaggggcacgttcaacaagagttcaggataatccctgttaccacaggggtgttcaggccttcacaggttggcagagggcccaagtgtcatctgctggtcacctcagctctgtgaggaagaaggggtgcagaccaggaagtggctcagggaggtcggaggccagcccaaggagggggtgcctgagtggccccaaccaagtgccgcgctctcccccccgccctctccccgccgccctctcccgccacgcacggcctcctggcagctctgccttttgggcacacgcaccttccgtcttcactgaatccactcccccttcaggtgggcaaacactgcctcttgcagacatgttcttgcctgtgccctgtcctgggaactgtagttggcagttactttgaagagcttaggaaacagcatggagttctgtcaggtggcagacattctagaatctctctaacaaggctgagtcggtgtgtcagtcagggccgggaaacaggccgtggagctgcctcagaaggcccgcaagttcatggccacacctggttctgtgtaggaccacatgccttgtatgtcccattacattgaaatcttttcagactgtgatgaaggaaatacagattttttttttttttttgagacagagtctcgctctgttgcccaggctggagtgcagtggctcaatctcgactcactgaaatcttcacctcccaggttcaagcgattctcctgcctcagcctcctgagtagctgggattacaggcatgcaccgccacgtccagctaatttttgtatttttagtagagacggggtttcaccatgttgaccaggctggtctcaaactcctgaccttaagtgatctgctctcctcagcctcccaaagtgctgagattacaggtgtgagccactgcacctggccaaaatacagattattttaaaaaagacattgaatgtttagaactgaattaaactgataactgcaggtttttgtttgtttgtttgtttgttttgttttgtttgtaagaagggatgcttatattcacagagtttgaaaaacaagtgacctaagccaacccctcattttacagtagaagaaaggcagcccagagaggtgggaccagagctggagcctgggtcccaccgcctgtttgcgtccttcccgtgagagcacgcagcctctataagcagcaggtgggacccaggcgtttgtctatggattttcctctcaaagttgctcttctctttactagggcagatcccaattttgaggggcctagagtctatgaaatttgggggatcctctttagaaaaaggacagaagattgtgaatggaagcaaaggcccatgaaggggagaagctctgagacccagcttctccagccccctggtgcgaattcacccctcgccaccaccccgcagggatgctcccattccacagcaatttcccgcagactctccagaagtgtgcactccggctcactgcttccccagtcttcacatgtttgcttgtcacttgattatcctccccgaagaggagccacttgtactttaaatgcctccttcacatcagcaggcaattaacagtagggaagggagaaggagggtgagcagtgaggcttctcaatcacacaactcaagagcacggggacgttctcccaggagcagcctgtctcttgtgcctaaagcacaaggggcagcggcaataggacggaaggggaccacccacgggctggactctcgaggccaggcagaggccactgtgcggtctttccttccgcttccctctccctgagccttatgcaaatccggctcttagcacagcctttagctcttgtctgaattccaggggaggcccaagatgggaccccctacttcaaaaataagcttgaattcaaacctccagcattgttccacagtgcgcaggccagaagacatccattctgttcctccaattccctgtaaggcccctctctgtgtccagccagatagcgtgtctccaatccatggggttgcagaaggggctcgctgcctgtgcactagatgccaatacggtgacaccaggattttcagaaaagaaaagctttatattaaaagtctattcccagctgggcgtggtggctcatggccttgggaggccaaggagggcggatcacgaggtcaggagttcaagaccatccaggccaatatggtgaaaccccatctctactaaaaatataaaaaattagctgggcatggtggtgcacacctgtagtcccagctactcgggaggccgaggcagaagaatcacttgaacccagcaggcagaggttgcagtgagcagaaatcatgccattgcactccagcctaggtgacagagcgagattctgtctcaaaacaaaaaaaagtctattcccaaggagacaggcatccagctcaactctgcctccctgtgctggcttcaaggcagtaattttatttttaaaggaaaaggattcagcaggcggattctgggattagcaggtgattggtggaaggaacggggaggtttggaaagtccttcagcacacacaattatttcttcacgattactcatgggctgtgtgtgcaaattcaggggggtggggtggaggaaattcagtccatgacatcagcaagctcattctgcacagaccccagttgaccaacttggttctgacagacttcagccagttctcttatctcggggcggagggagcgtcagtgtttcagcaggttgtttctattcttgtctgccattctgcgagctcaagaacttctgttagccattcgtttctttaactctttgaggcattgtttcattattaggatgcttgcttatttcttgtctcttgagcaactgagtgggtggatgacccagtcgattaacaaatgagtgagaaacgagaacatccttgccacactgggacctgtttgagcgtgaggcaggtgagcagaagacatcaggcccagaagttctggaagctccctcaggtgcccacaacacaaatgaagaggaaagagagaagacaaaacaaaaagaagggtaaaggagcctggcatactggctcagccttcctctttcaaaacttttgtttttttttttttgagacagtcttgctgtgtcgcccaggcttgagtgcaatggtgcaatctcgactcactgcaacctccgcttccctggttcaagcgattctcctgcctcagcctcccggatagctgggactacaggcgcctgccaccatgcccggctaatttttgtatttttagtagagacagggtttcaccatgttgaccaggctggtctcaaactcttgaccttaagtgatccacccaccttggcctcccgaagtgctgagattataggtgtgagccaccgcacccagctcaaaacttttttgaaactaaatttgagctcagcgatctaaaatacaatggcataaaactgcaagtctataaactgggcatagctctttcctcctctgctctgcaccaactggggtgaccagaagggactgaacagtctaggggcaggtcttgctcactcacgcgtccatggctgacgctggctgctagatgaggcctgctctgtgtcagccaggacaccaaatgtggcctctccatctgaccagggcttgctcaccacatagaaggtggtgttcagagtgagtgacccaagcaagagagagccaggggaaagccataccaccctgtgtgaggccgttcttgcattgcgataaagaaatccccgagactgggtaatttagaaagaaaagaggtttaattggctcccagttctgcagactgtgcaggaagcatagaggcatctgcttctggagaggcctcaggaagcttccagtcacggcagaaggccaatggggagcaggtgcatcacgtggtgggagcaggagtgagagggagtgagtaggggtgagggaggcaccacacttttttttttcaaggttttattttatttttattttttattatactttaagttctagggtttgttacataggtatacatgtgccatgttggtgtgctgcacccattaactcgtcatttacattaggtatatctcctaatgctgtcatccccttcccccaccccatgacaggccctggtgtgtgatgttccccaccctgtgtccaagtgtcctcattgttcaattcccacctatgagtgagaacatgcagtgtttggttttctgtccttgcgatagtttgctcagaatgatggtttccagcttcatccatgtcccaaacagtcagatctcatgagaagccgctcactatcatgaggacagcacggagtagatggtgctaaaccatttgtgagaaatccaaccccatgattcagtggctcccacctggccccgactctagtatcagaatgacaattcaacatgagattcagacagggacacacatctgaactataacacaccctttatgacctagtctcacaagccatcactttctgccacattctcttcattcaaaacactgccctggttcaaggagcaaagaatcacctcttctttggggagtctcacgccctggaagtagcactgaggctagttttggaaaatacagtgtgccacactcaccaaggcgtcagtctctgtgaagtaaattatactgagacatcagtgacttcatagagaaagggcatgaataacccctaaccacaaataatggcaagaagtatccatggaggcatcttgggaagaggcttctgatgttccatgcctactccaggcagctgtgtgccccacggccttccgcagtagttgaattcgcagactgagcatggcattggacccgatggccttgcttccactgagcctctgcacaacactggccttgggaaagaccacaaaatagtaaccggcagggctcagtagacccggaagcttagaacctgtagaaaagagaaggcttcctgtgatcctcctgcttcaagcaagggctccgccatctctcctgcagataaaaactcaggaacattttatgttctgcttttggagggagtttataactttacattctgtcttaaagaaaacacaagttttgaattctgggataccgagttcctaaaagaaaatccaggcaacaggaggctcccaatgtgtccaacctgcctccgatggtgcaatgaaacagcaagtactaagaaaatcaccaaagtgtggaagtggcaggggactgctttaacagcaagagaaggagaaatcttagtcgtgctagttccacatcgtggctgcctttgacttctggccatttagaaatggctctgctgccagctgggtgcggtggctcacgcctgtaatcccagcactttgggaggcccaggcgggtggatcacccgaggtcaggagtttgagaccagcctggccaacatggtgaaaccccgtctctactaaaaatacagaaattagctgggtgtggtggcgggtgcctgtaatcctagctactcagaaggctgaggcaggagaatcacttgaacctgggaggcagaggttgcagtgagccgagattgtgccactgcactccagcctggatgatagatcgagactccatctcaaaaaaaggaaggaaggaaggaaggagagagagagagagagagagaaagaaagaaagggaaagggagaaaagaaaggaaagaaagaaaagaaaaatggcttgctgccgagggaagagagagagatgaaataaatatgtctcctcaccctcttcctacccctgagctaggcacagttcgcttgtccatatgatgagatatagatgcgagggtttagctgtggattccacagcctccatcagcagcctgcgtgctcctaataaaaatgcatcctagcctcccaccttggcctttcctcacccagaaaaacaaggccagtgaggtcctaaagagcctattctgcaggagcgcatgtgagaagaactcttagagaaacagcagcaagttcaatttccccagagaaccctaaagcctcctatttcccttcagcctcacgtctgtgctccctaagctggctttggatttctctttagctggacttcattggcaggtgcggcaggagggtgtggggagccccctagatacaactgccaaggagactttaagtctgcctcactcccggcctccctttttgtactttctagaactcctcttggtgccctctctacccacacccctgtgccctttctgctgtgcactcaccttgcacagacctgtggatttggatgccccacctccatctgcaccacacctgagctctgtgggcgctcttcacctctatgccctgggcactgcatcttaggccttggatgtcatttggaagcagagtctctcttccttgttaaagcattgctgggatacagaggggagagctgtcctttcccgggcttgggtcctttgtagaagctaaaatggcacctgttgggcagctctgtcttcatcttgtgaatggaattgaccactctcgctcggtggatttgctagaggagcttcatctgatgttatactaaggacctcaagaattcaccttattcttgacctgttaggtccatgaaagtgttactgtaacctgcgtggccaatgagatctccactccagccagcaagaagtgggaaagagaggcggtggtcataccctttctccttaaaggcggaagacaggtgtcactcatcaccttttctcaacccagcagcaggaactcagcacacacccaacctcacatctggggagtctgggaaaggtctttatcctgggaggccgtgtgcccacctacaagccattggttcttttactaaaaagagaagggagtgtgggtgttggaggacaatgagcaggttctgccattccaccttccacaagaggcttctctaatttcctccaataagaaagaggcctctctgtattcccagaccccatagttctttctggtttctaccttgcccactttccccgagttgcaagttgcagttctccttctgtttactgtattacaaacttccaagctttgtctctactttactataccctagggaattgtgtgtactgagtactcagtctttgttcaataaggttaatttccctgaacctccaattcctcagttgtaaaggggcacttaatataagcttgtaggtgcatcacattctctccagagagagaactcactcctaagaaagcagcaccaaaccattcatgagagatccacccccataacccagacacctcccactagtccccacctcccaacacctccacattgggaattagatttcaacatgagctttagtggggacaaacaaaccacttccaaaccacagcacacatatgaatgagatcattcggcattcgtctttctgtttctggtttatttcacttagcacaagtcctccaggtttatctactatgttgcaaatgccaggatttcctctcttctagctagtcattgttaaccagaatgtgcaccaaactcacctgaagaggttttgcagaaaaggagcctgtatcctcctcactgcccccaccaaataccagttctcctgcctgaagtgcagcctcagcatctgtataagcagcacacacatgcgcacaacagtccaatggagtcccctgcaaacctacctaaacctcactaggcaaataggaaataatagtggtggtcacctcttcatctgtcaaacaacctggaaaatgtgaagattcctcttcattgttgcattggcctttattaccttgagcacaaagggatttttctcctactggatatgaccttaatgctgcttggcaggaatgaataacactccagataatggcactggcttcttcaaggtatagtgacaaaaaatgaaaaatacccagcccagatcctacctggggctgaagctctggatacaacttttgccatcttcaagagagaagcagccattgaacaccgactgtccccggatgtatctttcttttctgatgctaaaatagccccccagcaggacagggaaggtgaagaaaagatgtattctctagttttcccaagttaattatacttgctcagaaagccaagtgattcattttgttccaaggcaggcgtccatgcaattaatttcgttgatgaaataggttttcttctgcaaaactctgcttctaaactgcatttggtgcatggcatttaagccaactgcctcattaagctggaatcctgcagaaaaatgtttgcagaatagggacatttggaattaatgctaaaatgtcaaggtttcttctgcccagcacttttttaccccttagtttcttatacttcattatcacattaatgagcaactaacgtacaggaaaataaaaatggcaaggagcgatgtgttcaaggacacctagggaaaataaactaaagctgccctagttttgtacggctggcattttggcgtggcacaggttcttcgcatgtgccactgtctcgatgtggaatgacattcagaggaactaccctctgccatcacacacaccagatacctgtcatccctgaacccgatgacccaatggtcgctaagttcccttcttttattttattttatttttttgagacctagtctcactctgtcacccaggctggagtacggtggcaagatctcggctcaccgcaacctcccaggttcaagtaatgattctcctgcctcagcctcccgagtagctgggattacaggtgtgcgcccagctaatttttgtatttttagtacagacagggtttcaccgtgttgaccagaatggtctcgaactcctgacctcaagtgatccacccacctcagcctcccaaagtgctgagattaaaggcgtgtctctaagtttccttctaaccgttacatttggtaacctgtagtgatggttttgttctacctcccagttctctgaagagtgaattgagcttcatggaaacactctggcatttgctgataagatcgatggaaatagagtattctcagcccagccttgtggccagccttcacccacatttttttcagtctcttgtcccaacaagcatgacccactttggactgtgctggtcagaaccaagcagcagcatttcctttaggtcagagagcgagtctagaaatgagatacaaacaaccctgggtggaaatgaggggtgacccttgcccccccttgcctagtggcctcttgtggaacctacggggtaggaatgaaagtggcctgatgttgcacgtggccgatgatttatcatccctctggtctcagaaaagattgctttgggttcaaaggaaagaaagaaatgagttgtctcttcgggggttttgttgttattgttgtttgtttgtttctgtccaaagctgcttcatttttaaagctcttgttgcagccagccgtttttctgttttggattttcccgagtcggctgtgaattaatgtcccgtggaaaccactgcagggctcctctgctgatttctgtgggctctgcaccttctcgctctgccctgtgaattctgctcactcccagggactctactccagccccattggcccctttcttgtggccctgcagcgcagacgtgattgagcacaatcacccacaaattgcattgcaaatggtgcctattttttccagcagaccatctgctggagtcaattactcaccattccaagcgagcagcctgggcagatctggtgactctgcataaagtcacttctgagtcacctcatcccaaactcgcacctgaacgtccacctcctggctgccaaagcgactggaaaattacagaccctggaggtctggcttccttcctttgtcttctcctcactgacctccacaggcctctgagcttctattggcactgccaaagcttctgaggctgtgagacagacgcagaggggaaggggatgctagaggcggctgttgtgcccctagctttgcagatcgggactcaagaacacacagcaggactggggctcaagtccagtgcaccagggctcctgaattcatttttccctgagcactgctctccatactccgggatgcaccagagtacaggaggtcaaacccgccacagggtttgtatttcaggagactctactgagatgttcaggagtctgcagcagactcggcattgccttcggtggggggctgtctgctggggagtctgaccaaggcaagatgaggaagactcacgtgacaggggagcgaggctcaatgagctgcagcatccccatcagtgccatgccagatgccacagacatctgggcagggaggggcagggcatgcaggcacatcacaccctcagccccactgcccttagagcctggctcctgctcccaccccaggaggatcatgggcagcgtgcctgctgcaggcctctgggcttggctgtgaaatgccaccatggatgacactgacctggcgctaagccccccttcatgaaccctcctcccggccagctggtctcctcctggtgcctcccgcagaacctgggaggctgttgatgtgggctgcttcttccctgtctgggactgtgccctcctgtgggcagtcagcccttggcttccttccaatttacattgttctgttgcatttgatgccctcgttttgtttttgcaatgtgttttcaggcttcttaatcacctttctacactacaggtacatagagcagatttatggtacgcacctaataatagcgagttgaatgggactcatgaattatattaatcattattttagaagcaaatctagagggaattagtttacactatatatagacccagtacaagacagaaccccttgacctaagagctgttcacaatgaaatgggttctctgactggttacccttgggaagtgtattctcccaacgtgttgaaaaaaacgctgtagaaatttcccctctagaatagatatcacaccctacaaaactcatctgtcgttaaaacactaaccaggacactgatgggctaggaaggaataatgggtgtttctggttgaagcccaaaagaatcagtctttcatttcagtccttctgaagatggatccattttggttttctgccatgcatagtgagcttgtacccttcttgtaagaagccacacagagtgagcttgcaccctttgtgtgctgcaaggagcatgctgggcctttggactcattatctgaggagggagctctgtgtgtgcgtaaatccctggtctgcttttgggcgactcagcctctgccagagttcactttctcatttggttccgtctgcatgggacacgcttccatgtgaatttactttctccagtgctgtttttcaaatcatattaagtaataatcaacaatagtacaatcatagttcaactcaaaaggacgtgttgggctcatagtgctcaaatgtgtgcaaagaaaaaaaaagtgtttccagacgattagcatctgtttgattgagctttggttaatggggttttcctgtgctggacttagtcatcagcatcagacatttcttgagcccccatggaatggaagcatgtgcagaacacagtgaaggttcctcaaaggttgtagcagataaggggctctgcagggactcgtttctttcctggccacctcatgttcctgctggtgcagctccaatttccactcacttgttactattcacatttctctactctgttttcccttagaggagattttgaagacacacatcgcacactggtggtctccggatggcacgagactcgcctacgccgccatcaatgattcccgtgtccccatcatggagctcccaacttacaccggctccatctaccccaccgtgaagccctaccactatcccaaggtaggcaaagggacaccgcacagcaaattctttatattattcatgaacaccccaaccctgctcactcagtgtgcagacgtgatcatcagacatgtgtatgagcaaagcagttaacacaagaaagactaatcatgtctcattacattgcattacattcccgcctctgttgagctgagtcattggcaggtttacttcttttaggtaaccgaactaatgttcatcacctgactcagcttcactgaaccaaaacacacagggtacctcccctcaccactccccagtgatgaaggtgcacctgccctctctcacgcatcttatttctactttgagtttggcctctgggaaggcagaaagacttccatctgcccctggtcccctgggtctgggcaaggctgttttgttcatggtcactgctacgggctaaatgtttgtgtccttgccaaattcatacattaaaatcctaacccccaaggtgatggtattaggagggagatcactgggaggtgacaagacatggagggcagagccttcatgattgggattagtgcccttatgtatttgtctattttcatgctgctgattaagacatacccaagactcagcaattgagaaaagaaagatttattggacttacagttccacgtggctggggaggcctcacgatcatgtcagaaggtgaaaggcacgtcttacatggcggcagacaagaggagagagtttgtgccgggaaactcacctttttaaaaccatcagatcttgtgagacttattcactatcaggagaacagcatgggaaagacctgctcccatgattcaattacctcccaccaggtccctccctcatcttgggaattcaagatgagatttgggtggggacacagtcaaaccatatcaccttataaaagagaccccagagagacccctctctgattccaccatgtgaccatacagcaagaaagcgtcctctgtgaaccagaaattgggccctcgccagatactgaatcagccagcaccttgatcttggacttccagtccccagagctgtgagagatacattgctattgtttgtgagccagtcagtttatggtgttttgttacagcagcctagaggggccaagacagtcatgttctgacccaatgagccagtagaacagcaagtgtccagtggctgggagggaatattggggggaacagggatatccaaatctcactttattaccaaatcaaagcatcccagtgtgagtggagggcctgatactaaaacctccacagccactcagctggagagaagccagtgcccgagtatggacacagctcccatggacacatagagtctgccatgctggcttctggcttcactaggcttctccaagacccctgggcttggtggaggtgagcagtttcctgcctgcaccctgcctggtgactggaggctcacttcctgccatgagctgcctctgccagggggcatttaaacctcagcatcctagcccaccagagagctctgaaagctgatggtatgtgcctgctctgccataatcatccccacagaccagctggcttacagtttgcagcaagaggagtgataacttataaggcagatatatgaggccagtgaggttcccagagtcacagcctagagaaaggaaacacctggtgtcttagtcagttccagctgccacaatgaaataacacagacctaggcagcttaaacagcaggaatttctttctcacagttttggcagctggaagtccaagattagggttccggctgatttggttcctggtgagggctctcttcctggcttgcagacagccgccttctcgccatgtcttcacatgaaggggcaagagagggctctggtgtctcttcctctccttttgtggacatggatctcatcacaagggtgccaccctcatgaccttgtctaacctcaatcacctcccaaaggtcttacttccaaatagcatcacactgggggttagggctgcaccgtatgaattgaggaacttgttccatccatacacctggtaatacaggctcctttcaacagcctttgatcagcatggccaacatctaagagagccccagaaggaagaagaatgagacccttatggccacagccttcctttctgccttttccaattctgagagcatctggatgttaacatggcatggatttgccttcgacagaattatttcactcctttttcagctaaccttgattggtcttagtctgtagcatgtggaagggtccagcattttagttggaagcataattaaatagagaaaagtgtatgggactgatgctagttccttctaacccttctacatttcttaccagctgttcacagccaccccacccgccagaagagctggtggctgtctgaccttcatccaacccagagatgaatggttcccatggttatctttttgtgggagtttccccagtctaggagtgataacctggaatccagtagggtgcccttgattttacagtgaactctcagaaggtgctctgaagctgggattatgaaatcccagattactcaagatttggggtttcatattttaatagaaaaccaacattctggctgacagaattcagatgctccttgccccattcccacccactcctaaatcagaggcatgaataggcaagcctgcctgacatgccctgtcgtgggcctgatagcctctgtaaacctgaacatcttctgcagggtggaagtgagaacatcagacaacaccccgaagtccccctaaagaggaagccccacatctctccccagacccatacttgtcccccagagagtggggaacagggaagcagaatagtgccccagttcctttttgaaggacttaatctctccccatgctgagcatggccaccgctcctcaatgtccatcatttgctcacctccaactctccccttcctggcatccaatccatcttttctcccccactcctcttctcgtcttctcttttaagcaaggggctcagtactcacttgacattgccaaaccggggagttgggtggaatgggaagcggatgggattctagaaaagcaagaatcagcccacttagccctttgtccttttgaaaccctacacatgaaccatttgttctccacattaattctgctccttaatatggagctccagtgtcctggagtcccacctcggaatctcccaggaaaggctttgcagagctgaagttcactcttgtataaggctgcttgttcatgtctctgcccctttttaatccccaggctggaagtgagaaccccagcatttccctacacgttattggcttaaatggacccacccatgatctggagatgatgccgcctgatgatccacggatgaggtttgcttccttctattatgttaccaaaaaaaaaaaaaaactaagatgaatgttcaatgtgcatggtctcttctggatcagatttatcttacaacaagtttaaacatccaagaaaaaggtacctttcctaaagatttcctcactgctttatgattccattttctaggaaaagaataccattcaccaagtactattattttttaccttaggtcagatgcaggttatcctcctgagagctgggctcctctgggaggggcatggctgggccccaggcctgcctcagggggacaccagaggaaatgatgcggtcttcccaagacaatccatggagtctgaccttccataaatggtgctctgtatttagagcattttttagagcatggagcaatttgccagtggcaaattctattctaataaagccacatctcccagttggtaaggtcgcaaccctgtggaaggtattaacaatgttattgagttattattattagcatctgattgtggtcgcttttttctaaatcaaaacaactgatttaggatcgaatgtagtgatctgaatatcagtttagtattttccccaaattcaagcagcgtggggaatgattatacttccagagtccagctataacatcatcagccttctctctgttaaggatattgatgagagactcaaaaagaggaggggattttaggggtgccaggacccacccaagtatagattctgaaatttcatgaatggcactatttaaactaagaataactcattctgaggctcagcaaagacccaacccatattttgctatacctccagcctgggcctttattattccattcaaagctccatattactagtagcttctggcagcttctggaaagggcaggaatcgaggcctcaggtctagctcggggatggatgctccagcacctggtgactctggacctctctgaatgatgtgctggtctcctgcagtggctccagtgccacctttgccccacaccctgagctcctgcacagaagcccgaggcctctgcagaattctactgcgattccttcccctcatctttcttcagtgaaacttataatgttgtaagatccccaagtggatggatgaagcccagaagcccagtgctctaggaagcgtgaggcactgcctgcccctctcagccctgcatgggtcttctccccaacataggagggcctgtggctctagaggtttaatgaacctggcccccagcagctggtcccagggacaactggtcactggggtatcagcccaaggtgtgcgctggtttggagagttgaattgatttggctggtgatatttttgctgagatttaaaaaaaaaagttcagatgattgctttggcttttctcctaaagttccatatattttattgttttcctttcagcccccatccctgccaagcctcctggggcctggtccagcaaactcactgaattaatatggaaagtcacctggaaaatttcagccatctgtttgagttaattgaaaatctcgtttagtcaatttggtgatgctgtttccacaggcttgattagcttcaaggacaatgaaaaattagcgtcagccaggacttgaagcctggatgctgggcttcaggttttctggttgctctcatttcctaagctcaatgcaataatgcattttatatgcaatgtaaatttgtagcatgtaaatgtcacactttctcatactgcttctctatcacacatctttgagagtttttaaaagtccacacagatatatcagaaatcccaggctcaatgtagagcagatgtttagtatttgccagccatttgcctgagcactgggaatttggtggcaaatgaaccatggagttcacagtgtggaggggaacctggatcctgaagaagtcattactagcaagtaaatccctgcaggtgtgagaagggctgtggaaacgtgtggaagaggaggccacctggtctggagggtggcagtgtcacggctgaggtcagagtttctgcatgtccatgctactgacatttggggctcagcaattcagtgctgtagggggcagtcctgtgtgccgtagagcactaggcagcatccctggccttacacattagatgctgtcatatctgccttttccccctccagttgtgaccatcacaaatgtctccagcattgcccagtgtccccagattgaggactactggtttcaagtgaaggttctctagccaactgcctgggttcgagttctggctctgtggactctgtcaagttactcagcctccctgcttcagtttcctcatctgtaaaatggagataattttaataagaaacatgtttactctcgtggacagttgtgaaagttagatgagataaggcaaggatcatagggctggttcctccaatcgttccatcttgtggctatacataccccttgtatgtggacaactctcccctgtgtacctcaacctggcctgggtcaggactctaggttcaaaaagccaaccacccaaccagcatttctactgggagtggtcaccatataatttttaaatggtcaaattgtgattctcagacaaaatcaatcaacatgtgtccaagactttattaaactcattaattaataagggaaccagtgagctcttaaaaagaggccatagaaccatcgagaagctagttgtatagaggcaattgaacaaggacatcctagggtgagtctgccgggttactcagccatccgggagagacgcctaccccagcagggttgagaccgcccctgcaattggaaatcaagcccagcatgtccctggagaagggcccagtgatcccacctgcctctttaccaccttcagatccatttgctgacactgtctacacagcatctcaggccgaacccggtcaaagccaacctcccactctccttgtctacacctgctccctgcagtctccccatcatggtccagggcaactccaccttccaggatccccggcctcctttacgtccctctgtgctggggaccctccttggcaggtgcctggcatcagcctgcaaccccccgccgttccccactcctccctggcctggcccaccagcactgccccctcctgccccacccactgctgaccccacacagcagccagagtaaccctttaaatgacatcaggccacgtacccgctgctcccagacatctagtggcttctatttctctccaagtaaaggccagacttcctacagtggcctcagaagcccccatgatagatgatagatagatagatagatagatagatagatagataaacagatacatagatagatagatagatgattgatagacagatagatagataggccatgcaccctttctatcccccctcacatcggctgggtcactcccatacgaggatctgcacagaggctcccctctgcccagagagctcctccccacttaggtcctgatcaaatatatggttcccacagtgacttccctgataaccacatttcacatggcagccccaccccgcttccattttcttccttcaattcatcccagtggaatttttagatacttttttaaattgtttcattttcattttcccgcctgccacctagaacaggaagttgttgaggcagggacgttagttcctgtggggcgggccctggctccagttctgcagcagggctctggaaccttggctggatggatgtattgacttcaaatttagccggtaaaatcttatttgcatgggattcttgaagcttgagatatcttcagttgtgctggtacctttctaagaaccaaaacttacttgctatttagccatggatgacatcttgtcctctcaagcacaagatgctaaaggaactaactgaaactaagacacctcgtctgtggagggacacaaaaggaatgaaccctaagccatgcccctgagcacctaggaagggagacatgcagaggtttctggaagcctgcagtttatttcagcaggctagctcacgaaccaagaggaagggagaaagcagttcatgtatctgctatctaacctttatgccactcattttcaattattttttcctgtttgtttgcttgttaactagattgacttctccgatggttctcagatgcagggagagttaagtctgctctttcaaatctttgcattggcaagcacttactcatcatccatgtggcatgtgctgtgtgaggcccttgggtgattaagacgtgtggcctctcctaatgagagctcacattccaagaggcctggacagcttgtagccagagtctgcatggaagtgtggaaggagccacacctaggagcagaggtgccccttgtggggtgagtgggaagtgttcaggatggttttgcagatgtcagaaggatcccggggcaaaattggaggccctcttgggaaacggttctattaaagagaactaagagcggtgggcccagagtagagctcagccttccttgggctaatgcagggacccaggccttgttaagctgaacctgaccaggaaagaataaacactgtctatcctgtgggtggaaaaaaataaatgcaaatcgctgtgctgtggtttctatgctttcacacagaaacccagctgcactgataaaacaaatgcgcttgttttctgctggtttcctccggcctttcccgagcagttgagctgcgtgttgagttaagatgcggcagatagccagcacgatcattctgaagacatgttgccctgtgctgatatgtgctgttatttgcctccaaagatcctgtttggatgcagcgcagctgctcttctcctgattccctggcaagcagaggcggtaaagggctcccagaacccaagacacaaaaccaaccatgtccctgatgcacctgtgcgcagctgtgggggctcactcctccaccacccgcttccacggctcacgaaaggctcagaggcctctcactttcattttcttttgcttccatttatttgttttgatcccaagcaccaaggatttagatgctgtgcagctcctggcacagaagcatggtcggtccatgcaggcctctctcattttattgatttgctctttttcaactttagtccctactcccatgccctcgccacctcataggcacttatgtcgaatgcttagaggacctttgttcctctgtgtttttgtaaagcctgtattgttgcttgggtatgtgcgcgcttactttacatcaatggcattgtgatagagagccagataagctacaggatagaaacagatagagctccagacatagatgtctgtttctcctattttcctgtgagcaccatgtggagacctagcacacccatgtgtatttgaccaacccacggtttctaactgcacacagtgatgccagatgcccccagctcctgggcagcttacaacctcatggccttctctgcctccaggcttctccccaatatgcactgcccatgacacctccatgctgaccctgatgcgaaactcagccttctctctttccaatttatacaaaacatggtatgtgcacgagttttgggaaagctgagggtcatcagggccatgaaaacagcacagaacaatagagttctcatacctaatggcttgagcacccccccccaaaaaaaaccaccaccatcatcagtaccacctcttccccaaccttcaccacctatacaacctccaccaccaccacaccaccaccaccacaacctctacaacttccaacaccaccttcaccaccagctccaccaccatcaccaccaccacctctgtcacctccacaacctctacaacttccaacaccaccttcaccaccagctccaccaccatcaccaccaccacctctgtcacctccacaacctctacaacttccaaccttcaccacctgtacaacctccaccaccaccacctccacaacctttacaacttccaacactacaaccttcaccaccatcaccaccaccacctctgtcacctacacaacctctacaacttccaccaccagctctaccatcacctccgctaccaccatcacctccatcacctccacaacctccaccaccagcaccccaccatcacctccaccaccaccaccacaactacccccaccatcaccaccatcacctccatcacctccacaacctctaccaccaccaccacccccaccatcaccaccactatcaccgctatcaccaccacccccaccatcatctccactacctctaccacatccatcacccccacaacttctaccaccaccaggtccactgtcacctccaccacctccatcatctccacaacctctgctgccaccacccctatcaccacctccaccaccacccccactactatcaccaccacccccaccatcgcctccaccaccaccaccatcatcacttctacttccaccaccaccactgtcagctctcacttggtccctgttgctctccattcttaggtctcctctgcctccttccctatcataaacaagctctcctgcctcacatttacaatgtcaataacctgtcacatttacaatgacctgacttgcctatggttgcacttttaattagtagtagaaccaggacttgagcacgagtcttccgtcaccagagctattgctcagcattgtttaagagctgtcacgcctactgtatttccctttgtgcttgaactttcaggtggcacaaagctcatttggagggtttgctggcaaaatctctgttcttcctgctttcctccctcaggctgtggtccatctggatgttggggttgttcagacatcttcaggtgattcctaagtgtggccaaggcagagaagcccttctcagcagcagcattttacaaattatagctatgcccaacccccagttccaccccatccctgagtctgccatcttacctaaacatagtcctaacctctcttttgtctgggaagatatattattttatctgaatttgtgttccaattttttttggacgtggtctggatgtaaattacaatttcacaaatgtgctctgttcccctcacctgtagtcctatctctgttttcaccttgtgtgttaaagaaatcatctggctacctaaatactcaaatggattcatcttagggggcaccagttcaaggagattggctccagcagacagctttgtttacagccttgtgctttcagaatcagaccagggcagggtctttgttattcattagggtgagaagccattcccagtgactagggtaatggagaagctccagactagagaaatgccggatctttactgatgtgctgaaaaggaaattcacaaagttcctgttgatcatgggatcattaataaaaatgttcagtgctgtaggaggctggaaatctgagtcacagctgtcagaataataagtttctggtgaagaaagtacattttacattgtcatggcctgtgtttgaaagggcagctggattgttctgaagatgctgtaaatgcagggaatgattggttggttggcaggcttataatgagcaggagacatcagaaaaataaaatgggattctgcgtcgccatcctcatcaataaaacaccttagccatatcttccagctagcaaaacagtcttgacatctgaaattgtcagtaaaacactgaaacactggacaaggtttgccaaggcagagtcactgggctggtgagccagtgctggtaaactccaagggtgtaagtgacatccgcagtttcttcccgtggaccacaagtagcaaattcagtacatggatttcatggcatctgcaggaaaatgagacttggcaaaatttacctagcatcatgtttttaaatgtgttaacatgcattgaggcatgagcaaatattgaggaaacaggttgagtccatgggtgggtaggtgggtgatgaatagatggatgggtgatggttgggtgggtggagggatggattatgaatagataaatgcatgatggatgggtaaggggatagatagatgaataggtggatagatggataatgaatggatgggtggatgaatagatggatggttgatggatgagtgaatggatggatgatgggtggatggacggatagatggatgatgaatatatggatgggtggatggatggatgatggacagttggatgaattaatggatagagggatgatggatgaatgggtggatagatgaatggatggaaaaatggttgatggatatatggatgggtgagaggaatgaacagtagatggatggatggatggatggacagactgatggacaaatagatagatgggtgctgagtgtgtgaaaatgaatggctgggaaaaggacaacatggctttacccccaccactcctattcactgggtgtcttcatgttcacagcattaaattgttgaaaaaggatgccgcagtccctaaggcgcgttctctgtgaccccctctcacttcgttctccctcatcctgacagctggccctgcattatagccagcccttgagatggaagggacaggcagcatggtctattcctacatggaaagtgaaattatggaaacagacaccaaatagtaatttgtcttaagtcgtcacttttctgtgttgtagaaggcactctgccggcagatgtttttatgcaactgcatggctgcccgagagcatactcaaatgtggaactgtacactttagtagagcagcgcttggtatttagggtcgtttcagtttgctcagcggtgccctctattaaagcacatcatcttttaaaatgtcctctctcataacatttttgtacccctgctcaatccatgggataaacattgctaaaaaaataccagagttaactgtgggccctttatttcatgagataaaccagctttgttcccctcgccctttactgccacacaactgtcagaacatttgccaggatttgcaacacaaagaagtatcacagcacattaatccttgtgacggagacaatgctctattaatattttatggcaaacaaatggactaataaaaaattgatatgcttctcaccaggaagagtcactatattctgatttgaaggcacctttggcctaggactcatggaatgtaataacgtttcctcagccaggctgtgccattgcatgtgctcccccacgtaatccatggcagtccccaccctgtgctgaagttagtggcttgcccatctctgcaccgtccgcacctagaaccgtgtctcccacatgccaagccctgactagatgcgcttggatgcatcagtgcattggtaggcagatatagtgctttagaataaagagaaatttggtagcatttcttccagctatcttcgcttcctgttcatattttggtatcatgctctttttaaaatggaattttgattattaaaatatgaccatctattttctgtgattatcaaaatgcttcaatatctctcttcatcttggcagatagattattgcgtcttttagcactcagctccagccttatgttaaaaaatgattccacttcaaatcctattttctcctctcctttaactgctaccaaatttctctttattctgaagcactttacctgcctaccaatacatttacccattcaaagaatatttagtaagggcagatttggaaatggagatctatagttaaatagcgcttggagttattctcatgtggtcgcccactgccagacagaggatcgctcgtctccaatcagtagttctccactcgagctggcactggaatcacctagggccttgttaagccaggaagtgcttgtccccacccccagagtttcagattcagagggtctagggtgaggcttgggagtttgcatttctttttcttttttattattattattttttgagacagagcctcgctctgtcgcccaggttggagtgcagtggcatgatctcggctcactgcaacctccgcctcccgggttcaagcaattctcctgcctcagccccctgaatagctgggattataggcaactgccactaggcctggctaatttttgtatatttagtagagacggggttccaccatgctggccaggctggtctcgaactcccgacctcaggtgatccacccacctcggcctcccaaagtgctgggacatgcggttcctaacaccttcccaggggctgctggtacaggaaccacactgtcagaacctgacttgcctccttagagatgggggtagaggctgtttccaccacctgctttctcccctaattgcatggactttgcctgactttgccacaaaggcctcgcatccccatagctgtcctgctctctctgggtggcctgacctccctgggcgagggtgacaacactgcctgtgattgctgcgaaatcaggacagctcacacaggacgggcagggtcttctctcgtctctgcccgtgcttccttctaggcagcagtgccttctgagtacagtcatggtggtgccaatgatgtccctgtatgacacgagatgtgtcacccatgcagacaccaacaggtttacagggagcagcgcgggtcagtggcgtgtggcattattgcggctcgctgagcagtgggcagccattcccgcagcacaggattctgctctccctccacttccctttgtgaggcatggacgcctcccatcagtccaacctgttctcatgactgtgccttctgttgacgttgagtgttctggcattataacgttcctgtagagtctccctctgatcaatgcttccctttgtcccctcgagagacagtcttactcggggcatgggaatttgacaggcatctgcaggtcccacgccttgggacagaacacacatgagtagaagcacttccttctccttgctctttgtctcaaggagctccccgcctggccaacccaggactgtgaggaagaatggtaaggcctggaccttgtgagggaggaggcaggaaccagaagggctggaaaagggcacaggacaggctgacaaacatggctttcttggaggctatctcttcaagcctccaagaggagctttcttggagacagctcttctctgccctattttcatcattttctataggggcaaagacacctggggaactgcacaaggaaaggagagttttcggctccagcttgagccactgggactttcctgcttggagaaggttgctgcaaggggtcctgtgtgtttcattgcctgtgagcctcatgcccaacatggaacctcctgcatggcgtgaacagtgcacatccaagcttcgacagcagcctctggggagggaattgagctacaacttgcactgtgaacacgccattctcctgggacaagaggccctcataaggagagagacctaggacaagagtgagccagacctcggccccagctgtgcggacacttgcctgaggaaaaccttaccaagcccccacccttctgtaaaattcagaagtcacagaagcttatccaagcaaagcccgcagagagctcagcacaccagagcctttaacactcaagcacagttttctgagaaagaaacacttcactgttaaatcacagcaacgtacttgttccttcattttttttctaaaaggacaggaaaaaaatgtacactcagtgagctgatgtagattctagttacagggcagtctggtttttgcttggtgagaaagccagctcaagtattggtcactgttgagaatatacgtgagacccttacctgttccgagtttgtgaggtcagccaccaccatgcccgtcacaatcaggcaggggtgactctggagagctccatctaggctccctgaacaaaaagagcaagctctcaggtctgcagcagattctgtgtgtcctatcaccagctccctacctcagtccacagacccgtctaatctgaccttgccaccttcatgaagacttaatcattcccatccccttatcagatgaatgggtgggcattattaattaaatatcctactgcttctgtgccctttcctgccttcttttctttgaattaaacttatttcttgaggagcttgaaaaaaaatatcttattcttatgaacttggtctggttggaagcatctagagcggctgtgatcaggtgtgtggggaaggacatctccaccgtgtaccagtgagagctagccaataggttcagcctcattcagaggcactgaaatatttctccatgacaccgtgggtttatttattgttgttgttaagttttatttagttttaactttgcttttcttttttatcaaagtattgcatattagtgcttaaaaataaaataatatggaagagtctatagtgaaaaacaacagtctcttccctctccttctaacccatctcacccccagatggagatgacttttcactctttttacactttctcctgatatataccatcctatatggtaaatcactaagcaaaatgcacatttcactgtttttaaatgaattttagtcttatttattgtctttttatgatagacaagaattcggaacacttaccttcctacctattctaccccctccatttatatgtggattttattctctatgtcagttacctttttacatttaaatactattacaagtttgttcatgttacattaactacagagaggagctcttaacttcccaatttgtaaactgagattagtcccccgccctttcctacaagtccctttcctgtccctaccacacagcaacttctgcatctttgtttttacttttacatcattgaggttgatggcatttacactctgtcctgtaatcataactaaaccttccttacttttccattggttgattctaaaagattaaaatcaataaatagcatttactttctcataactaagtgattatctttcatgatagagctaaggagtgccctgtgattgcaattctttttgtttcactttttgttttcctggagttttaaattgtttttgttttttacctgaaatatttaattttattacatcctctctctccttttttcaaatcctctcagctattctgttgcattgcccttttccccaagtctgtctctctgagtgccctccatagccctggtattgtctggactactttttccaacctctacactaaggccatcctgggacctccccacagtgctccctcatgttggggcaactgtttcctagatctcatagatcacgtgatttactccctcttttgtctggagtgcattctcttaatgatttactaagaaaggagtgcaggaagtaaattttctgaattcttgaatagctaaaaatgtctcttttttcacacatttgaaattttagctgtatgtagaattgtagtgtttttattaactctttattcgtcaaagctagagggtatagctccattgtttccagcattttgagatgctaaagataaacctcatgttggtctgtgatatggtttggctatgtccccacccaaatctcatcttgaattgtagtttccataatccccaagtgtcgtgggagggactttgtgggaggtaattgaatcatgggggcagttactcccatgctgttctcttgatagtgaatgagtgctcatttgatctgatggttttataaggggctttttcccctttgctgggcacttctccttgccaccatatgaagaaggatgggtttgctttcccttccaccatgattgtaagtttcctgaggcctctgcagccctgcagaactgtgagtcaattaaatttctttcctttataaattacccagtctcaggcagttctttacagcagtgtgagaatagacttctgataattgttcctctgcaaatcaccttttttctttccaaaagctttttgaattttgaaataatatatctatgtgtgtgttttcttttcacttatcaccgtttcatccatatactttcaatcgttcctcctgtttgaactgcatttctgagtctcatacgatgctttacctggagctctgagtccccatgattctctctgaggtttcagctctgcaagtgtccaggttgctgtgccctccagcctgactcatccctcatgacccttctatctactttctgtcttccagaaacatgaaatctctcagccctcccctgttgtctttattattgtacatatattttatttctttattatcattgcaattaggtttctggagggaaaacaaactaatgtgataaatctactaacttaagttggagacttccagtgttttcttaataaccatcttcttgtttaaaaagtaacctatgcagtatggaaaataataatcccttgtcattgcacatcacactacccgtaggtaactactgtgagaaatttgataaattatcctttgagatttcttttctggaaatgtatatttgttcttcatttatttgggtttttttaaaaaaatgattaagccattttcccaacaccatcgattgtggaagtcttcctttccctactgatttggaatgacatctttattaaatgtaaaattatcatacaaaccagtgtgcattaaaggtgcctgtccactactgatggttgcctcagtcagatgtcaggtggttccagaaatacgcttattattagcaactttaaaaaataaatcccctgtccctatgcttcctttttaaaaccacctatctatttcttcttatatgcgaacttcagaattattttatttgactctctactgaaaagaaattcattggtttgctattaaaattaaattcatttctttaaccaatattaagtatttaccatgtgtgaagccctatgtaaggtgctaaaaaatgtacaaatgaataaggtgggtatggtctctgccattatgaaggttaaatataataaattcagttctttccaaactgatcaccattttgaaaactttaccatgtcttttctcttattccagaaacataggtgtttctattccttttttctaaataatatccttccatttcatcatgtgtaatgctgctatgttttgtttttagccttctttttgcaatttactaaatgcttatgatcctacaaactatttgcccagtatttctttatattatttttatcacttaatttgaatttatcatcaaattgatagtagtttagaactagctatggatgaactgattttagagattacttttttttacatgttgagtttttaattttgagccattaattttgagttgccttcataagtcagtgtagaatatattcaagtaaaagataaggccgggcacagtggctcacccctgtaatcccagcactttgggaggctgaggctggcggatcagttgaagtcaggagtttgaggccaacttggccaacaaggcgaaaccccctctctactaaaaatacaaaaataagccgggcgtggtggcgcacacctgtaatctcagctattcgggagactgaggcaggacaatcgcttgaacccaggaagtggaggttgcagtgagctgagatcgtgccactgcactctagcctgggtgacagagtgagactctgcctcaaaaaaaaaaaaaaagtagaagatacactttaatacaaaaatatattggttgttaaaaaaacacattgaaatattaaacattaagtattagcaatagacagaaaggaggagaagcttcagatcagcctaaattttgatcctttgtcaaaacttatttccttattactagattattgtggaatttcggttttcccataactcaaaggttctagcacaacatatttagatgtttcattattttccctggaatgtgggaaatcccttttagtcttcacattcgggtcttttttcctacacagaagtttcgtcctctttgtctttggttatcgtgtctgtagccactctggtttctctgtagaagcactgctcttcccagccggtaggaaggctcatcttcttctttacacctccatgtcaccttcctctgccttgtgggagaacctcccacattttcctcaattttcctgacccaaatttttctaattttagttttagtttccttgcagccccctcatctccctttttgatcttatcttggacttttagaattctgttctctttatttttagtgtgacttccctttcctttattctgcaccatttgaccctcacagttccgcacctcaggaaggagaatgcctcccacacctgatacctggccacagacaaagggtgagagtcacctttgactctgtgttctgactttttaggtgctactgagctcttctccggtgtaaatctggaagacagtctaacccatgtgcatctggcatggatcgtctgggctgagttgacatttttttttctaccttcttaagaatttttctttgacattctatgtaaattagtacacatggaaaattacaatcttccttaacacccatttagcaaaggtttgactttccaaatctgtggctggtgtgagcccagcatttctgagggaagaatagtacagtggggaagagaaaaaccttttccttctgcgttctcatggctggggctgccctgttccctacagggaagaaactgggcaagaccttgtctggtttcaccagtgccatctgtgttgcagttagagattttcaacattcatttctaatggcattgtgacttttcatcatttctgtgtgtctctttagacatgataacacaaagttagtaaaggtctccctctgccggccaggcaccactgcttgctggagacctctgtctggagagtccacactcgatgtggtgtatggtgtgctgtttgtgagcaagtaaatgttttattttcccttccagcagcaaaagtgtgactacaaaccttatagagcaaaagaatgtccctttgtccaaagcgtcgctgcctcgcaaggtgcctaccttgtccccagaaagctgctagaacgccttcaagattgccctgttggtggtgatgcttcaccctcgtacaccgacttgatttttagaaaataactaaaatgtatttggggccaggcacagtggttcatgcttgtcatcccagcactttgggaggccaaggcaggtggatcacttgaggccaggagttcaagaccagcctgggtaacatggtgaaaccccgtctctactaaaaatacaaaaattagccgggcatggtagcaggcacctgtaatcccagctatttggtaggcggaggcatgagaatcacttgaacccaggaggcggaggttgcagtgagctgagatcacaccactgcactccagcctgggcaacagagcgagactccgtctaaaaaacataaaaaatcaagtgtatttggcaccaggtatagtcactgatgcaactcatggacttaggaaatgttgactagagatgagatgttgctatgcgggtcatgaggcaacatcaagctctcagggcaagtcggcacaaggggcccaaaagctttatgataaatggcaacaggattagaagaggcaaagaactgcccaaaatgtgagaatcacggcttccttacatagaggtggagcccttatggatgcatgtatgtaaaaagaaatcttattatataatctttataaattccattaatagtgtttattgttttgggtttttaaaaatatttcacactgtatttcatcaccataacatctctaagggtgccaccaggctttaaaaattcatattacacaaatgaagaaactgagggttgaagcaccgtatagaattaattgtagaaccaaggctttctcaggcctctgaggtgagccacattctgcccctcaacccagggatgagccacgaggcagagtgggtccacatttaactgtcctaatttttagtacaattatatttttcctcagtgcaacagcctcatattacaaactaagagaagggaggaaaggagggagggagggagggagaggaaaggaaggagggagggaggggaggggagggagggagggaaaaaagagatgatctagcactcactttatgtaactggtcattttacttggggctctgtattagtcagttctcacactgctaataaacacatacttgaggctgggcacggtggtccatgcctgtagtcccagcactttgggaggccgaggctggcagattacttgaggtcaggaacttgagaccagcctggccaacatggtgaaaccccatctctactaaaaacacaaaaattagccaggcatggtggcagacatctgtaatcccaactacttgggaggctgaggcatgagaatcgcttgaacctgggaggtacaggttgcagtgagccaagatattgtgccactgcactccagcctggggaatagagtgagactctgtctcaaaaaaataaaaataaaaataaataaataaaataaagacctacctgagactgggtaatttagaaagagagaggtttcatagactcagttctacatggctggggaggcctcacaatcatggtggaagacgaaagaagggcaaaggggtgtcttacctggtggcaggcaagagagcgtgtgcagggagactgccatttataaaaccatcagatctcgtgagaacttattccctaccatgggaacagcatgggggaaaccacccgcatgattcaattgtctacacctggccccgcccttgacatgtggggattattacaattcaaggtgagatttgccggggggacatggccaaaccatatcaggctctgagtaaagaaacagtgtggtggctacttctagaaaataacaaaccacaccagagtaacacatccttgcctccttctaaagccatgaagcaggcttgtccctgtgtgtccacgttttgtggccaagagctttaagcaggaacagtactgtgactccgcgggccatgtcactgctgttgatgctgcacaccccagccccctggttccatccagtggcactcagcctagtgacatttccagcacgatttgttctggaggcatcaagagaaagtttgcatccatctcattttcatttataacatttcacttccaaattaagaaatagaaaaactaagaatagtgtgtagtcatatttggcctagatgaagattatttgtacaaaagaacactataaaaagcagaaagaagcataggatgaatgaatgtttccaacaattgagaacaaaagcagcattcttcctaattagcatgaaggacatagagggaaaaaatagtcattccgggagaccttacattttctttcttgattgcatgcagacgaaatgtgtttgctgagagagtaagtgcagggtaccctgtggcttcgccactgcccccattgtggacatggaatcttgcaaccacaggccccatgtggctctcacacacgtcccatggtagggaataagttctcatgagatctgatggttttataaatggcagtttccctgcacacgcttcagcgtcctccagtgtggactcaaagaccagttacaacatcattaaaaaataaaagtgttctatgtaaagcaagggctaggcagagacgttgaattatatttaaggacaaaagtgacatatatttttttcttatgattgtaaataatgaccaaatcccatcattataaatgcctgtccctgcctttgggccatgaaacagcaaagcaggacctttgtagaatgttgctggcaggatgtgccacctgtcagtgccagggccaggatggagagcaggggggagggcatggtccctgtggacatgcaagccaggttctggggcaggccaggctctaggacgggccagtatggggagcagatggtgggaagaaaagcaaccatgtttcagacatcacagaaatggagcaggttgaaaggcacgagagctggattacagctgagcgcccctcctgtgttcacgggttatgtacctcctcaccaccccagtcctcaggaactccccatgaccacagtgggcagctgcagacctcccctcctggccatgcgccagcagccgcctgtcttaggccctcacctgcttgccgctgttccttctgtttgccacatggtcctgatttaggtcaagttattaagaaccttgattaacaagttttaattgtgggaaatgggggagatgtggcactggaatctcctggttaactgaggctccagccaaggcatctggctatagtcgtttctgttaaaataattattaagtgtagtgaggtcgctctctggctcgccaggaattgtctagtgaatgtactgctgtctttagtgataaaagatcttgtaagaccacaaagtaatcattctgaacagtagatctcattatagatagagaaggggtgaatgattgaacgcgcattagctggcttctagaacattctgggattcacctggggatggtctttttggggcattaattttctcaacactttcttcttcctcttaaatgtaaaattgtatttttttaatctggtttttggagggctctgggtgactggatgaattcccagaagccccggtacccctcgggctaagtagagagccgcacagagcctgtggtagtttcaggtttgggcagaatcaggcgcatgacccttaagatatcaaaccaagttcgcctgaagcccagagccatgaaccaatttccctaattagctagagagtgtccctgggtattttatctttaaggaggaggaattagagaatggagccttcaacagcccaggctgggatgcttctcaccctgtgtcgctctctggggcctcccgccagcccttttccggttctttctctgtcccgcctccccggacccctcgctgcccggtcaggtggttagttgtgcgtttgcctggtactgcggtgtgaaagtcaaggcatcagctggagagacgagacctcaaaacccacggagcagcccccacacccctcacccccagggcagccacacgcagtgacatgcaactcccagtgtctttgggtttatttagcaagaggtaatgactgggcggcccctcagagtcccgcgccagtgcagattctttataagccagatttcagaagctcgcaggctggctgtgtcaccactggctccggcccccggctcccgtgtcgtgtccagggctggggtcggcggtcccctggcttctgtcgtgcgggggtcctgccaagctgctcatgctgtgtttggcgtttccagggagtactacatcaccatggtgaagtgggccaccagcaccaaggtcgccgtgacctggctgaaccgggcgcagaacgtgtccatcctcaccctctgcgacgccaccacgggggtctgcacgaaggtacgcggggctgtgggggtggaggggagacgggtgaagaaccgatggtcagacgcgcccgaggtggcgccagagtcgtctcagccctcgggcctgggacttggggaccggccgcccagctgctgcggggagcccgcggcgcagagtcccggctccggcgtggctgccacctcgtggctggtgcaggcgctgccgcagacccgaccgaacccatccgtgaattgccagaggcgccccgtgcctggcacctggacgccgtccgcagttcactgagtgttgcttccctttatccgcgctcaccgctgtgacctaagtgagcgtcctcctcgttgcagctgatgctcagagaggaggggccctgcctttccccagaccccgccgacagcctcccccagcgggctccaggcgtgcgtccctccccacgtcctggtgaggccagccatgtttctaggagtctcaggccgactcagtgtgtagtgagagaaggtaaacgtaggggaaagaaaattaaaatgctcaaagagtgagcaaaggaaaaatgaagtgtaagagaggttgcccgggtggagcaggcaggcggcccacggcctcaccctcgccccatgggatgggcccccagaagcaggtcaccttgtggcgggttttgtagacatcaaataatatcgattaatacattcaggcaggcctttcagaaactcctttttgatcttaagtttctgtctcctggctgaggggggccaaggcttgcaggcatatttacttgagaggctcctaacacgacagctgtgcctgagatcctaagcacagtgattgtttctaaggtggtcagtcttgcctgaccttttatctaacctggggcggattccaggctattctgatgagcttgcttgaggggaaggaaggaacgtgaggacacaaagcaggcagctaaaaatggcttgtaatctccaacttctccatgcccctgagccttgagtgtcagtggcaaacactgcttcctgctataacccatgacagaggcctgctccaggggcccggaggtccagtctgcaccagcaccaggcccacagcgcctccaggtgacacatgtgtgctgcacagcttgagtttggtgtctggagttttgtttttcttttgtttgcacctttccatagaccactgtgagacccacttttcctctatgctttagcccctttgaaagggtttctggtccaccaggagtgttactcagtattccagaatgggatctggacacaatgtccaatgttctgactcagtgtaggctgaggttcactattagatggacacatgcccgggcagtgatgaccgccccctggtacacgtgccatcttcccccagagggttcttttccaccacgggtttgtccttgttgctagggatagtggcattttctaattcgaggacgcttgtgtttggctccgagccacgcacgagacaaagaggagagctcgggattgcctcctcccagagctgccgtggcagctgtgcaatgcttgtgcagcggccatgtaggtgaagccaaattgtttcctgcactgtcggtcacagacacaatacatgcaaaaaaaaaaaagaaaagaaaagaaaaaccctcttgtctaatgctctcatttcatttcagaaacacgaggatgaaagtgaggcctggctccacagacaggtaactactgcatgtccgggtccccactgtcacctccacctgatccaccccagggctggccctcagagcttcgacaacagcagaatggcttctcagagtaaatcacacagggctccccaggcagaaacagacggcgtgccggctccactcacggtgcctcccgttctccagggttgcccagagagctccaggagaatccaagttccagggagggtcgtgtgaaaatcacggctcttcagagcgtggaatgtttggtgagacctcagcttgcagttagatgccagcaccttgctgaattgaaaatgaacagtccatcaaaggtggcttaacataatctactatagtaaaagggtggaaaagtggtggatatccctgtttgttgccaggggtggttttgttggtgtctcatttggagtcacctcctctgtgattccgtaagacccgtcctcagggacataactgcaaaccatccctggagagtcttcatccctaactcagataaaggaacacacattaaaacagactctaggaacttgagaccaaaagagatcaggagaagcccaggtaaatcattctgagacaattttttctaaattaaacttgcacaaaaagtatcagtattttctttcttcaagcctttttgtctcattccacactctgacactaagaagaacaggtgaaaaagctttggaagcttcctgtctccttatccttcctaaggggatgaaaattgtcttaaagactctggaaaaagtcaagccagacttcagtctcatgaattatggtagagacacaggtatgcttcttcatcgatatggtggatcctatttatggaaaataactgaagctggacaaaactatcgccatggctctccaagaacattccagcactatagatgctgggctgctgcttctgcctgtggagtcaggaatataattatctcagaagtcagagcctcatcaacagacgggctgctccgaaatgtatcctgtttctgctctgtgtcaatcttattcacaagaggaatggttccacatggccactttcattttacatgtcccaatttgggtgccaagtccaagccaagaagatatcgggaagagggaagacttagggaaccctcaaacattagcatgctggaaagttcttgaatgccacctggaccaaacatataagcatataagcatacatatcaaaaatagtattgtgatgttcatctcacattagacaaattgtcagagagattacaataaaaggaacattttgtaaactccgttatctatatatcatgtgttcaaccaatatttatggatcttaccaggcaccatgctaggctgtggatttcaaaaaatgagtcggctactatcactgagcacacattgtggtgtgtgtcagaattttattccttcttatggctgaataatattccagaatatgtatgtagtatatatcctggaatattatacatatgtatgtgtgtgtgttatatgtatatatacatatatatacaatataatacatatactggaatattattcagccgtaagaagaactgaaatagtattccagtatattccagtttgtttgtctgttgatggacatttgggttctgtctaccttttggctgttgtgaaaagcacatctaataacagatacaaaaggctaccttattgtacaattccatctatataaaatatccagaataaataaactcatagacacagaaagctgatcagtggtgtcccaaggccgggggagtatggagaggaacagcttaatgaacaggggtttattttggggtggtggaaatgttttggaactagatagaggtggctgcacgtcattgtgaatggactaaatgccactcaattgttcacttttattagtacgttttcttttgtgttatgggaattttacctcaacgattttttaaaaaattaataagctagagcatgagctcttaaagatggtacatcctagacagggagatgagatgttcacgttacatccattgtgcaggctacgagggtgatcctcagacattcagaagcattgctgaagtattcgggtgttggtgggagtgggagccagaaaaagcgtggtggacatggagcaggaggccctatgccaggcccactttgtgtttgaacaggaggaggtgagggacgtgattctttgttgggggcagggaggctatgggaaagcaaggtggacatgcacactctgcttccctgtccccctcaagaggcattctcacagggggagctggcttcccagctggccacctgcagttctgccctctggatggacggcagagtgcatggtccctggaggcccatggggggccgtggttctgtcctccagcgctcacttcattagctctacagagtagctacagagccgaggtcgtcagcaggactttcctgtattagcgattgtgtgtctcatcgcccatatgagaacagctactaaagtgtggggtaagacagcctgaatgggattccagaaaccagatccttccaagcagaatccagtcaacacttaaaaggtggcatgaattaaaataattcttactgttttcaaatgtaaagtttaaagcatttactaagcacacagctaaatttttaaaatagctgcttaaacgtatgcaatgctgccatgagttggaaacataaggttctgtgacaggtgtgttttcctgggatggagcgtccctgggtcaggtcagcccatcagctgcagttgtgattgtgacactgggttggggcatcccgcccatggcagcagttgggaggccaggatgtctctgaagaccctacaggttgtgagtctgcacctgtgaagattgcagctccatggtctgcaggaagatttaatttcaaacagtttcttatgacattgtttttttcgtaaaggaattcatggaccctatttttcaaaaacaatctgtagtgtttctgcatccctcgagttactgtgatatcctggagaacaacttagtaactttttaagactgaacctgccacctgctgccagcgaagccattggctgctgcttcagacagagcctaagggggttttcctgggagggctgcaggcatgagtgagggagacacatggaggccacatgccctctacccatccatctccaatgggtcacagaagcttgccccagctggcccaggagaaactggcatctggaaggtcctgcagacctcagggagacccggcctgcttaggtccaccgatcttccaaggacccggtgcaagaacagaggtgagttgtagcgagcctgctaattttgtgtcatctgagctgttcatctgagccgttcatcctcctctcttctcttcccaactccttcctggaatcctcagtacggtcacccgcagagattccccatgagccaaacagaagaggaaaatgcatgtgtggagacccaccaagttccctctcctctaggaatattccagagaagcaggcaatcccccctgccacatacacaccctgtcactgctgcgctgaccctgcagagtcagtcctgatgcagacccatgaggatcctctgccagaaccatctgcatttgccatagaaccccagagcctattgttttggttgaaggatcggttccatggatccatttctgactgtctttattcttttatcggaattttggttttgtgatttcaaaatttgggctggaaggggggttggacaaaattattatatctgaaccatgggaaaaaaacactggcaaaaatgctacaaataactcacaaagaagctctcatgagtcaaaagggctccttcttcacagatctgctgagtggagttgaggaaaccaggcattgtgtgtgataaattctgttatccagagagactagaaacgcttcccccaaaatcaaatgagagacagaaccaggataaaatccaggtcccctggtcaacaatcattgcactttgtcactaaaaatacatttaccacatgagaaaccgggtctcagagagactcagaggcttcacctgtgttccgaggaatgtttccctgacaaggtagagatgacatcacaacggtggaggccttcttattataaaaacaatgcttctggccagaattaattatttattacatttatttagagtatctttgtctgccaaacgtgcaaacatttcccccagaaaactgaaggaatatagcgctacccgccgcacagttggcaaatagaagtgcattttaaaagccaaattaaccgctggtttttccatttcctctgcttttaaataccatgcttccaactctaaataggaaaataaatgtttgcagattaaaggttccattttattgcaaatattcatgaagattaaatgtcattttaatcacatgttagtttatttctctgggcatatcatatctgcatgggttcactcactgtagggaaatgagttttgcttgtgccagctggggtttatttaccattagttctcatccccgcattcgtgtgaagctccttgagtcagaaaatacatctcgcaaccaactaattggtgttcacggatggaaactttcaaacttgggcttcagagaggccaaggtaccgcggtagcaaaatcctttttcgcccatcaaagcaacagccaccctgtgggctggtggaaggctgaggccgctggctgttcactgtccggggaccaggcagagatggtggcgacacctgccctaaatccagcctggaacccttcccccagggaaaactgggcatgctgattctgtttccagggaaaagagacagtagatccaagcaagtgttgtcatccagtgtggcccgaggtggagcgtgtccctgggactgctgtcccctcccacctgtgttttagaacccgtggcatttgtccttgtgtttattttctttttttcttgccttcttgatgggctattcagtgtgagatcaattgtattcaataagaagaaaagacaggattgaaagaatagattttgcttttaggcaaaatctggtttgggattgttgagaattatgtttttttctgatatataataaatgccactggagaaatctcacaatacactctggtttcaatgggcaataattcaaggaggaagcacctccttttgagttttgagagcagagttcctgttctcactggtgagcttggcgtgcacatggggctgggctttgtctcggtgctgtgtagactgagggatgcctttttatttgccactgccggggctgtagcctcttaattcctccatcttcttcttttagaaaacgtaacagttgactcatgattcccgaggaaagtgacggcctcatcaagcacttattatttcaactgttcctctccttagaaatcacatagaaaatgtatctcggggtgtattttatcctggttcaacctcttcagaataaatgatgttttagttgtggtttcatccgtggcctttgtccacagaatgaagaacctgtgttctccaaggatggccgaaagtttttcttcatcagagccatcccccagggaggacgagggaaattctatcacatcacggtgtcctcgtcccaggtaagtcctgctagtttccggagctgaactagaaactggcctgctagaggccgtggggtgacagcctctagggctgggcacacttgcgttttcgaggaccccaaggaatctgaaggtggttcccgaaggcagggcagggcatggcgctggtgagtgcagaggttcccatcaggcctggtggaaccttgctctatctggtcacgtgcgagaatgtgaatgacgcttctgccaaggtcagcagagaccctggggtcccctgttcagtgtaaggccaaggatgttggaggactgtctgtgccgggggccctttccttctccctctgctgagggtctccttaacatactccccgctgaggcatggctccatgcactcaacatccctcaggggtccagcctcccatgctgccctacctccacccggagttggatgcaggtattattttattatgtgaccgctaccagccatcactcactggttctggggtctggcgagttcggaatggagcatccctgagtagggaatctcagagattaatatacgtgaatctaggatcaaaagtagacatctcggggtcaccatctcctgaagaggtcacctcagggagcctcacgcctgcaggacggggctgccatggtgttgactttgggggactctgccctgaggaagaagggaagcatgatcttggatctcctcagttttggaggcagtctaaagttatttgggatcagggtaaatgaatgaaatttgattagagaaaatgttaatcacaaatattctatggctatgacatagaaggctcatatttatgatgaggcctcaaaggcaatttcaaaagaaaatccaagaacatccgcactaagagcagctctgatggaatcagggtgggggctgcgggacccctgggatggaatcggggtgggggctgcgggactcctgggatggaaatggcgtctcttggaggttcaggtgcaattttttctcagtgcacttcatgacacgattgatagaatgtctgcaagctgttgcctttgctttttcctgcggtcttcattctaccatccaaattcttttgtttattattttacatcacttatatcaagattttaaaatgctggccaggtgcggtggctcacgcctgtaatcccagcactttgggaggccaaggcaggtggattacctgagatcaggagttcaagaccagtggccaacatggcgaaacaaaaattagctgggcatggtggcacctgcctgtagtcccagctacttgggagactgaagtaggagaattgcttgaacccgggaggcggaggctgcagtaagctgagatcgtgccactgcactccagcctgggtgacagagtgagacactgtctcaaaaaaaaaaaaaaaaaagatttataaatgcttcagtgttttcatttggctcccagtcttgtatttatccaagttgccatcatttgcccggagccctatcaaacattccagcaggaagcaggtctcctgcactgcccatgaggcaccacctcctgcaggttcccaggaacccctcggggggcccccagggccttccctttcaaaacctgcttcaaactccccagcctctcctacacgctgtctgcgcccccaggccctgctgccccccaacccccatgttcgagtctgcagcccacagagtgtgtgccttgggccctccacctagtttaatctccacctgctctgcgcccacctcccagggcatctgccttccagaacagctgcccatttcaaatccccactgaaacatcgctcccgcctagatggccctgtctctctcttctgttaccattggtcgttaccattgtctgttaccattcttcttagctcaaggggaacatagggaaagacaatgcgtgcaaaacttgtagtgtggcaatacaggtccaaactgtccttgtcagtggcagcagggagcgccctttctccctccgtttattcttctctctttttccctccacctcccggcatttgtctctttcctccctcactggtcccccttcagtaatggctccattaattagatttacaaatgaaaaaggcctataaagcattgattctcctcctgagatgcttccatcatggttggaggccaggtccaagtgattcgcgtcaccaaagaggacagggcactgttcccaccactgacattcgggggtcggggaggctgcgggcctggggttggttgggaagcctcaaggaggatgttgcctcccaggagaggagcaggcagaaggggcagagagcccttcccacagagagaatggcagcccctgtcacctggtgtccaaaacagttggaggatgaagagccatgctggggccgggacaccggtgtctgctcctgatgccatgtctgtgtgtttcagcccaacagcagcaacgacaacatccagtccatcacctccggggactgggacgtgaccaagatcctagcctacgatgagaaggggaataagatgtgagtgagaaccaggggcctgccccatcttactggccaatggggcacatttgttattttttgtcaattacacttatggagtacaggagcacaggaggcctcctctttcctcctcaggcagcatcactgactcctagtttcttcatgaaaatgtatagtagattcccgtcccaacagtccgacttccagagctgcggcgtcctgaggacgcaattaggcttgcagccagcccatgaagggaagcacgctagcggcagtagtaggggtagtactgatgttgattgagtttttactagtccaggctctaagccaagtgctttacagacattatctcattgaatacaacagttccatgaggtgagtttactgctttccccattttaaaaataagtaaatgaaaacaaaaataagtaatttgctccaggttattcagttggtagcgggtagatttggctcagatgaggggagcccagttcggaggactttaccaccatacaatttcacctccctgctcctggggtaaaagccaaggtttctgcattgggaggtcttaggtgaaaatgagtcaacaactatttattgggccaggctatatgtctgaacttgtcttaaatgtgctcagctccttgcccttcagaaggtgagtgatcttgtaaaagatttccacatccacattcaggtgtgtgtcacccccaaccacagtaccctctggccacgaagcagaggccagtgcagggggcacccggagccagtggaatctgcactggtgtccctcagcccttaggtgtctggccaccccctgctctggtcacaggtgtagctggacctgaacaggggagctactccctgcaggccatgggcggcagtccctgaggagtgtccatagaggtagtgccaggaatgtgaagtgcagacgtgccttggagcaaactaaccctgtgcaccttggtgatctttgcagctacttcctgagcacggaggacctgcctcggagacgacaactctacaggtaactcctgctccccctgcacacagggctctcccccttaggagggcatccaggctttgcagaattgcaccttttcagcagttcggaaagggcggcagcaaagacagaccccaccacagaggagtagctgtagagtctggagagaagtaatgaaacttgcagaggccaccaaaggggtagttttgagacttttgaagctttatttttctgctgttgttgacttgggttttccctgtcacccacttgcctctttggctaacggatggactttaacccgtctttccttttcacttctattcaatgtcacctcggaggaattctgccccccctgccccaccacagattttttgtagggagcagagtgtgatttggaaacaaacccgtgggtcagcacgaggaggccggccctgctgtccggcattgtagctcactggctttggggaactctgccctgaggaagacagggagcatgatctcgaagctcctcagtttggaagcagtctaaagttatttgggatcagggtaggtaaatgaaatttgattagaaaaaaaaggttaatcacaaatattctatagctataaagtagaaggctaatatttatgatgaggccctaaaggcaatttcccttctcaacagcccaactgtgcgactttggacaagtttccaaatctcaaagagggcagggaccctgtgttctgaaccctggagggggactggttttttttctagggcgtgtccctcttctacatttagtcctgtcatctgcccagtcactgttctcactaaaggaggctttgggttgtgaagtgagattagccctgggcactttctaccagggccacagaggtgaggagggggtgtctgctgcctcccccgtgcctctgcatgggatggctgcagccagttacacctaaaggcacctgggccgctgaagaggatgttgttcaggggagacctgaggcttgaggccagtggcgcattgtctaaatggtgccaatgcctgttgcccccgccccactgctgggacattgggaagcccccctggtgaacgcagcctcccttcccagccatcggccgctatgcggacaggatgaggtcagcatgagggagccagtccgtgtagatgttccatcgtcaccatgtgtctactaggaaaattgaaatacacatgtcaccaattaataaacatgagaggctgcctgtggcccctgtcctctaaattacagaatgagaaggttgtcttctctctcccgtgaaatatctttgctcctggaacaacagacttcatattgaaacctatggttagaggggaccctcctgcggcaaaatgttcagataagaacttcttccaggtagatccggtatcttaggatctttccattttagggagcacattttaggccttcttgacttgaaatgacacttgaccacagtggtcccaggtaacatcttcaagccagttcccacttgtgtagctccgttgagtgggaagcgcgagctctcgaggtttcactctgtcaggggatgtggcttttggaagctgccagagttcaattccactggtgctgctggagcccctgcctgctcacatgccagcgtttggaacccagataatttgaagatatgtcactctgtctactgttctcagattgctagccatccactcagagggacaggacacgtgcagatagagtgctagatcatataacactgacagctccatgctcctcacaccaggccacctgcagagcctggagaaggcagcataggtgactgccttccagccctcccacaagcaaggatgctgaaagctcttgagagtgggagggacccaccagcaaaggaaggtggaaatggagctgggtggtctcaggggctccagcagggagacagagggagaggcccggggggtctgtagcagggctccgcagatcaccctcatggggagagcccaccagcttgcggcacccagcgtggagggcagctcctctccgcccacattcacacctgcgtcctttgctcttccagtgccaacacggtgggcaacttcaacaggcagtgcctctcctgtgacctggttgagaactgcacctacttcagcgcttccttcagccatagcatggacttcttcctgctcaagtgcgaaggtcagctcctgccaccccgtcagggcaaagagccctggcaggcacatttgcagggagggggtgggcacacttgcagggagggggcagcggctgtggtgggagcacagcgtattccagaacaggtgaggatcccgcctacctgataacattgcttatggtgcaagatgactggacccccacagagcctggtgcagtggggctactttacgtttcatacaggtgtacagcttatcagagtgttctgtgcacactgtgccagtaatctctcagtttgtctcccattgtccacaaaaaataatagtcccatgagctaggaagggcaaatatcctacacagtgatgagccaaagccatcaatccatcaataaagataggaaaacaatttcaaagattaacttttcaatcatatttaaggatgattgaatatcaccaggcacggtggctcacgcttgtaatcccagcgctttgggaggccaaggtgggcagattcacctgaggtcaggagttcgagacctgcctggctaacatggcgaaatcccgtctctactaaaaatacaaaaattagccgggcctggtggtgaatgcctgtaatctcagctactagggaggctgaggcagaagaattgcttgaacccaggaggtggaggttgcagtgagctgagatcgcaccactacactccagcctgggcaacagagtgagactccatctcaaatgactagataagaaaaaaaggattgaggttatgttaaagaagtctcagaaaaatatttccctatgtcccaattcattgataatttatcccaaactgcaagagtttgatcacaccaaccagcatacacaaaagagtaggccatgttgcatatgggatacaaaggatatttttgctgcttgtctgtatcttggaaagatatgatatgaacccatggaaaggtaagtcatcctaaatatggtcgtaacaaaatatgatctcctgcgatgacctcaaagaatgaaaatatgccacaggcagagactaagatcaggagcaatttgctcctctgtcagagtttcaatcccctaagccataggtggagaatgaataacttttatcagagcaatgtctttgctagcctttgctagctactagagagctcatgacttcatgacttcgttctctttttatcagtgtcatctaaaatcttgaaaatccgcagaacagggacactcagcctcttgctcaacacaagctcagcccctgacattcttctaagacagcaaggagaccacggagggatgaggggggtgcgactgaaatataacattagtgccccagtccccgcaacgttaatggtaccaaattcctctttcctgtgtgtcccaagaaggaggccaccaagtatctgaaatcatagagtgctgtaggggaaagaacctaagatctaactgacccacttcatgtatcagatggcaaaccctaagccagaagttgagtggattccctgactcccaatgagccagtgacacagagagggccagcatcaaggtctcccagttcctagcccagtgacatctgtctcctagggcgggatcttcttgaaataagaacttgggaaattacagggattgacggggcatagggattgggaaaatgtggcaagcagacccactaggagccagagagtcttttgaggagctacataatcagaatccacaatcctgtctcagaagcaggaggcagcttcagcacacaggaggtcatgatcaaacacagaagtgaaaaattgaagtagatttcaagaagagtgccccaagcaacaaaggttgaatgagaaaggtgacagagcctccatcgtggagatcctgagtcagggacagaggtcatttgccagaggggcttggtctggcctaggcaggaggcagagcctttgggatctgaggtctgcactggtcaagacagcaactttatggatttgtatttcccaaattcttactataaccagcaagaagggtctggcttctcaccgttcatggaaagaagtcaaaataataatgagttgtgatatgaaggagtgatatttctttattacctatgccaccaaggggaagagcagaaagcaattccactcttcaatttgtggagcaaatacagggtttctttttttaaaaaaaaaaaagaagaagaagggtttggaatggggaagagcttggggggttaggaggtgccaaggagtgtgactggctgtggtggcccctctttaattattgtcccatttgatgaaggagctggcaccattgtggatcccaccaggttatcagttaatcacagtcagccttgtagtcactcttcagccatgagcgggtttcatccttgaagtaatcttttgttaaagaaagaattctggaggtatctgggtcctatcaggagctgactcctggaggttttaaggaaatacatgaccagataagaaagcatggtgtgtgctccacaagcatccgggttaataaatgtgcataaggcatgagagcatagaatgggaaaagaaagggagtggaggcgacagcacattctgaggctgtgtttcaagatgaaaggtaacacatacgcagcttgtctcaaagttgtatcttgagacagggagcagacagaagaggagaggagaaagaaaaaaagtttaaatcgtggtttgaggctgagctgctcggtcatattcctaacacatactaacatctgctccacatggtgaccctcccagaatccagaatccaacagcttatttgttgttgttgttgttgtttgagatggagtcttgctctgccgcccaggctggagtgcactagtgccatctcagctcactgcaacctctgcctcccggtttcaagcgattctcctgcctcagcctcccaagtagctgggattacatggatacataatttttgtatttttagtaaagacagggttttgccatgttggccaggctggtctcacactcctggtctcaaatgttccacctgccttggcctcccaaagtgctgggattacagacaaaagccacctcacctggcccttacttaacaaacactttcgctgcttccctttggaggtcacagctccctgctaagttcaagctcaagttcagtctggatgcctcattctgacaactggaagccttttatggttcagtttccataagctgcagccctgggttgaaatccaaaaggctctcccaggagatccatggccatggatttaggcagggaagttccagttcccacatggtggatgtaaacatggagcccgtggtagatagaaacacagcctggtgttgggaggctgcttggacagagtgttaaagtttagagagcactatagggtggctcctgtgcggatttctagtctgccactggccttctgtcccaagggagattcgtatttctttttatgtttatgtatttgcaaggcttgtgttgtggtctgcaaatagttattgtgaagagatgactccatagttgatacctgggaggaaaacagaagcaaagaacaagtacagcaacacaaggtcagacacacgactgacccagcccccaggtacagccacactgggtcacacacacatgactgacccggaccccaggtacagccacactgggtcacacacacgactgacccagtccccaagtacagccacactgggtcacacacacacaactaacctggcccattgggcacctccacaatctcaccttcagaaaggatgggatgctcctcctgccaatgcctggatccctataataatcaaacagattcctagaatttgaagataggaatagatctcagagcatctaatccagtctccaccctgcctttcttttgttgattcagaaactgaactcttagtcattatgaaattatcacgctagggtttcctgaatcatttaagatctatttaaatatttagcctgttgcctcatcttaaggtagacataaactagccctcttctctacaaaattgctctttaaagtgtttacataataagctattttctggctaaagtaacttttgaatgcccaaattaaactctccccatggaggtaaccaaaatcccacttataaaaagagattttctgaaaaggtttaaatttacaaagacaacaaagtacatggggagacaggagcagccaactgtttgaacctggaagcagttaccagtgataactgacctggcagaccctgaagctgagcctcgtcctgccatggggaaagctgagcaggcattggcgatgattgcctaagggatgagaagatcaattgctatgaaatcttaaaggagaaagtgattatacccatttggattgcttggggcattttgctggaggagaagactcaaggaaggtgtcaatgatgaggtggcatttaaaacaaatgagtaggtaggatttggaatgggaaaaagcagtccaagtggaaggtacaccctgagaaaaagcacaagaaatgttgtaagattatgcaatggaatcttttgcagcatgtgaatcaggatcaagtgaatacaagcaacctgatttaataaacaaagataatttaaaataattttatttttctccacgtttctcagtagatattaaaatggacccagatgtgtagtctagagcaacgtttagtcaatgctcatgtcctgtcctgtttccttcacaccccaagttattctgagagattcttggaaacctgtgacaaaaataacgtctccactcctagcattagagactcttgttttcttctccttccctcctcctgcagcattttgttatataaattaacttagtcttctagttgcaaccagaaccaaaaaaatcctccttttttaggttgaggataaatgtactggcaatgagaggcttctctatggtaaaatctgtaaacatgcccacattcaaagctgttcatcccgtcacacagggagggaagtgtaagtagttcaggttgtctgggcataggaagggatgatcatcaaaggatttaacaactaggacaaggtggataccaaccagccaaaagacatgtccctgagagcagatataggctatcaaaccacattaggacataagggctgggtataaaatcatgaaattataactgtttcatatagacttcaacattcttcctgcctttctgtgggccttccattaggacagtttttggtaagtttagctgatattgacctatcctgtaacttatattcagtattataacttatattcagcaatataactttattgtcttagtccatttgggctgctatagtgaagttctatagactgtgtggcttataaacaacagaaaattatttctcacagttctggaagctggaaatccaagaccagggtaccagcatggttgattctggtaagggccctcttctgggtcacagatgaccagtttctccttgtatcctcatgtggtgggaaagagggtgacagagctctctggggcctcattataagtgcactaatgccattcccaagggttccactcttgggacctaatcacctctcaaaggccccacctcttaataccatcacgttggaggttaggacttaatgtataaatgtgggggggacataaacactcagtccattgtaatcatagctgattgtagctcatcagttgtttgcaaacagtatttctatttcgttagtcctttggcatactgatcttctcctaatgttcagtttttcttccacagtgtattttgtccaacatcattatagagttccatctagcagtatcaatgtgtgctttctctaatttttcattaacatttcttcagcggcttctcaatatttgacatttgtatgcttatatgtttatgttttatgtttataattcttaattccttaaaattttttattgtacatacaaacctaaaaattatttttaggttaataataattactattaacttaaataataattattttaggttaattcctcaattttttttttttgagacagagtctcgctctgttgcccaggctagagtacagtggcatgatcttggctcattgcaagctctgcctcctggtttcacgccattctcctgcctcagcctcctgagtagctgggactacaggtgcccgccacaatgcccagctaatttttttttgtatttttattagagacgggttttcactgtgttagccaggatggtctcaatctcctgaccttgtgatctgcccacctcggcctcccaaagtgctgggattacaggcatgagccaccgtgcctggccaattccttaatttttgattgtacatacaaacccataaattatttttctactttgcacagttacattaaaaatatattcgaatacaatatataaatagaggttcagaaatgcttatagccactatatccactcactacctcactggatcccatctctgagtgtcaatatttatatctaaaggacatgggtttcagatgacccctggatacttgtgcgagggatcagctgtaagccaaactcagtggaacattgtggaaactcacctatctatgtaatacagagagtttctgtccacctctctattgtctggaagtgaagccagctatattctaaatattgtattatgatgtaaccttttatgatgattttccagaatataccaagcagcttttggcatacatacttaattggtcttctcaatgaccctgtgaaatgggtagtaaaagaaataatcttctatttgttaagttctttacaatttgaaaagcacatttcttttttttttttttttttttgagatggagttttgttcttgtcacccaggctggagtgcaatgacacaatctgggctcactgcaacctccgcctcccaggttcaagcaattctcctgcctcagcctcttgagtagctgggattacaagcgccaaccaccacacccagctaatttttgtatttttagtagagacggggttttgcaatgttggttaggtgggtcttgagctcttgacctcaggtgatccacctgcctcggcctcccaaagtactgggattacaggctttgagccacggtgcctggcctgaaaagtacatttctaattacattataacagttgatgactatgttcccatttctgattccttgaaatttatattctagcgtaaatatatctacttagaattccctaaactcaatatcatttttcacatttccatgcttttgtctttgactacctgataaacccctatacattctccaagactttcagggcagggttgattttcatccccttacaggagggatgaatgagaagtcagagaacatgaaagtggctgtgtattcacccgcagaccaacgcctgtgacaggaactcagtcttcagctgtcttagatgactggggatgcccaggacaggggaaggctgggtggtctcaccttctagtcctggataaacccaattccatctttaaagaaaaaaagcactcacctcctggactcatcttctaggacagctaacaaattaccgcaatctggatggtttaaaccaacagaaatttagtctctcacagttctggaggccggaaatccaaaatcaagctgttagccagtgtggtttctcttggaggctgtgagggagaatctgttccacgtttctctcgagcttctggtggttgccagcagtccttggcattttttgacttaccaatgtattgctttcatctttgccttcatcttcatgtggtcttccccctctgtctctgcatccaaatttcccacttcttatgtggatgccaatcattggatgaggacccacctaatccagcgtagcttcatcttaacttgactacacctgcaaagacctcgtttccaaataaggtcacattcacaggaaccgagggtcaggacttcagtgtaacttttggggggacaccattaattaaacccacaacacttcccttctaaggactgcattgccttcttatataagaaagaaagagtgctcagcttgttcttctcaggaacacaaaattaagggcagccacactagactgtgccagagacagttcttaatggtttcactgcattctggaagcagcaagggggtcactgaaggaagtaatgtgatactaccatatctttggatagcaactctagcatattagaggaagaagagcagttccagtatagattctctctaggaatacttcttccctgtcataatgcaaaattcacagtcaagtggcatacagccataacaagttctgtagggttttctcctacccatctaaattcaaccgccagagccactgaacaacagaatcgaagtgcccaatttacataatttgtgtttcacagtcctcgcctctgttgagagaactggatttttctcttcaaaatgaatctcaagagtatgatttattttccttcaagtttttgaaaacgactcaatcaatcctgtttctaagaaatgtccaaatgccaccaggaaagtgagttccgtgtatgaattggccatttggtgcttcctactgaaacattttttgtatgtttaaaaatagctaaataaacttccttctcctgaagccgaggatggaattattgcagtcacttgctgctctgagtgggaacgggacagtctgtgttcatgaatcccttacagctctgggctctcacccccgcccctttcagtgttgagccatgattagggagctactttccagactttaagaagtttggtcttagacttagcagattggtttatcaagacaggcttctccttctccaagttgagtggaaccaaagtattattacctgagcctaaaatacagtgactcaaatctgataactattcttcttactattaaatattccccaagatcttctgtcatcaccatcattgccatcattatcaaaatcacaggagattgaaatggcagtaagggaggtctatggagtatggaaccgtagagctgggttcaaacctggactctgccacctacagcttcgcgaccttgggcatcttggttaaccttgcttaatcctccacaccctcatcctgaaaatcggaggaataacagtatggcagtccccccttatccacagttctagtttttgaggtttcagttacctagagtcaactatgctctgaaaatattataaacaataagatattttgagagagagagacaccacattcataataacttttattacagtatattgttataatagtttgatttcattattagttattgttctcttactatgcctaatttataaatgaaactttataattaggtatgtaggcacagaaaaaacattatatatatggggttcaatactatcattggtttcagacatccactggggtctgggaacatgtccctggtggatatggggcaccactgtacctgtcctgtgaggctgttttgaagattaacctagatagtgcatgtagagtacttaccatggcatctgatacatagtgagtgtttaataataagtgttaactatcataattgttttcatcattgtcatcaccttagtaatcaattgagtttcttacacatccacttgctacccactcagtatccaaaagttggggccaaggctgggggtggctgacgtgcatgaagtcaatgaagcagcatcccttcccacatgttagtgggcactccagcacctcagcaggcttaggttggaacccctggatcttgcacttacactagcaaattccagaagcggccatggatgccagagccacaaaacattaaatcaactgtcaggcatggcaatgagtacctggtggcttccagagtgcatgtgtccaccgtggtcctcacagttggttcctggcagaagttaagaagtaaatttccagctttcttagcacctgcccgttccttctgctgtgacctttcccctccatgccttcaggtgcccggagctcccagatgcccctcctacatcctctcgctgcaaaacataattaaccaggggaaatgtccacgaaggtgccattaaggtgtcctgcaaatatgtatactaaggtgcttgttattcttccccaggttttagtcagagcagtgagtaaggcagggatgaaaaacaggaatcagccaaccagctccacttgttgggaaggcactggctgcagtgctatggatgagaagggttctgaggccaagtgcaggttcagcaggaaagaacatcatgagtgattaacggatgatgtcatgaaagtcgtaagcgattgatggatgacgtcacaaaagtcatgatgtcattaacatcatgagtgatttatgatgtcatgaacattatgagtgattgatatatgatgtcatgaacatcatgagtgagtgattaatatgagcaacttcaagagtaattgatgaatgatgtcatgagggtcatgagtgatgatataatgaaacatgagtgagtgactaatgtcaggcacatcatgagtgatcgatgttacgaatatcatgagtgatcgattgatgatgtcatgaacatcatgagtgaatgattaatgtcataaatgtcacaagtaactgatgtcatgaatgtcctgagtgattaatgacatgagcatcatgagtgattgatgccatggatgtcatgagtgattgaagggtgatgtcatgaatgtcctcagtgattgatggatgatgtcatgaatgtcctgagtgattaatgacatgagcatcatgagtgattgatgggtgatgtcatgaatgtcctgagtgattgatggatgatgtcatgaatgtcctgattgattagtgatgtgtgtcacccacagtcatgggggagcaggtggcagccacatgccatgcatctatgatgtttggtgtaatcccctgaaatgaatgaacacctccacatggtgagacttcagattccatattatccaagatgacatacatttggaagtttgagatttatcctaaaactcaccttgtactgcagaatgaggtgaaggggcttatttttttaagggcctagactcctgaagcattatggccagccaaaatagaagtgacagcatgtcacttcagagaagagaaaagggcatgcatgaagagacgcagattgagactcggttacctgaagggatggaaatggctgtcatggaaactctcctgagggaggctgttgcccagggtttctaactgaagggcacctcttctgtcatacatcttttgaatgagggagaagaaatctccagatccttccagagtggctcaggggtgatactgattcacaccccttcagagtgctggatcaacagtgtaagcaggcatgccctttgcatgatcccaacataggaattaaatattctactgctggtcaaattatttgctaataactcatgcctaaccgtaaatgagtagtcccagagctagaaaaataatacatagtttgcgtcttcattgataaaactgtcttattagcctcaaacatgtagggtgctattgactcccaacagcaaatttgaaaacaaatggtttggttctacaaactagttaatcctctagacatctcttatatcaaaatttccaagaaatttacctcagctgccctttttaattttgaatttatccaagtgaatgtttagaaccggtttgaagctccttggagcattgctggtgtgtttgtaagaacatctgttcagtctctcaaacatttggagccattccctttgaggctgcatgaaccaagaacaaggaaagggattctcaaggcaggttatattgttaatgtaagtgacatgaatactctggaacatgtcacactcttcagtaaatgctaccagacaccacgcaaaccactcatattcctcctcagtaacaaccaaacaaacatcttccatggaaaagaagcttctcactttgccactcaacacctttcccattcctgggcagtggcaggtatgctgaacctggtacgagtgtgcctttctacatcagaggccatgtcctgcagtctttcatctgaaatgtccattaaaaataaataatgggctgggcatggtgactcacgcctgtaatgccagcattttggaaggccgaggcagacaaatcacctgaggtcaggaattcaagaccagcctggccaatatggtgaaaccctgtctctactaaaaatacaaaaattagctggacgtgatggcacgtgcctttaattccagctactcaggaggctgagacaggagaatcacttgaacccgggaagcagaggttgcagtgagctgagatcatgccattgccctccagcgtgggcaacaagagtgaaactctgtctcaataaataaataaattaattaattaattaattcaactcaataaataatgactctagaatgtgtccattccttttatccttgttgccccagctctgggtaataaaagccattttgttactggtcagttttcctgtgagatttcccactagccagttcaccttgcttctgcctgaatatgaccagatggtatttcctaaagaatatctctcttcaaaatggcttccagagcacatacatttctcttttttctaagtaaaatgatagaagaaataaaacaaaaacaaaaacaaaaacaatgccactgggccactaggaaggggccccaatggactaaaatgttgaagaatttttgtaaagtaaacataaatggttcactgttaaagtgaaagccagacacaagggaatgtaacataattggcaaaagacatgattataaaatgaagaccaaaaagaagtttgtttttttagaattctgaattgtggagcacctgtcagagtagatgctgccgcctcccatttttgcccctaagacaaaaggagacttggccagggagacttccagagtggacggtggggctggaaggggagctgtgccgcaggtggccacaaagccaaggccccaagcactgcaagaggccccctcatcccttcatcactgccctgtctccacctggcatcagaatccgcattcacggagggagtggctctatggctgctgaagccatgtgtccacagcctgggccccacctggacgagagtatagccaacagggcaccactgcagcacacgggacacgcgaaagggaggcctcagaccgagcgcctgggaaggaaatccctggagaagcattttaaagatcttgtccatctgctgcagccagaccgactgtaaatatcctccgagagattccagaaggcgtcacctttaccacacagagcggtaaagagtgggctgctgtgaaaatgaaggaagctgactgctcaagacttacaatatttacaaaacaaatttttgtaattcagaagaagaactgaataggtaaagtagtcaaataccccagttgcccccaaaagcctggatcacgctgacgtaaatgaatacggcttcttaattatttctagtgcttcttcccttcacttcctgaagtgttcttgtttggtcaaaattatgaacagaacaacaccagaaagtgccctagaaaatacaaccaaaaggcttcccagaggacccaagaactggacaaagatgaacattcaaacacttttgagagctatgaaaaatagatccaacgaatgtaatctcttggtagaggctttagaaggagagattggggagaaggaagggggaagaaataaatcaagatatgatggaaaaaaactttccccatgcttttgagtcgttagggaaaagaaacctaatgagtgtaattctaagaattttggagaagatctaacgatacatacctcctaataaaacttgacaattcaagtttagaaattatataagattacaggcagggctcagtggctcatacctgttaactgaaccaactaattaaatatagactggccccatgaaacgtgttcttcatgtttactgaaagcatattcttaaggccggtgttggggatgcccttctggctactgtacttcaagatgttctctgcagagggtcatttggaataaattttcctctggtctcaacaccaggaatggttgagcttctcataacctatctaatgggctgtgaattgtgtttccctaaactgtgttggctgctagagagcttagcatgaaatgtgtggcatatgtgggtaggtctttatagcacacatttttaatctttttcctgatgtcttttcttttttctttttacattgttctgatagcctcacttactcattttaagcttattttatttttatctgtgcattcatatcatccttatctgccttcagtcctttttgccactagatccaacatggatagacagataatagatgagagggaaatgactgaccgattgattggcaggtaggaaaattaaagtactcttagcctagcattcaaggctgcatacaatctggccacatcctacttatccagcctcgtaatgacactactcctctatcagagctttcaaacacttttagaggcacaatcagttttcaaatgaaatgttaagtgaatatatatatatatattttttttctgtatatatatatatatatacacatatatatatatatacacatatatatatacacacacatatatatatacacacacacatatatatatacagaaaaaacatggtgttttgttagtattaaaatgtttcctcaagtcaaagtatagcatttgcttttcagttcaatcaaaggaaacagtaagaccattttggtgactacaaaatgtaaactactaattaagagatacaggtccaagttacagcctcttgttaatcaccgtcatcctccaggaaattcacagtaagcctttgcagacccacagcggtgcttccggttaaaagccagtgtggaatacatgtctcaagcttccctgatgttatttctgtacctgtcaaactagcaacttatttaaatatctgatacaacctccgagattcaacctcataaactttctctggtcacatcctcgctccctccttccctggggctctgagggcattttttgcctttacgccgttgcatcttgtccatccctttacaaatgctgagctcccagaggcaagactgtttcactgatatctgtgcagcagccttatagtagactgtcttcatccatcctggcagctgtaacaaaataccataaactgggcagtgtctaaacagcagaaatttatttctcacagttccagagggtgggaagcccaaggccaaggcaactcggtgtctggtgagggcgtgctatctcgctgcgtcctcacatggtggaaggggcaagggagctctcttgggccttttttattaaaaccctaatcctattcagaggcctccaccctcgtgatttaatcataccctaaggcccgaccccctaacactgtcaccttgtgggtaaggatttcaacagaggaatctaggagggacacaaacattcaaaccatagcccagactatgtgtagctgacgctgtgccagattgcgatattcactttgtgggttcaggggacaagaagacccagtgaaagcttgtagggaccttagggaccaaagccagtgacagtgtcagccccccgcccccaacgacttcatccacacctctgctcacagatgcctccctggcaccctctcaaaggccccaccctaattgctctctagccctcatcctgctcctccatcctatttcctgctcttcatcctgttttctctcttgcacgtttcactcctgccattgatttttctgtgtatgttttcagatgcccatcttctccactggcgtgtagttcagtgagtataggaactttgtttgacccaccactttgatcctgacatctagtgcaagagctgtggcatagtgtcctccataaattagcatttttaaatggatgaataaaagctgcactaccatactatactttggggccaatgcagacctaggttagggtcataatcttactctagaacttcctggaaaataagttaatacacatgccatttttaggttacaatgaaagctgcttctcatattgtgagtagccaaaatattctttaagacattattttttttgccctcgtttataaaagcctgctcacaagacctggaactgtgaacactgatttaattttttaaacagaaatgttgtaaacaatgaaagagaatcaaaaacaattaaaataatgcaatatgcagtttgacccaggagtttgatgctgtggtgaactatgatggcaccactgtactccagcctgggtgacagagcaagatcctaactgtaaaataataataaccataatgcaatatgcaattttacaccctatacttaatgcacagtaaatgggtctgaatgaattttcaaagtgaatacatagaccttattggcaactttatatgtgtcttctctattacttcagagggaagtactggtgcctgcggataaagttttagggagacagatttcaacttaacataaagaaaaagtcactaaagtcctaaccatcattgtatggatctcatcgtgtgtaatatatggacatacggtgaaggtggacatgccaaactctcgtcccaggagttctccaggcagaaactagaggaccagtgataggcacatttgtgtaggatccctttttggattattttggactcgatggactaaggtccttgccagtttaagagtctgtgattgttcttctctgatactgactcaatagagcaacttcagggcccattgcagcacccaggcagatccggcaccttctccaaagatccttctctctgctccatgcagtggtgctgatggtaataataaaaaaccgaatgcatggagagatactgaagtgcatcctgaataatcatcaaaattcattgcatgtatgaagtcaaaatttctatttgcaaactttgttgaattacccattttgaaaagttgatctttgtcagtccctcaagacaaagtcaattccattcttctccttagtggctattggtgaaaagtctgtttcttagttgtagatcaggaaacagtgctgcttgactagaggattcctcgccttacacaaagactgctgacacattttggtcaacagtaaaatacctattcatctcttccacccatatttcaaaagtagataacttattccttaaggaatgtttttgttgttgttgttgttgttttgtttgtttgtttgtttgtttgttttgagacagagtttcacttttgttgcctaggctggagtgcagtggcgagacctcggctcactgcaacctctgcctcccgggttcaagcgattctcctgcctcagcctcccaagtagctgggattacaggcatgtgccaccacacccagctaattttgtatttttagtagagacagggtttcaccgtgttggccaggctggtctcaaactcctgacctcaggtgatccacctgcctcagcctcccagagtgctgggattacaggtgggagccaccgtgcccatccaggaatgttatcttaatgcttagtaaaatgaattagaagaggtgggaagtatctactagctcctaacaaaagtttttactttagctatgaagacataaaaagaatcagtcccaaacttaattattgatgctaatgaggaggaaaaagatgagagaaaatcagctgcttccctggctgtgcatttctgcttcagcaattccttgttgtttaagagaaaggtggcaaacgcaggtgcccactgcagccagaaaggaatggaaatgagtgaacccctctttgtgtcatataacggaggccactggagagaacccccggtctctgacaggaaccgttgtgactcagctctggtcagtcattgccattcagaaattgttagattgccagttcttccagtatttcagcagaagtactaaatccatatttccatataaaaatatgatttttaaatgttgacaacccattacaatttgaaaaatatttcttttggcgaaatgaaacacctgcaggccacatctggtccgcaggtgaccagtgagtggtgttcacttgaatcaatataccagatggccaaagaggacttcttcctgtttctcagccttgcttacaagctactcacttggtcattaagaaatcaccaaagcttatgtagccagagggagccataacagaagtggatgtgcttaagtgtcaaggatccaacctggacactcagaaatccacaatactttttaaactgctctgtatgtaagactattttaaatctacctgtactgaattctgagctatgcaacagagttgagtaagacagcgttcatagtaatacatttctcccacttcagcacgcataaattgtcttccaagaaaagggatatttgtcacttattctaccagctgtcagtcagtcttcccttgatgttctgggaagctctttggcacctcagtgccttcgtcaccgacgtgagcatctgtccatgtgaggaaaagagaatgctgccacgacaggggttgtggtgactgttgaatctgcttttgctgcctcagtgttgaggaagccagggcccaggacttgcgcatggctagttaagagtggggtcaggactgcttcccgtgccccaactgccacactgctgtttctccaatgtcattcttctcattcatattctggttaattcagtagctggtcactgaggctttctgtgcttggcacacagcacgtggagaaggaacaggaaacaaacctgcaacattccctaagggaaaggtagaaaacaaagatcagggtcacacatttattctcacaaggcctgttggtttcatgagcaccagttttatagcttctcaaaccagggctagctcacatctaggtgagaaggtagcagatggtggttccagccactcatcccaccacacagaaacttatatcctagtgagtaactgcagaggaatcagtccagaagggaattacttcaccctacgtttcacaaacgcaaacccatgatcattacaagaatgggagctgcaactaatcataaggattgtgagcagttccaatcctgcacattccgagtttggcacagtgtatgagtttaataaatatttgaagccttcaaataggaacaaagagttttatggacacaaaatatgtcttaagtaactgttgagaaaagaaatgttggcttagctttagataaagtctctgtcttcctataccactctttatcttctagacattaaattgggtgtatattcttggtcaatatcccatattaaaaatgtactccctgaaaatattagcatgggtgacattttcctttgtaatcctgattccttggccagtttccttgttatcttcccaactgtctcctagctgaattgttcagtggttattattttacggactcatggagattcacaaggaggaagatgtccatttctccaccaacacccaaaggcttcttgagaacctcccagtgatgaaaatcgagagggtttctatgtgctagagctacaaatcaaacatggaacaacaaccttctcctcggcactgttgtccaacagcaacgacaaagcctaaatagggcagagaagggagagattcgaaaaatgaattagaaaaatctccttacaaagtgctttcttcaggaaatgtgggaccaaagaggcctgcagctttttctcttaatggagataaagtaggatcatccatgtgcttaaaatagtcacatgcagagaaaaatgagcagagacgtctggctaaatgttacatctgctttcactttcattaattttcttgcccagaagaaggtattagttaatgttagacagctgtcgaatgatacaccactttaaacacatttttaaagccactatttcatagtttgtagctgtaagtccatcagagtgagacaacatgaacatgaatatggagaacctagaaacacaacatagcatctatcatagtagacatcatctcctagcacatagtttaagctacgttgacaagaagtgtctgaagtttttattacttgcttctacttagaatggtaatataaactatttttaaatcagatgttacgggcatatgagatacataatctacactgaaatccaccccctcccagacacacacacacacacacacacacacttgaagacacccactggattttgaacatctcaatcagctcttccccattctcatcctctttcttatctgtttcttttccctcttcctcctccccttttcctcccttccccttcccttcccttctttattcttctgaccaattcagtctcaaagcctttagctgggtgaagacaggtgggcatctgcacagagaagtagccccgcatgggctgcctgagctcaagccaggaggtggaggcatctgcccgcctgggagcacctgggctgtggagtcagccctgggcaggaagagagggcgtctgcgcagaggggcagcctgtcgtgggaaatcagagcctaagagtaagggatgcgtctcttggaaaggatggcccactgggggtgtttaagcccaagcagagtgaggagggggtgtctcccagaaaggacggctggcaggggggtggtgtcgcagcccaagcagagtgaggagggggtgtctcccagaaaggacggctggcggggggggggtggtgtcggagcccaagtggagtgaggagggggtgtctcccagaaaggatgtcctgtgggggggtgtcagatcccaagcggagtgaggagaaggtgtctgcaaggagaggtagcagcgatggtgatgaaaatgtcttagactcaggagctagatcaagtaagaacagtaaagaagatgaaaacccagtttctccctgttggggatggaagtcacacatatggggaggtggaaactggaggcacacctgcgtggtgctggactggaactggggggagtggagtgagtccctgtctttctaaacgcagcgctgaactttcagctgaatcttcctgggactatttgcagaactcgaatggggtgtgaagattagcctgtaggagtgcgcctgtgtgaatttcctgaatgtaacggtaatgctgtggttctggaggagaacgccttattcgtgggagatacacagccccaagagcatttggggaagatggggcatcagctcagggattccttctcaaatgcttcagggggcaaagtcctttgccctgtacttgcagctttccttaagtttgaagttgctgtaaaatcttttttttttaattagataaaattttacaaaaatgaataaactgtgtgcctggcaaaggaattgagcgtgaaggtcactagcttcaggttggaaagtgctcttccctgtcaccaagcgtgcagccaccggcaaatgacaaagtcttgttctcaaaaacttaaaaagttttctaaagaaatagctgctaaagaaaatgagaagccagatagaaaaggcattgcctagtttattcttctccatttgagacattttcatcttctctaatatattccagcgggctacattaaacacctaagcagatagaatgtgtacatgttctagtaatcggtatatttatttcatgaaggtcattatgctagagtatgatcattatagttcaggcacaaaatctaaccatgtttcccctgggctctgacccatgcagatgtcagtatgcctccacaaggaccatcttccaggtaaacaggttacacttagctcagctttaagatggccataaatcttaaaatcgtggcatactgacttttgtttcagagtcaactctcagtagcctacacacctcagaatttgttttttagtttttcagccctactttcaattatttacagtgccctgaacatcaaatacagtctcggtctcgtacctttgtaagtcatgctatcatcaataatgcagataattgtattttgaaatgcctaattataattcacatttatatttatattattcaaacacccaatgcatttgccacatgctagacaataagaaaaacagaccaagaggctgagcgcagtggctcatgcctgtaatcccaacactctgggaggccgaggcaggtggatcgcttgagctcaagagtttgagaccagcctgggcaacatggcaaaaccatgtctctacaaaaaatacaaaaattagctggccatggtgtcatgcacccatagtcccagctgcttgagaggctgaggcagaaggattgcttgaacctgggaggtcgaggctgcagtgagctgtgattgtgccactgcaagccagcctaggcaacacagtgagaccctataagaaagaaaaaggaaaggagagaagagggggagaggaggagaggaggagaggaggagaggggaggggaatggtggggaggggagggaggagggagggaagaaggacagaaggagggaaggaaggaaggaaggaaaatggagagagggaggaagggaaaaagagaagaaaaacagaccaagatattagcaggaaagggactgaatttccaagcaaattgggagtcagtgcaagagtaatatcggctcaatggccaacaacaattagatggttttcagcagatgggggctagctggcatcatacgcaagagcatcagtctcagccagatgggaactttgaggttcctgtgattagcttggtaattctaagaggaactgcagaccacttgccataggtaagatgcttcctccatcctgctcaaagccctcccacccttcaccaccaccaaacaccatctctgctcctcatgtggaatctagggccctccacaattgaaagtcagccttccagaagtgcctcctgtgatgctggtgcacagacccctgggccctttctgtttgctgttcaagtctcgagactgcctgtgccctcccgcagctgtgctcttgccgctgccgttctcaccacccgatagctccttcccagactttcaggccgtcaaaatcctcaccttcctttaaaattctctggttcacatcagctttgtaagtatatcctgagcaagtattaagtgatcttgatgatttttttgagtcttccagctatgcctttgaacacgttttcctgtctctatctttttcatcttgaaaatccacattcgctgctgccttttttctgatcacctgttcggtccttacctcctttccatctggcttcctctgtctatcgattgctctcacaaggtctctgctcagccactaattgccacaagttccaggaagaggcagagccggggccaggccaggaggcagaagccactcgggggactggggggccatgccgggggcagtttggtccaacaaagaagcgcttgaaggaaaataatggaaaatcagttctgaaaggtagattgagataagtagagctgtataaacgttgtgacatagataattgtgaataatattccactgtctagccctagaacaatttgactgtccagtggaaaaaccttaccagcaaggtggtttcttgaagaaaaggaagtttgccacacagaaagctccaactggttctaagcaaagggtagcacctgcaccaagtatcagggcatgaacctgcctcctgggttgtcccggccttaatcgtacttcattttgatcagatggcttgcagggttgctgctcacagcctatttctactatctatacgtccacatttgaaagccacctccaagcacacaccgtgcacgccctgtggagaggaagcatttgcatttctacccctcagataactgctgctgcccagttcatgtttcaagtatgagttccttcattctatcaccaggcttaagatccctttggtagatgaactggatgtttacatccattattgctggacagccacagaaccgattctcgcagcatggctgtagttgtgaaccttctccaggattctctaccacggactctgttcttgcctctcaccgtccacgcccaggtgaccgtgtcatccccacggtgagtgggtgccctccttcaccctcagaagccaccctgccccaacgtcagccctgccttagaaaaaggaccacagacctctccatctggaaagacaaagagaccacacaggatgaatccacaccaatccacgaccagtcgtccactgtggagagctctccaggccacctgccaccaagggctttcaatagcagtcaggagccagatgcatgaggctcggagtggctttgatgagatcttcaatcaccggttgaccacacaggccacagtgctgtggtagagaccctccctactccaggggccactgatgtagggttacctagaatttaggcagagctgggtagaaatttaaaaaggggaaaaaaaactctttattgcaaaagttttagaaagggaggctgctgaaaggatgttgattcttcttaagaaaactttctgcacatcatctttgcatttttgtgctaatttctactgcaatttattttctcatcccagcaagtagcaatttcaggtgacgtgacagtttatgaatgttacaaacattatttctttttaaaaaaaatctcttgaaatcagacttggcaatccagatacattttcccattcagtatgagtgggagcattttattagccataatcaagttttccttttcatgacaagaaagcttacagagacctgggaaccactcatataccacggggtttctttgcaattcatgtaactgaggaatcaaacccacatctgcgcctcctctggccttacttattgtcagaaagttcctctcttgtcctgtcagttagagcaccagtaggaactgagctgtgtatagtcagctgctagcttgagattctgacaaatctttacaaaaatacataggcttctatggccctctccttcatcacaagttaaacccacatgaaataatgtattatgagactttgcaaagaagaatgcaattcatcttactgagaaagcaaaaccctgccaggttgatttctttctcagtagcttcgtgacaatttcaaggaagccactgtaccagcacttcatttccctaaaacaggttatgactcttctttccctcatgcgttcggctcagttcctgagtggctgccgtatgccaggcaacgaactgggtgcttgagatcgatgcttttgaggggcttgtgttggagggagagagaggtactcaggaggactgtccttcactgtgacaatgctgggacagagacatgctctggggcctggaggacccaaggaattccacatccatgtgccagggactttgttggaaccaacgataagtatgcatttgcatgaagaggcatcgtgctagacctggggagtgacagacacacatgaagtctctacccaacaaccgatcatggggtcataccattgggagcctggaagctgctggaagcccaggagctcaccatctcccttcccagtagcaaagccaccacccattttacagatgagaatattaagacactcgttacgtctcacgcgagggcacacagctgatcaggagctgagcccacacaagagccagagttcctcccacatccgcacaccccagggcctgtgaacagcgctctgccctctcctgtgcacagggaaacaccaacatttttgctgacacagtcccagaaatctcctccacagacctaagtgtgttgaaccctagtgacgtcctagacacaagagggcactgcagtactgcacatttgtgcttctcctcgcaggaccgtgatgggttctgcaagtgactggtaacttcccagggaatggtgttgcctccaacatgtaaaccacacaccacatcgccactgccacaactgacaatgtcaagactaccctgtggggacacagagaatcgagccctccagttcgagaagtctttctttgggacccaatatttggcagatgccaggcagaatgctgagtttgtggagatgaggacagaggccctgccctcaagtagcctgaagtctaggaaaatgaatcccattgggaaaccagtcaagggacccaagcttggggaagggactagcacgtgctgagacctctgctaagtggaggcatctcactcacgccatgcaagcagcctgggctccgatgcacacaggagcagtgcagaagagtgagggtcccggggtcccagtgccctgccagcatattgtcgtagagacaggcacacacagccagcaggaggacagtcaaaggcagaggatgggatggcaaggtgtttaagaaagaccataagggctgtaggaagccaagaaaaggagtgtttggtaactggtaaaaatggggtgtggggaggaaaaggcagacaacccctcatcgagaaggagcaagaagtgacttctgtgtgccttggctgcctcatctacaaatttgggatagtagtaccagccttgtacggctgacgaagtgtaaattatttattatctgaaacactcagagcaggacctgttgctggtagacggtggtgatgctggaggggatgctgacattgatgctgatgtcatccgtcattgtagctccgactctgactccgtatctcagaggtggggggctctggtcatttgcaccaatttcctgtcatatggggagaattcacctcttgtttccgatgcctggcaacataaattcacatagccaccagttaatagcagctgatgagtttccattctgtgcaaaaaattacactaaaatgaccaaagattctcatagacaaaggaaatttaaggacaaaggaaaattatgtggacaaaggagttttattttctttctgggtacaagagttggtggtggccttagcagaactggatatggaaggcctgggctaggcctggatggtcccggggctgcacggatgtagctcatcttcacgcagacaagaataaggacgcctgtcctctgagtactcactgcccagtgaggtcatcagcaccgtttccaaacagaaacaagatgaagaaacaactcaatgatgagttgtgccttgccagggtgggcggacactcagcctcccctagctcataagctagcatctgtctctgtctccctagaaatcccagctgccactgaggaatatttacactattaacaacagctcccagccgggtgcagtggctcactcctgtaatcccagcactttgggaggccgaggcaggcggatccccttaagtcaggagttcaagaccagcctagccaacatggtgaaacctcgtctctactaaatacaaaaaaaaaaaaaaattagccagttgtggtggtgcgtgcctgtaatcccagctactcaggaggctgaggcaggggaatcacttgaacccaggaggcggaggttgcagtgagctgagaccatgccattgcactccagcctgggtgacaaaagcaaaactccatctcaaagaaaaacaaaaacaaaaacaaaaacaaaaaaaaccagctcccatttatttcgctctaataatggccaagaactgcaaagagcatctatgtcacttaccttttagaaacgacactattgttcacatttcacatgtgagaagagggagactcggagactagggttgcacggtggtgagcagaagcgctaaagcgtaaagtgcaagaccttcactagaccctgcctcttccgctgctgtgggatcgtgatgttcacggcaaagaagtaaagttgaatgtattcattgcagaaatgattatcatttgtgggccagcgactggaagagccccttttctcttgatgtgatttggggccagttgtctacggtctgagaaagactctaggagacactgccgcagggcacccctgccctgcaaaggtttgttgtgatagtgactgcttctgtgccgtatttcgctggcttgggggtgtctgaaaatacagtctaagtatgatatgtaagggaaagggagaatgagaatgacttagacgtatagggtcagtgtgcaccaaatggagctcttctgacatcaccttagagcagtggaccctaagacctacctctagctcccttttgtgacttatttccccacaaaatgtgttaaagtcctaatgcccaggaaataggatcattgtagatgtaactaattaaagtgaggccatactggagtaggatggaccccggatctgatacgaggggtggccttccaagaagaggagaagagacagacacgggaggcagacgctgctgtgcgacgtcagaggcagggaaaggaaggacaagccgcggactgatggcccccaccagaagctgaaagagctgccgccctgcccccaccttcatctcggacttctggcctccagacctgtgagacaatctatttctgttgttttaagctgcccggtctgtgggaccttgttaggacagccttaggaaactgatccagtccccaggtacctactcctccaaatccttcttcaaccacctacaatcctctctgacttaaggccagctgacaaggagcttgctttaaatcactaccttggagcagtggaccccaaagtgttttggtggctggattttgttagagacacacattctcaggccccaatcacaaacccatggagtcagaaacacagggctggtgcccacccgtgtccactttaacaagccatccgggtgattcagatgcagttcagaggctgagagcccagagtgtacaaaatgcccattctttgcttccaagacacacttttcctattttcattttctgaaatcagaatgcctcttaggcaatctctgtaaaatcttatgattaataaatcagtggttcatcttacagctgggggtgtctcagaatcaatgaaaaggaaggaatacaacctccacctgatatgcctgtgagtgctgctttgtttaagaaagcggcttctgatggtggaaaggattcctgtgattttaaagcggtttgtgtcccagcagtgggccctgtaatgagcacctcaggcacactatgaccttcaggaatgttcctccgaggctcccaaaccttccgctcatttctgatgcaccaaagctggcctgaggcctaatctctgggtcccacttctgtttaattaccgcgagccttgtttctgctgcctgcctgcccgccgcctgccgcccggctttcagaagcatctctggttctggaggcttcacttcgaagatgcagccccttgcatggaggggaggcccctggctgggggaaatatgcatttggtcgacgtgttttcttctctctcttctgccagtattttcttctgaagcacacagcactgcctcacccatgcccaacccacctggggagctgagcctccagataaaaatagtgtgcagtttggaggctggtgtttttgagatcgaacagctgttctgtcgcactttcacaacacggttattaaagcaggagagaagtaattaaaattgtcacttgtgcggctgttcgaattatatttccacttcctctccacagagcattcattatgtgttacaaaaatatttcattgtggtgttttacatcattaattttgtttaaattattcttaattgctcactgacatgacaaaaaatgaggaggaaattgggaggaagagattttattttaacaacaaaaaaactggaaagggtgaattttatttattttgattttgatttcacctcttttcgagatgagtttcgctcttgtcacccaggctggagtgcaatggcgtgacctaagctcactgaaacgtccacctccccagttcaagtgatcctcctgcctcagcctcccaagtagctgggattacaggtgcctgccaccacgcccagctaatttttgtatttttagtagagacagggtttcatcatgttggccaggctggtctcgaactcctgacctcaggcgatctgccagcctcggcctcccaaagtgctgggattacaggagtgagccactgcacccagcctgaattttagtaatgagtcctgggctggtgtgggcatgtctgtggccaacatgcacgtacacatgcactcacacatgtgtgcttattcacacacctgcatgcacacacacacatgcatgcaggcacattcacacatgcatgcacacacatgcacacaaacacatgcatacacagatgcatgcatgcataacgcacattcacacatgcacacacatgcacacacacacgcatgcataaggcacattcacacatgcacacacatgcacacgcatgcaggcacattcacatgcatgcacacatgcacacaaacacatgcacacacatgcataacatgcacacatgcacacatgcatgcatacaggcacattcacacatgcacgcacacatgcatacatgcatgttcacacgtgtatgcatacagacacattcacgtgcatgcacgcacacacacgtgggatgtgcatttgggatgggctggaattgagcgcccaggagccacagttcatcccactgctgagccagctctgggggtgggggcaggtagagtgtgggtaccagcatgggagtatttttctgtccctgggccagtgacagaatttgtggcaatttctggtgggcgaggcgctcttccttgttactttttcctcagttggtcttgtatagtgtggccctttatcttctgaaagaatgagactttgtgttccgctttcaacttaaacctgacaaaatctctgtatttctttcacttccacagctggtatggagggaaaactaaaccacgtttactctattagtatgagtatcattgctcatttctttcctttccccagtattggtgaggttttctagaacaatgattagccaagacccaacatctgtgttcatttcttttttctcacttccttttctatcatttccatttcaaagcaaagaaaataagactcttatattcacattcccccaagcgatcttacatttttttaaaaattgttcatttagtttaaaaactgagtaggcagcgtctccacttgcagggcactccagggacccagcagccacgttaggatgcttctcgggtcctgaggtttggttggtggcactccgtgttcacgaggacaggaatacaaggagaaaacagtaagcataatgacagcagtaaaataattcttaaataattcatggaactaagagcttccagctagacgatgtcaggaatgtttttagattcacagaatgttagagcagaaagaagttccaagatccgctaatccaaatgttttcaaacttgttttaagccacagagccccttcttcaaaaggaaacttactgggaagcccaatatggaaatagcggcttctcaagagactctggggactcgctttgaagatctctgatcgggttccattgccacattttgcagattaaagaaatgtggggccaaaaaggttaagtaataagaaaagtctgcttgcaggaaataaaaacaaattgcaccaagagccaccgtggaatagcacagaacgtgtacgtggcttatgtaagtaggtatttgcaggggcttctgtgcaagatgcccaggaccgcagcgggatgccttcgggagcagagatgggatggaaaagccgggcagactctggaaggcagccagggtgctggcccctaaggacgcacgtgcaagaccggataacgggaggctttgtgtgtgcacctggagaacagaggtgcctccttataagtgacctccctggactttaaacatctcacaaaatgtggagccagttctcaggacaacagcacatctggttggccggtgggtccctcgaggaaaagaggatggaagactggcgcgcaggaatgccagtggctcatacctaagaacaagtgttaagaacagaccagttttcatcgtgaacagggtttcagtaaaagaatactcctgttgttggggcttcttatctttcttgaagggtcttccactaaccctcaccaaccaaccatctcaccatatgcccattcgtccacagagccccaggcaacagagtgaatggatgttaatagctccttgattaaatagtaataagaacaagaaatacagataagaatgcaaataataacaatactagacacacctactgaagggttaggagggcatggcacattctaagcatttgatgtgtgttactatgtgatgctcagaacagctctttaagatgagtggtggtatcattcccatttcacatatgaagaaactacagagcagctgattcaagtaacttgcccaagtctactgagctagctagtggtgcagccaacactgaacactcaggtttacttttactttgtgataaagacatagactcacacagggagcaaacggagcccagtggagcccagtagaggactgagtctgtggccaaagtgcctggcttccagtgctggcgttaccacttacagttctgtgcctgtttattcctctgtgaaatggggacgtagcgcctcttgcctggggctacgttaaggaatgaatgagtttgtgcatgtaatgcactgggacactgtggacatgatcagcggggcgggattgttaaccgttgttgttgccattactgttattacggtggtgccacagaggagggaggaggcagagagccatcacagagaagatgctggggctgaatcttgaacactatgtagaggtttagcaggaagactgggagggaagagcgggtgctcaggcaaagaacagcacagcccccacgcaggaacgaggagtccagaatgctgggccacagtgtgtgataggtcaggtctacagaggtcttgtatttcacgtcaagagtttaaacctaagcctctggacagtggaaataactggaggtcccagtcagaggagtgccacatcacaactctttgtaaaccctcgggcaggagagtgggggacagcgctgaggacattagcatggagatgggaggtatttagcaggcacagtgagaggaactaatgaggaatcaagggtggaggttaagagaggccagagcgtggaacgacttccattcaaaaaacggggtttgcttgcgctacatcctcgagtccaaaaagaaaagcaggtgattttgtatcacaggtagcgcccaccaagtgtctgaagctttatgggtcagcccacctggtcatccccattgcttgcaggtagtgacatctcccaccttacagatagctgagaatggaagtcgctaccctcaggacacacacccagcaggtggccatggcgaggtgccacccacattcctccattctgctgtcacacggtggaccaaccatcaggggctaaagaggaggatgggcagcaacctcagcctgcatgcagactgaggaatccacaggaagcggaagcctttccagtctcctcctcactacagtgacctgtcccgtgtccaggtctgatcagatgtgaaagcaaagatggactcccatgtactccatgctcactctgttgatgaaaaggagcctgagtttcccaacacaccataatttgtacacgcaagcgttgtctcgggaagctgagcatttattcccatgatgagcatgtgctcggaagtttttagatttcctcttgtaaaactgtttttacgttccagactcatacggaatatacaactttttacttcttagtatgcttaactgctggcagcgttacctaaacatgaattttatcataccttcattaccaaacttcatttcaatgatcttgtgcactttttcaaaagcaaagctaacctctaacacaggtagctggcgatttagaggctattctagagaatgcgccgccaactctgaactgactctgccaagtgttcaccttcccagggaatgtgcaccacccgcgagttatccacccattcatcctatcggcgactgtcaattggcgacttgctgttaacgagtcaatgtacgttttcctaggtgggatgcaaagttgtacaaaatagattcctatgttccaagtacagttgaagagataagacataactagatcactagaaatcaaatcagaacttaattgctcggatcgaaagtcattgcagaactttgagttacaacatggcagactgtgctcagtgctatgacaatctgagggcgagggtcataccaggagctgcgagaagtatgctgagaaggccgggaagtggggccagacactccatccacagtctagctgtgggctcagtcggggcgaacgaaacagccagtgggcgctgtacctttcccctgcaggcttttgcccacccctccaagcaggctttgcccctctgcaggctttgcccccctgtagcctttgcccccctgtagcctttgcccccctgcaggcttgcctcagcgcacaaaactgaaatactaagttccttctttcatacttggaattctgtgaatcatgtaaaacacctgaaaacgtcactccaaggggcataaaactgatgctgtgagttcaatgcagataattcctaacccctaaggcttttacaaatcaactacccaaaggtacgagctgaattttgggaatgtactgagaaccttctcttttcttcttttttttatgattgggaaggtttcccttattcaaaatgcctatcatgagccctgagtgtcactagtaatttctagagcaagaggttccctgtgactataaaaagtcaacgtgccattgcctccccatcttttgtgagcgtgtaaaacaacccatccatttccacggcccccctcgagccgcgctcctcggactgctgtatgggaaataggatcactttcaagttccctggacacataaaattggattgaagcaaaactaaatgctgtggggcacggagtggagggggtggggacagcctcaatcccaggtttgatgtcagcgataacaaggtttccaaatcaaacggcaacaaaacctgtcggcagtgttgactaggaaatgctgtcctcggaacaaatattttaattatccgcagtagttctggtagcttggctagctccctgtttattagtatgataatatcacctcaatgtataaactttatgcatcaggcatgcataatgcatgaacgggcaaataaagagatctggagcctgttcgcagcgggccatgccaattatctcgctcggccagagcctgcctctgctcacagctgttctttgaaaccattcaccaatgcttaagagatatcagtggtgccagccaggctgtttgaatctccattgtttacatactaggagtttagctgctggttggaaattatctgtcacataaacatcctctgaggatacagacgagaggaagggagacaagccctgtctttatgaattttttttatttattctgatgacttttttcttttacagttttgtgtcctttttaattacttcgttttcctctggaattgtcacatttctccctccagttgagcaggtgaaaactaatgctctaaaatgcctggggctgcaaaccagagacacagaaataaatattttctgttcacaagtctgttgtgtaattcaaagcttttcttttggtaatctgattttttttttatttttgtccctctggtcacaggatctttacagggcaaaaacgaccttatatgtgggttgtgaattcacttgcttccatttgtttattttcccttccaggaacaatataaattttgaaagtcagatattgaacttgagccaaaatagtgtgtgtcaccaaccaaagtttttaaagggccaaatgttgtttttattgcggttatctcttcgtaagcaaaggctgagcagataccatcagttttctgctatcagcaggcgtgccattgtatatttcagtttgaacatcagggctgttgttgcatgctccaaggctgcaccagccacgaggcaggcttatttatcaaggacttaggaaatatgaggaccaggcagagagaatcctagtgaacacgtttttgctgatgcatatgttcacgtgaatttgggaacacgcacataagagtgtgtcattagacaaatgcatagagaatcagatatctaatatttgacctgaaccaggaaggaactcacaatgaaatatgattgtatgctttcatttaaaagcgtatcctaaatacaaaaattagccaggcgtggtggcgcatgcctggagtcccagctacttggaaggttgaggtgggaggatcacttgagcccgggaagtagaggttgcagtgagcccagatagtgccaatgtactccagcctgggcaacagagcgagaccttgtcttaaataaataaatatataaataacagcatatcctatgttccaagactagacctaaacataaagataccagagatattggctgggaaaaaaacagaaaagcaatcccgtgttctcagcctcttttctttcttctttcctttccctcagacttagaccagaacctctttgtcggtacaggcagacaccatctgcttccatcctttcccatgaccatggcaaatgttgacattgcaaaggcagattctgaccacggaattctcatctctggaggaaggtatccccatcacagagagttgtgacgaggttgagagaatgtctctaagagccgagtgcagtaccaggcagatagtaggaaaaaaatgttggctgctgttgtttttgctgaagctgctgttgctcttactaaaagtagaccttagcaagcctgtatcctgcagttgagatccagataaggaaagctgcttacctggaatcacaaaatagctggtcccctgaccccttctttacttacaggagtccccgcatagacctctgaaccatggaccgcgtctggtggttgtactggccacatggcatcaaagcgtattttcatgcaagtctgtcttccgtactggactctgagctccctaagagtaaatgctttgtctatttctgtctgtttccccagcagctagcaccatgccttgcacatggtggcatctcaatacctatttgttgaattacatgcaaagtaaaaaagaaactatgaatatgaattgtcagaagaatagcagctaagtggagtcctaaggtttagccacaagaatctgtgccaaggcaatacagatggattgtcttacaggcatcagagacaaaagggcaaaagcttcctattgtatgaaacaaatcatttaataagttttactgaccagacttgcataagatcatttggaagaagaggaaaacaagtaaaaaaccaatgtggtaaaaacccctcataggtgtccttggtaaaagtattctctgttgtttcagataggtttaaagtgttcctcttgaatggtaccagcttccccaaaattctgtgtatgttcttcgtgtgttcggcatgtcccctcttctctagaaatcttaggtaaatgctaacatgggtctagtctggccaaagtagcacaaattttgagtatctgattcctaattaggattctgcttctgtttccttattaggagaaaatgtattttgatttagagaaattgtattttgatttagatgttttcctgaattatttgccagttttcaggggccatcacagaaaccttgaggcctgtggtggtcctacagttcacatagacagtagtgggcatgcatcccctgggccagagaaaccggatgcgaaggcggcctgcagagccgacctcagaccaccagagggtctgatctcagggcagagactcagttagactgcctgggattaggaatcaacagatacaaaattatacagaggagctgtttttcaacttttgtttagtggcctccttaaatgtaattttattcacgttctttgtattccactagtgtaaagaagtattctatattaaaatatcagtgaagatggcctggttgtcatatggcttcacaaacagaatataattccgatcttagacatggagactgctacccttggaacttagtgaaaagggcaggggattccctatgtacgaacagagagaccacagcctgaattagaaaaaccaggactccaagaatggtcttgagagacctttccttagcctgatttaaatttgccaccttgatatgtcatagccaattataagcttgggaggtcattcattcattaaccattaatctgttcgtcaaacatttttatacaacgctgagtccaaggttcagaacaggtggaggggatgagacatggcttcgtggcccaaggatttcagaatgtgtttgtctttctgtctgtgtgagatggggttggaacacggtcagagcagctatggctttaaaattgcaactcagtgtgacacttgctattattggtacttatggcactttcttcaatcacaaattagaaagcacacgggagaaatacctgcagcaacgtggtaagaaacaattagcttctaaataacataaaaaacagcaatgccattaaagtggacgaaggatgagagagggcagtttgtagtcaggaaaacctatgagaaatgcaaatgtcaagggggaagggaggagggatagcattaggagatatatgtaacgtaaatggcgagttgatgggtgcagcacaccaacatggcacatgtatacatatggaacaaacctgcacattgtgcacatgtaccctagaacttaaagtataataataaaaaagaaagatgtccagctttactcaaaatttctaaaaattcaaacatttacccattagagtggttttaaaaacttttttaagatacaacctagatctccatacactatcagttggagagcaactagacaatatttactaaaatgtgaactgtttcgactttcagtgtagaccgtattattgttccccatgtttcacagcccctccctgtaaaaagatcatcctccaccccatggccatgtggcctgcagggcctctgtggagatacagactcatccctgctctgttgggaccaatgggatgcgtcttggccaacagcatgacatggccatgtggcctgcagggcctctgtggagatacggactcatccctgctctgttgggaccaatgggatgagtctcggccaacagcatgagagtggacatgaactgcaccatgtccaggacattttttagttatgcaaattatttttggtaatatttatttttaatttattttttattgaggtaaaatatacatatataatgtatatataaatatatataaataaattatatgtatgtgtgggtatatatatataatttaccagttttaccattggagtggtaacaaatacatttatattcttttctcccccttcatcgtgcatttctgcaagccccccttgctcatttccttttgttgtgagctcagcctgttccagatgaaggctgacctttcaaccaggatcctagaaagaagacgcatcctggaggatagcccagcagagcacagccgggctgctgcagacctggttaccaggacgcaacattagcggaaagtcagcttccttgtttcacaccattgagagtcaggagttatgtgtttgaaaccacaagattatttcatgaacgttgactataaaacctttttgaaacagcaactgcagtgctaccaactagcttaacgacagatgcagtcttacccgtgtgcaaagatatatgtaagaggtttttcagcaacactgttttaagatagcagaaaatgaaaggaaacaacctaaatatccaccagtagacagacaatggactcaataaattattatatttccatatgatgggatactatgcatctcttcaaaaatgaagttttacaacttttaaaaattatttacatcattgtatattatagtattaacccttctgctactagatgttttcgcttaaccttataatcttcatgttggcccatgtcgataggtgtagatctactaattcattctgcatgctctataatattctgccatgtgagtaactgcgttttattcatttaatctcctgctaatgagtagctgagtaatttcccatttgtgacctgtacatagttgctgttaggaacaatcttctgcctgccttcttgtgcacaggtgcagaggatgctctgagatgtgttcccaggagtggagcccgcaggtcatacgcatgagcatcttcagatgtcatggatattgctaagctgttctccagagtggctgtgcccactgacacccccaacacggcttcaccctcttgtagtggccagactagatgtcaagaccgtaccaaatatgttacattgagacatgtcatatcatactatatatggcatgtatattattatgaatacatagccatgtggtagaaatatcttttaaatatgcagagaaatgatcaacattaacttcaaaatgatggtcacttctgggacgagagaggactgggattagggaaggaatgcaaatgacatcgtagctatttgttatgtcttgtttttttttgtactcaacactacttatttattattgttttccccatattcttttattttgtttggtttggggctctttcatttttattcatcattaataattgcatatatttattgggtacaatgtgatgttatatacatatatacattgtggaatgatcaaatcaggctaattaacatatctgtcacttcacgcatttatcattctttgtggtgaaaacatttaaaactccactcttttagcaattttgaaatatacaatgcattattattacctagagtcaccatgctgtacaatagacaccaaaaggtattcctcccgtctaactgaaactgtgtacccttcgaccgataactcccttttccccacctgccgccccctcacttcagcctctggtaaccatctttctactctttgtttctacgaaatcaacatttttagattccacatataagtgagatcatgtgacatttctcttcctatgcctggcttatttcacttagcgtaatgtcttccagattcatctgtgttgtcacaaatgacacaagtcctttcatctctaagactgagtagttctccactgtgtatatgtacctatgttttaatacattcatctgttgctgggcaggtaggctgtctccatgtctggactgttatgaatagtgctgcagtaaacatggaagtacagacagctcttcaacatcctgatttcaattcctttggatctttacacagcagtgagatggctgaatcatagggaaattctatttttagtttttttttgaggaaccaccatattgttttatgaaatagttttactaatttaccttccccccagagcatataaaggtttccttttctccacatgcttgccgacacttgttagcttttttttctttataatagccattctcacaggtgtgagatgatatcttattgtgcttttaatttgcatttccccagtgattagtgatgctgaatatttttcatgtatctattttctatttgcatgtcttctttgacaaattcaggtcctttgcccatttttaatagggttgtttgttttcttgctattgagtagtttgaattccttacatattttggttattagccccttatgtgatatatgatttgccagtattttcaacacaattcatgaaatgtcttttcactctattaattgctttctttgctatgcagaaatttaggatgatgcaatcccgttcacctagctttgcttttgttgcctgtgtctttggggtccaagccaagaatcattgcccagaccaatgtcatggagctttttcactatgttttcttccagtagttttacaatttcaggtcttacactgaagtctttaatcgattttgagttgattattgtataaggagtgagataagagtccagtttcctccttctgcatgtgaatagccagcttttccaacaccacttattgaagagactgtcctttccccagtgtgtgtccttggcatctttgtgaaaaataaattaactgtagatgaattggtttatttctgggctctctatcctattccattggttgatgtgtctgtttttatgttagtactatgctgttttgattactacatctttgtaatacgttttgaaatcaggcggtgtgatgcctcctgttttattctttttgaacaagattgctttggctatttggggtctttgtggttgcatatgaattttaggatttttctgtgaaaaaaatcaatttccttctgtttctatgaagaatgactgaaatttggatagagattgcattgaatctacaaatcacttttggtagtatggacattttaacaatattagttcttccaatccatgaacaagggatatctttccatttatttgtgtcgtctccaattttctttcatcaatttttatagtattcagtatacatattttttacttccttgaatttattcctaagtatctttttcttgatgccattgtaaatgggattgtttccttaatttacttgtagatagttcattgttagtatacagaaacactgctgatttttgtgttgcattgtgtaacctgcagctttactgaatttgtccatcagttctaacattcctttggtgcaatctttatggttctctttacagaagatcatgtcatcagcaaacagaaaaattaacttcttcctttactatttggatgacttttatctcattttcttgcctaattgctcttgctaagactcccaggactatgttgaataaaagtggtgagagtgggcatccttgtctttctctgatcttagaggaaaagctttcagcttcaccatggattttgatgttagctatgggtttggcatagatggcctttattgtattgaggaacattccttctatacctacttgttgacagcttttatcatgaaaggatgttgaagcatttgtcaaatgctttttctgcatctattgcaaggattgcatggccttcattttgttaatatggtgaatcacatttactgatttgtgtatattgaaccatccttgcatcccacagctgaatcccacttgtttatgatgaatgatcctttttaaaaaaattgtttatttccataggttttggaggaatcagtggtatttggttacatgagtaagttatttagtggtgatttgtgagattttggtgcacccatcacccaagcagtatacactgaacccaatttgtagtcttttatccctcaccccctcctcccctttcctccaagtccccaaagtccattgtatcattttcatgcctttgtatcctcatacttagctcccacttatgagtgagaacatacgatgtttggttttccaattagtgatccttttaatgtaccattgaatatgatttgccagtattttgttgaggatttttgcatttatgttcatcaggcatattagactgtagttggggtttttggcgggggtgggggagtttggtagtctctttgtctggctttggtatcagggtaaggctggcctcataaaatgagtttggaagtactccctcacgttccattttttggaagagtttgagaaggactggtattagttcttctctaaatgttggtaggattcagcagtgaagccatcaggtcctgggcttttctttgataggagactttttattattgattcaatcttcttactcattattgatctcttcaatttcttcatgattcggtcttggtagattatatgtttttaggaatttatccatttcttcttggttatccaatttgttgccatgtaattgttcatagtagtcgcttaagatcctttgtacttctgtgttatcagctgtaacatctctttcatttctgattttatttgcatcttctctctttttttcttagtctggctaaatttttgccaatgttgtttagcctttcaaaaaacaaactttagaaaaactaacttaaaatagagcaatacggtgtgtaatgttaagattttgtaaagcttgcagatatacatgcaaccattttcatgttatttttgtctatgtttaaaatacgtgcttatgtgtaaatatgaccatgtatgtgcagacaaacatttaagaacattttagcaacatttaggttacttctgggaagtggggataaaatagatcactgttactttattcctttctttagtgtcttttagaaacatatattaagtttatgaattaaaagattaaaagcgactaattcaggctcagtagcttttttattgtatggatgagacaaaagacttaaaactatctacacctgtggtttttttcctctgtaaaatatggttagaaatatctactttgcagagctgctgtgaggatttgattagaaattattcataaaaatatctaacagcatgccttttacttagtaggcactaaataaataataattgtttacattattaataagaacataagagatattctgttttcaaatttattcaccctgaaatgtgcagagaaaatacttataggttctttatttttcaataactgattctttcttctacttgagctccccatgggggggaaatgaatcttagagccaagaaacttagtttgactcaataatttaaactggcatttaaatctcttttggtaagtgctgcctctttgggtataaatatgtggactttcagatcgctgttccctcactgggtagggggtgccatatttagcaaataaaaatttaagatactcagttacatttgaattttaggtaaaccacagataatttttttgtagtatgtcccaaatactgcatgggacacacttacagtaagaaaatacttattctttatctgagcaccacatagaaccaggcatcctgcatatcatctggcagccccatctgtgggtgaacagagaggggcaccacgttggggaaaagggccctggactcctggactttgtgcatggggtagagactggatccagtccttgggcaacagataggcctcttctctgatgtccaaggccagcatgacccacagtctgtgtgtctcagctcatctggacctgtggatgggcactggccagaccttccaccttacctctcaagggtagaggactccttgcatttctgccacatgctctttgggccctggactagggtgtccactctggggcctctgcagtgaggccctgaagccctcagcatggtgggatcatagcagattccctagctttcaaccagttgtcagacggcccctcagaagcgtgtggggagttttgatgatgaccgcaggaatactgaactccacccatccccctgcccaagatagtgtgcatgcttcagctttgctgtggccaccccttgtgagtccatggcatcctgggtccatagcctgaagcagagcgcaagcagcagccctggccacagtgttcccacagtgcatctgtctccctgggaccacccacttcccacttcctctttctccctgcatcttcccacaatccacctgagccaaagggacaggctctcctggctctcctgcctctcctgcctctcctgcctctcctccctctcctccctctcctccctctcctgcctttcctgcctctcctgcatgctctgtgctttctcattcagcattcactccacaaacatccaatcgagcacaactctattcaaaacacccttctcaatgcagaaaacaacagcagtgaatctgacacattcttgactgtctcggagcttacatcctagtgcagtagatgaggagaaggacagcaagcaagtatgctgatcattacatattataaggtcccaatagcgtagtgtgtggtaatgagttctacaaagatcaggaaagctgtgagaatggaggctgaccacatggtcatggaggggagttcctttagatgggatagttggagatggcatttgagtagacatttaaatgaaggaaacacaggccatggcagtgtctaggggcagagcatttcaggcagtgagaacaagcggctcagtgggaacaagcctgacatgcctccagccctgcaggaaggccagctagctggagccggtgagtgcagaggacagtggctaaagtaaggttggaaaagtcaccaggcctgcctcttaatgttttcaaaaagatatagaaaataattcagggagactttttttctttctttctggactctccttttgctaagaagaatcgagaagtcacctgcagagaaaacagatcaggggccacctggtcctgagttggaccttccttctcacttctcagggctgcaacattcctgcagctgggaagctgccagctagtgattcaaggaaaaactgaaatatagtttgacattttcaaaatattcctgttacatgaatacgtttttacaaggtgttatgagagacccattggatggagtgacatccttcctggaggagccagcagacttagcactgaggcttgagtaatttataagaacccataaagccatcctggaatgtgtgtctgtatggtaaaaatgatgttatgaggatataaaccaaatgtaatgcttcatagaatgatgttttatggcattacaataatctgaaaatatggactttgagttgggtgtgttgcagttaacacaggtgcagaggtagggagctgtgccttggcccccctgccggcctggcctctgccatcccatcattgattactcttgcatgaattcgggttctccaggctccgcacgtctatctacgtggcataagaaaagcctgttttcttgttctcggctaaactaatggcttcgtttttgttttcttcctggctattctctacccaacacaggtcctggtgttcctatggtgacggtgcacaacacaacagataagaaaagtaagtgctcttttttttccttaaatcttcctgagactcaggagaaaggaagcaaaacactctatgagatcagctggcccacattctcctactcagagacagagggatgagtcatgtcctagcagttcagaataggccatgctgatcaccaatatcaacgaaatatgatgaaagtcaaagtccgcatacccctgccagagggccccacaccccttcacaagtgctgagcctggagggtcattccaggcctacccaggtcatagactgacatcctctgaacagccagctcaaaaggctttgtagcctcacatgagtccgtccccactgagaacctgccatgtggcaccaagacttgaggggcacatggaggctcatctgtctttgtgggtctgggagcttcacggcatggagggtctctgcatccatgctgcacaggatatcagagaaaaacttattctgccatttgtaaaatggtagggaaggctttttcaggactgttgtgaaaggggagggagattcaggctcaactttgaatacagcaagatcccgtgggggtttatagccagtgaccagagaaaggggtccgtggatggaaaactgctaagagaaggcatcagtgggaggcgatttttgctaagctgacctcacaagatccttgctgaaggcaggacaaggacttaggctcaaaggtggaggacgaggaacagttacggagggtgatcagatatcaggggtggagacctcttgctaaagctgggcaatgcaggccgaagacaggttaggatcaaggttgaagcctggtcaagaagaggactcagaggagcctcactcaagtttggtcaaggagagtctttgaaagacttcccagggtcactagaggtggcatgtgtttgcttggagggaccccacacaggttgccacgggcacatccgtgtttacgcgagggatgtgtgctgtgtgcagtgggaggcagaggcacagcacagctgagaagcaaagagaactcgccctcggtccctccctttccagccctccctctgtctaacccaaagcagcctgtgtcctccttcccccgaatccttcccactcccttccacattcaggaaccccttccctggcaggagggcaaacttcatggcccgggtccgcagttcccctaggtctggggacagaggtgactccgtgtctccagtgaccatcgagcatcagcggctccctgattcctatctctgtggtggtacttcaagctccaggagaactggaggcggcggcggtgaggcgcatgttggaaaggaggctccaaacgtgtgtttagacaccgtgaagtggtcaaactgttccaaagtgggcaaaatagattcgtttaaagagacagcacttagccaataatcccaaataatgatgatagtctgccaagctatcaaatcattattagaaatacaaaaccaaagcataagtaatcataaaaccagaaataaattaatagattttaaagcccccacaaaaagccataaagtggatgtcagaatggatatacaaaaacactcagaatggccgttggagggaccccgtgctgagaagaagcgggatggccttcctgtgctcctccccagaggaggggctggtttccccagcaaaaaggttcacctgctcccaggctgctttccagcctcacctgcgaggtttgggaatctgggccatttgagcaatgggggcggtatccccggaaggatgttgggcgcgattgcctgggtctctcacctccccactgcatccacccaccctctgcccactctaaggggcacgaggctgtgaagggccctccaggaggccgcagaggccaagctagaacttccaccaaggcctggggtcggtggagtctgacagacatactccggcatgacagtgaatgtttgaaacacctgtgctagacctctttaggtggaattttccctgaaaaaatgccgatgttgcatagagcctcaactgtgacatcttttttttccttaagcaaatgtatattttcattttgagtatttgataagatttagagtccatggacacctttctggtatttgtgaggttttccccttcttgaaaattgatggtctggtagaaattagataaggtgtccaatggagctcacagcattgcagcctcccgggttagctgttgcccgatggttctgtgagatgccaccactgaagacccggaagtggagacacaggactctatgcactatttgtgcaacttcctaggaatctataattatttcaaatttaaaagttttttctaatctgtggtctaataaaaaacacaaaagtatctttcagctttgaaaaatatgatatagcatatggctcttcttacaaaagtcattcccttaaatgctttttacttctttggaggaagctattattaatctattcaagttcaaaggttaatatagtccctacttttgggaaatgcattttgacttctaagccacttccagcctggatgtgatcagtccttggggctcctaaagcctcccacggtgctggatcaagtcaacacagtttccaaggctcatgtgtgagtgaaaatgaagccggcctgtatcttaggtgtgtgtgacactgttgagaaaatatttcatttattccatttataaaaataaggtaatctataggtgggctgaggtgcaattcttcggaagagagtcccagtaagaattgaccaaatgtcttccagcaagtgcaacatgctaatatgctcaaagatccaggaaattttgttaactctgctgggaaacaaaacaaccacttcttttcctctgtaggactggctactacattaaccaatcaatccaatcaatattgacagaccataggccctaggttgccatccatatccgttgcggagctgcataaatgggaattttttaggaagcatttcgccgtttgcagttgagctgtcactttggtgactgtgactccctgaagcaaagagatgggacccagcggcttaagaaataaaaagcactgtgcacacaggatggggctggcgttacatgcctgtactcccttcttctctgtgtgaaatttaacagtgaacctgaaggtgacaccattgcgcttgatctcagcaaagtgctgactaattggaaactggacggcgtttagaattattttggtcacatttattttacgagcctatttatatagcagtgtttgactctgggtttcctggagcctaattcaaactctaggaatatttcatcccgccctagcctgtttctgcatttctggctgtcaatgtagttcaagctctttcaggatggtaacttaagctgccattttaacttggaaaaaaaaatgattaaatgtggttgagttgattgtcgttcccatccccaggaggacagtaggggtcccatcttgctcagtgtctatgttacattcagacttcatgatttgaggggttccaggttcctgaacacccactttttccccatgcctggataaaagtgcctgaaatcccttccttgcacggccatccctgagggttggcacatcatagctgcacgaatggctttgagtccacctgggaaataagagtgagtgtggcagggcctggtaaagtgccaaacccagccctgagttccagcctccaggtgtttgccatgggaggcgtgtggggtttcttcagtgtgtttaccttttgatatgtctgatgtcctcttgcagcacttcacagcccatctccaacccagctgtgtcttccccaaacaaaatgcactgagttttcattttgtctgtcaaactggtgcatcttggatgagaaggcaggtgcctggtgcttccaggcccccagttccagcagcatcttgttcgtggtgtggttggaccacatcagagcctcctcgtggcctctgcagtggatgaagggtccacagcatgtggtttgcggggggatgtgcatatcaggcagccgacaaagccattgtcaggccagcacttcacacatcagcctttgggcctcaggtaagcttgagatcagttgtcctctttcacgattgaaaaggccgctgaagacttccaggagcaacacaaaggcaggcagtgagtcacccatccctgcagatgcctgtttcatccaaacactcagccagctagcggttctgcatcgtcaggattctgcaaaaccccacaccacttgtacttgttccatttgatgctccatcctgaacaactcagacaaccgtgttctgatcagggggccagagaaaggctggaggtcacagggagccatggtagtaacaatagtggccccaaccagcatttatcagcacttgctccggggcagggtgctgtggcaaatacttgacatattttaactcatttcatcctctcaacagcctgtgaggcaggaactgctattatccccacttgtcagctaaggaagctgaggcaccacagcttaggtgatcgggccacatgcatgcagcgaggaagcaaaagcagaggagttgcatctcggacgcaagcagtgcggctccaacagagcctgttcttccagacatgtggtcattgcatggcgctgctcagccgcctgccctcatgcggtctgaaggacaactgcaaatccagagcgatgcccggcctgcactcccattgagatgagtctggggaggcagaagcagtcacacctgcagctcgttctcagcaccttctccgcccatacaccacccccggggtccatccgagccagctctggggtgagcgtgcggcacggcaccttctcctgctctgagaagccttccacgtcacagggaagagatgctcctcaggccctggtggctgttaaacctgtgggagccccgtcgaattaagggctctgcttcctgcagcagctcagcctccatgtgcaggctggggtcatactccatgcactgtgagagctcagcccttgaacttcaccctctaatggcagccccttagcccccaggcagcagtctttggctagccatccattattctcttttgaatgtaatcgtagcagcagttctgggctctccacacagcaccaggccccttccttgtaccaaccctatgaggttcaacaattcatctgagatccacagcaaacttcagggcgaggcccggactcttgtcttatctgactaccaagcaggcgctcttgactgtgggctgggggctgataccagatgtctgacaaggggggaaaggcagccccagaccccaagacccaggatctcctggccttcacgtcgctgccatctgggaaatgtgctcacagcagcagcctctgtgaccactgagctgctggtcaaaaatcacccctggtttagatcagccctggtgaggccatgccagcacaggcatttgcacctcacgcctctgttgaacagtgtgcaaagcagcagcgcttccaacccgcgctgtggggctgagccaggaaagcggggcccatggcctacagctgggcagggcaagacaggaggcctcggggagccggctcctgagccgctgtgtgacgccatgactggcagctgaggtgtggcccacgttctgttacagggcagagcctcggcactgtgcgtcagctagcaaagggggctctggaaggctgggacccgtctttatcatactatcctctcccagccctgctgtgaaatttgaaattactgtttcagaattctttgtcctttcccctcctctcccccactgaccccaaaaccaccctgggaatatttgacttttttcctctttagaaaatcttatctacaaacagagcctgcggggtgttcacagatgtgactctgaattatttaaaagctgtttccttaagaaggtaattatggttgggaccaacctatactcatttggtgcctggatattcaaacaaacaacttaggtactgggataaaaaaaccaacaaaatcatagtgaatacattgcgggctttaatgtaaatatgaaaggcaggcccacttagagacgtggatgccaactcgacgtgtgggagtcgaaattgcggtgtggcttgcaatgcagccccacagccatgcagagaaagcgtgcgtgtggcggggttgaagctggctacactggctgacagcaccccacagcggcctgcaagcgcatgtgggagcttgggatcactaggcagcctggttcccactcctttatggcatcaaaagttaggtttctctacctcctactctcttcatttgggtctttgtaagaaagcaaaaacagcccctaccaccagtggtgcccaggtgggtccatgaagcaacgccagatgcagttggtttccagcctctgttcctgcaccagtgctgctgggcgcacccctgccccaccttctccctgaggcaccccctcctagactgtcaaggctgtgcccacagctccccttccatcaagcacagggcgcccacacatggagagacatcaggagcatggcattccagagggcccacatgtcactgtcacgctacacgccaaggagtttgcccgccatcctgcaggacccaggaggagcactgtcagacgtccctctcgaaaagcttctggtcgctgtgcagagaatggatggaaggaccccaggttgcagacaggagggctgctgggggccatggtggaaaggatgagagtctggaccagcaggggggcctccaatgaggggctgcctctgcaggccctgcagggagagatgcacctggaaaggggccgaagagctgccatctcaatccagtccagggaggtgtggcacttgctggggtggcgaagcatcatacagaatcctacagcctgtggccctcaaaacctgggtcttgtccagtcctaacaaagaaggaacagccccgctgcctccttgggtgcagcagcaggcgactgggtgggtgtctggagagtaggtcctcatgcctctcaccctgcaggccaactgggcaaagccctggctctcagaaacagtggccaggacacagcgggcagctgccccatcacagccgtggagccaccaccaaggttggggccgtccagcaaatgcacaaacccatttcagacctggagataaaagccagctctttcctgcagatcatatggggcagaaccaaaaagactaaaaatgtaaaaagatgatgaaggaaagtaaatgttaaaagaaaaaaaatttcgaaagcagcctggtgcctaacttcagccctaggtcttaacatggctgcatcaggcaagtttctacctaagacccacagctttcaaatattttaaggagcaatttggtggccaaagagagaaagtctcattataaagtggcctttatgtgaggggaccttgccaagtcatgccaagacagaggacactgggccatctgtcctcaagtagtttttgctcatgaatccctaagataatttttgaaaaatcatgtttcccctacacatttttaagttgtcacctaaagtttttctcattaattcaaagctgtacaaaataagtttttagcatatttattttaaaataaaagtattacataatcctatgatatctaagtattgtggcaatttgatacttaccactgcccagttaaacatttctggaacaagttcttcttagctttacatccttccttttcctcctcgagctgatatttacattccatttgtccgcccgtcaccccagaattctgtcctaacgtcatttaatcttggaaatattttaaaggtcttttctttttaacttccggtgaccataaggccataatcattacttgttggatggaattattatcataattatcacttgttcacatcaagcaattaggatacattacatactttgataattgttggacataaaaagttatgattgctctgagatgcatctcttagcgagctgggtgtggtggtttttcactcagttcatgagcacacctgactcatttccagagaagaccttgtcagaaacgtgtgcgctcctggtttttccctccttttggtggtcgcttctttttgtttctgtagaatgtctgaaaatgtgttcatgtaaataaatggagagagaggagtcttgttatagcagtgccattttcactgaacgcctgagctatatgccaaaacattgtggcccatccattctctgtcattaaggattattttcaatgatctattgatttttagctcagtgagattccccttccattttgttaaaatcaaaggatgacaagccgaccatgttactgggggctcttacccattactgggggagttctcttactgaactcagccttggtggtccctcatccttcatgtggagcccacctgtgtacaagatgccccagggacagatgagggggctccaaggccttccttgccctcgtgacgcctgtgtcaggccatgatgaaagaggcacaggaaaggagcagttccttggagcgaatcaggcatgtccattctcagcacatttgccagcaggctcctatggatgcagagagcctgggaaccagtctcctgaatcccacgtgtctgcactcgaaatcttctggacccacagggttgcacgcgtgagcagctgtcctggtgggtggagtgtctgcagatttgctgttggaacgtgttagacttcagtccagcatttgggtgggcaagctggcatttggctaacacagagtggaaagcaagccacgcatggagctgcacgccctgcaggatgtctgcaggtgcttcttcctctctactacctaatgcgggaggagagctgggcttcgctgccacccagcagctctcggtgcctcgaggagcacctgcaggctgggcactgtgccagccactgcacccgctcatccgtgggctggaggacacacacatgagtcccctcaatgcacaactcctctggcatcaaacacctgccatgggcccagcatgatgctagaaggaccaaaaataaatgccacctactgggaccctgccctcaagttgcttaaaatctggctggaggaaaaaagatatggcaaaaagaataatagttgcccaaactgtgtcagactgactctaacaactcaacattcggagttcagagaaaagaggctgggtgctgtggctcacacctgtaatcccacgaaggtgggaggacctctttttcttttttgacctcctgggctcaagcaatcctcccacctcagccccacaagtagctgggactacagacatgcatcaccatgactggctaatttttacatttttctttggagagatcaggtctccctatgttgcccaggctggtctcggactcctggactcaagtgatcctcctcccttggcctcccaaagcattgggattacagacgtgagccaccgcacccgaaccctttcctttgtcttttctattttgttcataaagcatgtctctgttgatcactgcatgtatatgtggagggaaggacaatatgattttaagaaatgtaatatttagcatcttggccccaagattctacaatcctttcataggatttttttttttttttgagatgggggtcttgctctgtcacctaggctcaaggggagtggtgcaatcacagctcaagctatcctcccactgcagcctcgacctccagagctcaagctgtcctcccacctcagcctcctgagtaactgggaccacaggtgtgtgccaccatgcctggatttttttatgtttatattttgtagagatggagttgggattacaggtgtgagccactgcacccagcaaggaagatctcttgagtccaggagtttgagactagcctgggaaacacaatgagaccctacctctgcaaaaattacaaaatttagccgggcatggtggtgtatgcctgtagtcccagctgctcaggaggctaaggtgggaggattgcttgagcccgggtgttcgaggctgcagtgagttatgatttcaccactgcactccaacctggctgcaagaccctgtctcaaaaaacaaaaatggagctcagagaaaagagatttccagttaaggtgagtaagtttaaacagtagtcatgcgggctctgggcctgaatctggtcttcgaatatgactaatggcctagccctggggtaagcggacggcagctgcaagagcacagggagggggcgaggtggggcagagaggggtcctactgatggccgcaggggaaggtgcacgtgaggagtgagcagaaatacagcaggagaggcctggactagaaaggcacagaaaacccaggcaggggaagtcaggccaaggcaacagggagatgccggagagacttctgcctaagcctctgcgtgcacacaccatcctgcagttttatttcttgtagaaatgtgagaaagggaagcggctgctctctcctcttttagatccgttgcctattggtgttcattggatctggtcaccaattttccaaaatttagcacagtggtgattccatcaatcccctgaacctgccgggccacttggaagcatgtcttgcaacagtgcacagctacaccacgacctgcccatgggacgcagcgagggaagcagcctcatgagcaggcctgagtctctgcggtctcactgtgtccagatctgataatagctaattccaccaaatattagagggggctcacatttaattaaagagtggccatttgtgtgctccagactggaggtccccactgccctgaagtcaaaagaaaagtccttcagggaatatgccaatcttttcttatttctctgctgagctcctgccctctttgaatgcaattatgggaacaaataaaatggcttaactcaagtcccctgtgggacagtcagctctctgctgataaaaccagttgtgtgggcaatcattaaatgagaaatctaatatttaactaaatttaatagtctgttgctttggtgctttcctgtgaagggtgggatttcaatagagaggaacgaggtattcacacgcagcctgtgtagtccatgagcgattagaacatggtgcgttcccacatgaaaccagaactctcagatccggaaactggtaacgggctgtttggtggccagcctgtgttccgttagctctaggcaagcttaactcagtaggcagcagagaacattgctccctgagtttaaccttctccttcatgaccagcatttgagatcgcacactgacggctgaaacatcaaattcacatgcatatatatggagacaagagcgtactttaaccagctgtaagagggtctgtccccattttctctcagtttgagatttggccatccagacaggctcttgccactagcagacccccccagctgaagccctttctgggacccagaagcagaagctaactgatagcaagaagcccatctctgttctcattggtagggtctttctacctttgctcctgccagttcccctgatcttcatcggttgtcacttccatcatttgacccacatttgcacaccccaagttcctcacctgttttgcacctgggatgatcatgtcagcaggcagaggagcagagaccacaggttctccaagggttacagctgaggcgtcgagatgacctcatgagatcgaggcactggtctcctacaataagctggagtttggagcgtgtggatgaactgcctcatagtcccagagtcgagtgaattaacttaggtgcatcattagtctcctaaacatcagaaaattttccatcaacttctaaacaccagaaacttttccatcaacttctaaacaccagaaacttttccatcaatttctaaacaccagaaacttttccatcaatttaatgcagtttgctttgggtcctcgggtctgagctgtgtgggaaacactggttgatagtctggcctcagtttttccaactcttaccgttcaagagatctgagccctgaagacctttgcagcttcctgagacactcaggaggacctctcctcggtcctgtttagtttcctggggccacatgggaacaaggagaaagacttgggtagaaacccagactcgttaccatctaaagatgcttaatttccaagatatgaatcgattttccacaaacccatctaccccgggtacccaaaactagtgcatttcgtctctgggataggactgaacactgataccttggcgaggggtagggagaaggatttgctgccaggaaaatgaccaaaactttcatttggtgttaagtgtatccagagagcttgacaggtgcctgagatagggtggtcaggtccctcttggaggaggtaacgcttgcgttgatggaggagaaggagctagcaaggaagatttcaaacacagggcagcacgtgcaaaggccctggggcagcaaagagcttgggaaatgctgttctcttcattaccaggcagcactccctgctagtcttcctttcctgtaactgtgaatagaacatgaatgatatgcagtcactgtctcataaaccaactcctctcacctgagtgtgtgcctggagcattgcattaaagggctgagggcatttggactcagcaccaatgagtgctgccgcccatccattaggaacatgggctgaggctgtgaagctggcgcaggggcatgcaggccccttggggtggagtgcacctcccctaactcacgtgcatgcctgtgagggagagtgcgccacctctgcagccaagtctctgggtctcagagttaaggtcaagtctacttggacttcccttggacttcaccactgcagacaccccttgcagacgtagctgtgtttcctgctgggacacgtgtcctgcaagggacacgtttctcgcatgctacgtggtgttcggaacctttcccagtggtggtctaacgtcagatttgttaaaactctacctgtttgaaaactagtgtcactatttctccccttattttttatcaaagctcaatattcaaatgtgtccagcaacttgcaagtcattttcattttatgtactcgtcacaagcgctgggagcttccatttccccctgttcctctacagaaggttgccaggccttctgggcagagttcttgaataaagccacagccccatgttctccacacaaagccacacgtccagattctcctagttatgggcggtcatttgacctccagctgccccggagaagcgcccacctgcagagcagctttttttttttttttcaagggagttatatgggaggatgactggacatccattctagcattgtttgtgatcatttgtttacgctttaaacaaatgcacaaattgcagctgcttccaagtgatttgacgagccaaaggcaaagttccttgcagaaaaattccctttcacaatgaaccacaagttatccccatgtgtaggcttagtgtgagaagggagaaaggaagttgggtggtttttatgacacgtcagatggtgaaatgaaacagaatggccatttcagtacatgaacggagagttcctcaggggacttctttgcatctgaagaaatagataacgaggacgtgtgtgtgctgtcgcggcagaggcacaaaggtccagcgcatccacaccacagggcagaactgaccttggtctctaccacggagggaggacagccagtcccactgcagtgtgaagcaaggctcacacgactccactgtccacaaatacagtcaccgaagttaaggtctctccagagaccagcttatcttctgttttgggagagagatcagaatccattttatttctgggaacatttaataaagatgataccctagtttctacccacctttccttttctggttattatggccacaatttttggaaaaccatttgtcctaacagatgtgtaatgtaggttttcttaaaaccagcagtcatgggaagaatcataccaaaacctgtgcgtgtgacgccacggagaacaaaaacctctggtgggggaaggagaaagcctaagacggtggggagaatctttaatccacccaaattccagatttgagtctaggcttttgagcgcataacttgagcgtgttttttaatgcccagtttctttttctgtacactagaaataataataatcacctctgaggctgatgaaagcagcagttacgcacatgaaaagccatggcccgcagaggtcctccatgagtgaccactgcatctcagtgtgtccctgtttcctctctttcagaaatgtttgacctagaaacaaatgaacatgtcaagaaggccataaatgaccgacagatgcctaaagtggaatacagggacattgagattgatgattacagtaagtactacgtttttcccctctaaaagaaaaagaaaaagaaaacgtgggctgtgacacagtgcagtcatcagcagcaggtgccctgcaaggaagactccccaagcacgggggtgtatctttgcccctcagctcctctggcatggagtgtcttgtgttcagaaccaagatgctcactctggtgacaaaaccaaaaaaagcagggcacaggatctctctccctgagaggctgacagttgcttcaaagcaagaccacagactccaacgctctccttctttggtgaccgtgtcaagacaccgtccagaaaaacctcttccctctggaaattccctttctgtgccatctgaagtccttcctgcctcatcagctggtggattatgggctgatgaggggcgtccttgcagccagggtttacgtgaggaggtttgagtgctgttactccctaggaaatgcttctcactctgcctttctctgcctgtgcccttctttccttgaactgtccctccagtcattcggtaagttctcctgggcactaactctgtgctaggcgttgctaagcactaaacaccccagagcattagctggacctggactcacagctctaggagggaggcagagcctcggagcctcaactcccacctccgcacagatggctcccaagtcacccggctggccccgtgtcctcactgcccaccaggtcgttactcttggaaacccaagtgtaaaatgcccacagcggatttcactgtcttcccccagaactctgtcccgctccagacttccccacctctatgcatagcagccttttggtggtaagttggtgtcgaataactgagacttcaaaccttgaagctgtctttgagtcattcatgcagacaccacttacccatcacctctgaggctgtaaacgggtttccctcctgtgcaaactccgactgactgatagtaactgcaggagctctttgttgaaagggaaggtttccagagctcggcggaaagcgtgttgaggctgataagtaacactgagctgaaagggcagggggaggagccacacaccttgcgtttgccatccctagaccgtctctggaacctctttgtctgcccttccctgacacgagacagcagcgtgtcgcctggagcctagggtattcgctggcagcccccttgtgctcagcagcttagaggagacacaatcacctaacagactcagctcccaagagcaggtaccaaggctcaccccacgaaacaaaaacaggtcccccaaacagtacgtgctgcaaagctgcattgcgtagagcagaaagtaaatagcacgagaattcagagaagagcatgagactgggctggggacatgtgggaatgctcacggaacgtgggacttgaacatggtccctagagtcagcatcaggtgggctcacaagaggagaccgtgcaatccagagaagagggcaacgtgaggggtcttaggcaagggcaagtgcagtgcagtgtggctgggtctggaggctgccctggagtcccagcctgcaggacagcccaggtgtgggccctgcacagggaccctcactcgcctgtgctcaccacgccctccctgcagcccaccacaggtccgggccaaaaacttctggccccgccatttggccacaggaagctatgctctatcacaacttttctggacattgcattcacctctgaaagtcagaacattctggaattttgatgcacttcagatccgctcccgcccccacccccacccccacccctgcccccaacacactcacatgtccaaaggctgtctctcttaaaataccctgaaggtgaccacgccagggaagggggcatgaacgaaatgagtagggaatggtctaggagaaaaagaataattttgtgtgtgtctgtgtgtgagacagagtctcactctgtcccccaggctagaatgcagtggtacgatcttgggttactgcagccttgacctcccgagctcaagtgatcctcccacctcagcctcctgagtagctgggaccacaggcaggccacatgcccaactaattcttttttttttttttttttcgtagagacagggtctcactatgttgcccaaactggtcttgaactacggggctcaagcaatcctgcctcagtcccccaaagtgccaggattataggtgtcagccatcatgcccagcctagaggaggaagaagagaaattcaagaaaaccataaacaagggctgggcatggtggcttatgcctggattcccattactttgggaagctgaggagggcagatcacttgaggtcaggagttcaagacaagcctggccaacatggtaaaaccccatctctacaaaaaaatacaaaaattagccaggcgtgatggcatgtgcctgtagtcccagttacttgggaggctgaggcacgagaatcacttgaacctagaaggcagaggttgcagtgagccaagatcgcaccactgcactccagccttggcaatagagtgagactttgtctcaaaaaacaaaaaacaaacaaacaaacaaaaaatggaggctgtgacaagctgctttggccaagaaatgtgtgtattggccagtcacggtggctcacgcctgtaatcccagcactttgggaggccgaggcatgcggatcacttgaggtcaggagttcaagaccagcctggccaacatggtgaaactctgtctctactaaaaatacaaaagttagctgggtgtggtggtgcacacttgtaatcccagctactggggtggctgaggcaggagaatcacttgaacccaggaggcggaagttgcagtgagctgagatcgcactactgtactccagcatgggtgacagaatgagactccatctcaaaaaaaaaaaaaaaaaaaaaaatgtgtgtgttatcccagcccaatggagaaaccattgccccggcatgtctctgaagctcctctgttctcagctcgaggctcctccgcagccttggcggccagactgtcaccctggcaagatccctttctgagctccttaggcctggcctcctcctcctccagcccactctacccactgctgtcccagtaacgcttcccaagcctgcagcactggtgtgtgactgtcatcccttcctcttaggaaatgcagaaaagacctttcaaagcacaaagccagctttcccacccttgccacacactctgtccagcagggggtttccttaaaaggtgggtgggtacagatgccaggagaggatgtggggcacctgtatgagcccagcatcaggaagacccccttagggatcgcaggaaatctgaaagatgtcagccctaccgacctgacttggttttgtttttttactttatgctaccagaggctaatgcttttctttattttattttattttgtattttttagaaaagtaggacatcttccagaagggctcccctgaaatgttttcagccagtcagaacatggtttccaaggtctgcccttgggcttatcagtggcagggagcagcccagaccatgttttatggaatttaaatgatgaagtccaaggcctgcctctccgccagtccctgggccattgagctaatttgcaagccattaacattcagcccgaatcagtaatgagacgccaggtcagagctggctgcccagccagccacccaagcctgcagtgtatctgtgtagtaattgtattgaaaagccgctaattccaatttaattgctgtgcctttggtaatctgggttgtagttaacatcaacaaataaattcaacttggatgggaagatttgttggaaggtagggggcacagaagaaattggtgaggcaggtttttgaggtttggttcctacccactctccctcacccactggatttcatgctgctgaggaccagatccagtgaccttggtagccacgggatccaatgggctgtaccatccttccctggcttcccctagctgtggctgcagcatagccatagagccacccagcacaaacctgccaacagcaagacccacagatccacctggctctgcacagaggcactgccatgggccggcaccctctcccctctaggcggccccctgtctcccctgaccctctatctcttcctctccctgcctccctgctcccaaatatccatccccagcatccccgatcagatgctgagagatgcctttgttgccgcaggcagccctcctgctctcagggcaccatatttccctgcctgaaattctgctgctagcgagtgcccgggccatcgagtcttccgtgcattcagtgcactcccatatgcaagactgaatggaagcttcagagaaatgaagcttcacacaggtcgggtgacttgcccaaggccgcgcagcaggccagagtcctcaggatgaaaaccctgggccagtctctgtctgtgggcttcccctcaggccccacccagagcaccctcacccccacggtcacccaagggcatgcccgataccccgtggccagcattgccccctaacccgtgctgtgctctgcttctccccagacctgcccatgcagatactgaagccagcaaccttcaccgacaccacccactaccctctgctcctggtggtgtaagtatcgtcacatctgtctttccctggtgctcgttctggggctccgtgacacccatgataaaggaatattgaactcttaagaaaagataagcaggagaaatgacattgttgcaaactgaaaacataacatcgtttagcccaatgtcaggttctttaggaatcttggagacacccagaggttaaaggaaagtgggtgctgtgtacccaccgcctctccccaggctgcctcaggttctgtgaccataaagtgaggctgctgggatcatcgtagtggcattttgcatgacaggctcaccggaggctggcaggggacaggtcccaagacacagagacacaagatggctggagcctgggacccgcaccctgagcccgtgggtctcactggctggcatttctggccactgccgtgaatgcccttttttcaccagcaaagaattttttcagctctttcttatattcattaataaagcctccggtttgggttttgagaacaactttttgtgctctgtaaatgccttgaaggtgttgggtctgattagggaactcagtgctaggagccggcccagtgccctgtgcataggttcaaatgttgcctgacagccctgagtctaggtgatgtccacgcgctgacaccgcacggggaggcagtgcagagggggccacctggaccgttgagcaaatgccccaatgcacctcctggtctgtactttcaagaccacggagcaggagaaactcctgcacccctcgtagcctgggagagccggctgaagcgaggcctatgctgggctgtgttaaggatgccagtgcaactaccccctgagtaaacgctggcacctgatggagctctgattaaccctggtgtcttgccctgctcccttcctgagggctgagtccctaaatagcaaaaaggttccattatagaaacgccccagggcacagattccaatagctgattccgttttgcaattaacccactttccttaatatctggactgctttcacactttcccagcagccatgcatgcacactcacccacatgcagacacacgcacccacacacaggcacacgcacatgcacacacacccacatgtgcacacatgcatccacacacacacatgcacacacgcatacataaacacacacatatgcatacccacatgcacacacacccacaggcacacacatgcacacacacgcacccacacacataggcacacacacatgcacacacccacatgtgcacacatgcacacacacacgcacctgcatacataagcacacacatgcatacccacatgcacacatacacacacatgcacacacatacgtgtgcatacgcatccacatgcagcacatatgcacatgtatgtgtatatacacatgcacacatgcacacatctatacacacccacacccacagacccacacaccccacacatgtgcacacacaccacacacgtttcctgcctcctttctcttactaaaccagattttccccactttctccaggatgctaacaacttccgaaccagctttcttcccctgcacactggtttcttcagtgatcttaaaggaaatccccaaaagcatttcagtttacaaaacaattctccttcccttcagaggtaaaagtggtcgtgcccggtggagacagctgagctctgctgagctcggacgggaccggccaggcaaccccaccccctgggtgcacactcactctggccttgctagcttgccttggaggctgtgtctttttgtttgtttctcactgtgacatcaaatgtgatagcaaggagatctggagtccctgagcccctgcttcagattaaaaaaatccaaaagaaaacaaaggcacactcgacatagagcagcaccatgactcaccaggaccctaagcatgcagcactcgagcgcgccgctcctggcccgctcctcctgcccccaccccactcctcagcccttggcagacagctgggagagtgcccgtggtcgaagcagtcacctggctggagccactctcagttggggcactgctccctgctgttccagggaggcaggctggacctggggctgactttctctcctgtccatctttttcccggcaagagggaaaatcacttaaaaacttccccacacccataagtatgctggtcaatgaggaacaaccagtcctgcatagaaaatggccctgttcccagcctgggcaacatagcaagaccccatctctacagattaacagatttttcttttaattagccaggcatggtggcacatgcctgtggtctcagctatttggaaggcaaaagtgggaggattgcttgagccccagaggtcaagcctgcagtgaaccaagattgtgccactgcactccagcctggccgacagagtgagaccctgtctcaaacaaaagaaaaaaaaagaagaaaagaaaagaaagagagagagagaaggaaagaaggaggggagggagggaggaagggagggaacagccctgtttgaggaaaaagaaaacagccctgtttgtggcactggtcgaatcccatggtccaaatgccccaccatggatgcctttcagccagcagtgctgggctcgcaaatgaagagctgggaggagagcacagtgggagccgccagcccaggtcggaggccacactgcccagagccaatggctccttgactcccgagcagagggagggagaaaggccacccatatggcgggtttgctgttacttccgacttaacaagagacagaccacgtcttcaagccagggatgtggctagagtcagcgcggccttgtcacttgtgatgggtactgagaggtacagcctgggacatctagaacccaggaaagagaaaccttcttgccgtgtagggaaggtccccgcagggagaaggtgggaggatttgtattgtttccctcaccaaatagatgctttttggtggccgtcccagacagcgccggtgtgtgtagggatggccctgggtgtcctaggctcttggaggtctcctcttcctcctcactttatggggtgtggataacacctggctcacctgcccggggcaacagaatctggggtatggagttgagcgtgtggcagccgggtcacgggtaaaatcccttacgggggtcatctgacgtggcagctgctagaccagccgccacccaccacgcagcaggcctgctgagcccgggattctctttccagggatggcaccccaggcagccagagtgtggctgagaagttcgaggtgagctgggagacggtgatggtgagcagccacggcgcggtggtggtaaagtgtgacggccgtggcagcggcttccaagggaccaagctcctgcacgaagtgaggcggcggctgggcttgctggaggagaaggaccagatggaggccgtgcggtgagcacccgcccaggaagcaggagaggccgggaggggacggggctcctcatgggggcagcaccgcagtcacagtgcgggaatgctttttctccacgcacacatttttcatgcaatttgctcttacctaaaatctcttggccattccaaagaagtttcaaaggaaacttaggaatcttctcctagggacatttataactagttttcccactgcagggtagattgttgagttgactaaaacaaggggatagaaattgccggttgggttggcttggcttttctgcgctgtggtcactgacccgggccagtgtccacgcatgtctttgccatttatcccaaggggaggagagaagagatcaggaaggaaggacagaaaaagggaaggaatatgaatggggctggatccgtggaaatgggtcaccctcgttactgagagcaggacctccatgcacatccaggtggggccagaatgcccttcccggctctgaggaagggcaggcttttgttctgtcattcctgtgcatccctatcactgactcagcaagagcaaccgacatcacagaaacaaaaggaggcttagcaccaaggggcagatgctccaaatgacttattgaatcttattgttgcactggaaataaaaagacatcaagacactgcgccaggctgcagctggccttcaggctcattttgtagaagcagttttcacagtctgatggcacagaggactgcagcacttactctaacttcaccccttagagatgctgcaggaacagctcaacggactgtggacttgggttctgagaatgacaagaaggcagggagaagcgcatctaccagggacccccgccgcgaccatgatcatcaccgttatgggcaggggagcgtgaggctgggcccgggcacacaaggagggtggagcacagagcccagctcagtacatgtttattgactggacctggcatctctgtacctattataccagggtgctttgtgcgtttggaaatttttactcaactgactttgaaaacatttctcctcattttgaaaaagattgacggccctggtatgtactcagcgaatggtctttcaatggaaaacaatgagcgtgtgaatgaatggttccggtcctcctccagggagctatgagctgggtgatggcagacaaagcaattgcttcagaaacccgtgttgcagctgggaaatacggagcgggagagctctcaggactcagatactcagggaaggagtgtctgccaggatgcctttgcctggaagtcaatgactacaacaacacatgtgtgcgtgcacacacacacacacacacacacacacctctcaaataaggaactatattggctacaaaagacacagggatgtcaggtctcaaggttgatgaatccagacaccaacaatgtcaccaacgacccaggctctctccgtctctccgcccagccagccatgatggtctcatcctaagccgagccctcagtcacggggtggccctcagtagcacctggctccatgcttcgtcatctacctccagcaggttggggaggaaaccacttttagaaacttccagaaaggaaaggaaagtctccccacaagcagacagcaaacctctccttccatctccctggccctcccctgcccattccagaacctgccaccagtgagacaggtgcaggcagcccccccagagaccaagtgggtccgtctgacaccagtgtggggccagcccctgagcagaggatgtggggtgacaagggaatgctggggttcagtgtggaaggaggatgggtgggtggctgctgggtcagcagcgggcagtgccagccacagaggactcccaggacacggaagccggcccaggctgcgctctggagtggagtgggcctggcttcctgggtgggggcacgagtgctctcctggcttcccagacctcctcctttgggtctttttcatttgtgtgtggcttcccctgccatctcctgctctttcctcaccccacctgctctatctcctcccagggagatttggaagcccggggcctccccgccatcaagggcaggcccaggggaaagtcgcagcaccctcaggctccccttcgacacttggctctgcctggcatcttccccaaagagcacaggaattagagggcaaaggtgtttcacacacacacacgtcgtgccctaaaaagaaggaatgggcccaaccatctgttccaaaacaaggcagaacctgttctggaaaaagtcaataatgccaactcctaaaccaccgaagctcaaagaatgggagcgtgtggacaacggcaaagcttagagccgttgccaaagcacagactttcttaggaagctgatgcccaatggcgccaagccatagaaagcctccctcagctctccctaggaacgaggtctgcattttcattcatcagaaagaaatagcccaatttgatcggaaacctaaaatcaggaggctgacacattagcctgactcctcccactcccacagttcccccgtccaccaccaccatatcctcaccgaggagcccacaggccagcctcccacgagcagctgagatgagctgtggaagggagctcgtcccacccctgtggaaggcagcgggcagctgtgtaaacccgactagggccggtgggctcctgtctcctagagacaggttgtctctgggctcaacttgggattttcttcacgattgtttcttttgggtcctacgtgctcatgtgtacacacacagacaccctgggtcatgtgctaaggagcagcagaaatgcctcatttttatttactcatttgttcacgtagctagtggaggaagccaaaatagttatccccaaaatattgagacctgctaagtgaaagatactgaaaacacagggactctctgcctctgcccctgtttgccagacgccaggacatccatccttccttcctggggacagcacctgctcatcagcccagagagggtcccagccgttgccagggtctctgggggcagattgcattgccttctcacaggttccctccttttaaaagactgggggctgggcatggtggctcacgcctgtaatcccagcactttgggaggcccaggtgggcggatcaccggagtccaggagttcaatcaagaccagctggccaacatggtgaaaccccgtctctattaaaaacacaaaaatcggccgggcgcggtggctcacgcctgtaatcccagcactttgggaggccgaggcgggcggatcacgaggtcaggagatcgagaccatcctggctaacacggtgaaaccccgtctctactaaaaaaaaaaaaaaatacaaaaaattagccgggcgaggtggcgggcacctgtagtcccagctactcgggaggctgaggcaggagaatggcgtgaaccccagggggcggagcctgcagtgagccgagattgtgccactgcactccagcctgggcgacagcgagactccgtctcaaaaaaaaaaaaaaaaaaaaaacacaaaaatcagccaggtgtaatcccagctactcaggaggttgaggcaggaggatcgcttgaacctgggaggcagaggttgcggtgagccacgatcacgccactgcactccagcctgggcaatgagccaaactccatctcaaaaagaaaaccgtaaataaataaaagactggagctgctctctcctttgcctggtcactatgctgagagttatggctctttgttaaaatactgtgtaaacagggcccctacaccactgccttaagaggcactggaactgaggcctccgccacgtggagggcacagcgcacgccaggaaatctcttccggttttcctcttgttcatctgactttcattttcaggacagtgacagtgtctcgaccaggaactcataagggttgagaaaagaaattatattttctcctctttactagaaaatgtctaaaaatatctctaactccacacttgacattatggcttggcttgaggtaaaatccagacagacaataatttccatctaacaagcaacaagcccacagcctgcaggcgtcctgctgctggttgaggtccagaaaccggaaggaccccagccacttcgtgggggaagcagaagaccacaatgcggggcaaggtcccagcaagggtgaggcagggacccaggcagcactggcccagagcactgaggcccagagcaccaagcggctgctgccaaggctgggccgtagcaggaagctcatgggaagaatccctctgtggccaaacaggtacaagacaggggcctcctcccaggaattgggaacagaaggctgtgcaggtgggatggggtctcactggcttgactctgagcccagaagcatagaaccagagctccacagattcctgccgacccctaaggctcatcccagagcccgcgtgcttggagtcacaggctctgggtgggggcccaatagcagcagatggaccccatgcaacaggggctgcgtctcccagaaggggctctgcggctgtggattaatggctcgcagtcgagaagcttctatacctggaagtgctacagagttattgcaagggtgctttgaggttttaacgtgaacatgctgacttggcactaaataaataaaagcaataaataattatattggaatgctaaggttgctttttatttgaagaggggttttcatccttgaaatggatggaaaacatggctctgggctacaggaagacaaagtggcagcaggatgtgcactgaaccctctttcccctcctcgacctcacaggacgatgctgaaggagcagtacattgacaggacgcgcgtggccgtgtttgggaaggtgagtctgcgccaccctggtctgaaaacccctcagttccagtgtggcctgcaccattacccacgtctaatcctgatttattgagaacgtctgtggtctgctggtgagcaagtaattttttaaaatcaagagcctgggtgcttagtgattccagccgtgggaggtttcatttgatcagctcattttcctaagtttctttttacattatctggaaggaaagagaagggaagccaagtccccgcaggagagctctaatacattcctaatgacttttctcccatccatctgctgtagctcttggcatggtagccaggaaagaagcaaagcaggaatctatttctggataactcgatgtggagtaacaacgttaattaccatgtctacttagacggaagcacaggtgtggggagggtcgcgcagtgaactctcaaaccagagccgctcccatctggtggcccttgtcagaaggctgtagcctgggacagctcagctgtagctgaggcccacggtttggagttaggtctctgcaccgccacctactatggccctggtacatggcccctcattctccttagcctagacctggggcctcttgatctcaagaaggccagcacacagatgggtcggtatagacccatcttccctctgggagtgaccctcagcacaggccctgcagaggaggccttgctgtgacacccccgcaggtgaaggcttggacaagtaatcagcacagtgcctcttacgtcatcgcctccaaaacctcagagcccagcatgcactggagacccggccctgccctgtgggctgctcccggaagcaggggatgcaggagccctcccacacctcctccttacctgccggaggtgaagtggtcaggaggagggccggcggcttctctccttgttcagagcccgggcacagagccctagaggtgcattccaggtgcctagatgtccactcactgcctgtgaggcccgaagccactgggtcattggtaggtgtaacttgggtgtcaatagccatcacctctccccaccctcatggaagtgacttcccagcagactggcagctgaaaggcagggagcctgggccgtggtcagtcttttccagtcgtcactctgccccaaatgcacatggatgccactcctgagggcttggcctccttcctgtgccttgcatatagtccatccactcagggcctttcatagttcacttctggacacagagaggctttctcaacaggcagttggtccagaagcacaggcagccgaggtgccaaagggaaaggggaccctgtgcacctgtcagagcacaactgatgcacccccacaccctgtacccccgcactcagctccgccgaggacatctgtctgagctccgtgctggggatctttcctttgccattctgcccagtggatcccgggcgtctttccagagcataagcatctctgttttgttttaacaagccttagatagaggtccgtagaccccacaatggtatttctcctctgaagaataaagcgtcaatccttttagtggcttggcatgttgcggcctgtccattctgtttcctcctcgcatgtgccccagtgatctggctgcagcctttgtcaggcatcgcaggacctgggacacagagcccaggggagcagcagccaccctgcacccagaggtgacctggagagcaagggggcacctgtgcgttatgttctgcagtttcccccccgacaccgaaaatcccccctgcagaagattgcctgtctctcatttaaaccagagcaggccgcgtggccctgcaggaaaatgagatttaaagaaaacgaagaatgacaagtaaggacgtgtggagttcactgacaataaatattatttgtcagaaaatgaaaatcttctttcattgtcattagacaaggtgcccctgccctattaaaggaacacaccggaacgatcgtgcaggtcataaatggttgatcttggagtttggcatgacctgcgcttcacggtctcagtcaggtacctgggttctctacactccatgctcccaacacgcatgctcacagactcacatacacatggatgctcacccatacacatgctcacacacacatgctcacacattcacacacatgctcacccatacacctgctcacccatacacatgctctcacatacatgtgctcacacatacacacacatgctcacccatacacatgctcacacattcacacacatacacaaatgctcacatacacgctcacacatacacacacatgctcacccacacaatgctcacacattcacacacgctcacccatacacctgctctcacacacatgctcacacatacacacacatgctcacccatacacctgctcacacatacacatggtgtcacacacacgctcatacacacacatgctcacacacacgattacatacacctgctcacacacacacacatgctcacccatacacatgctcacacacacgctcacattcacacacatgctcacccatacacttgttcacacatacacatgctctcacacatgctcagacacatgctcacccatacacatgctcacacacgctcacacattcacacacacctgctcacacatacacatacatgctcacccatacacctgctcacacacacatgctcacccataaacatgctcacacacacacatgctcatacacgtttacccatacacatgctcacacgattacatacacctgctcacacacacacgtgctcacaaattacatacacatgctcacacatacatgctcacaaacacgactacatacacctactcacacacacatgctcacacaattacatacaccgactcacgcacacatgctcacacaattacatacacctgctcacccatacacacatgctcacatgattacacatgctcccacatacatacatgctcacacacattacatacacatgctcacacacgctcacacatacacacgagtacatacacgctgacacatgctcacacacacgattacatacacatgctcacacatacacatgctcacccacacacacgctcacacatacactcacacacacctgctcacacatacccatacatgctcacccatacacatgctcacacacacatgctcacccatacacatgctcacacacatgctcacccatacacatgctcacacacacatgctcatacacgtttacccatacacatgctcacacacgattacatacacctcccacatacacgattacatgcacctgctcacacacacacatgctcacaaattacatacacatgctcacacatacacatacatgctcacaaacatgattacatacacctactcacacacacatgctcacacaattacatacgcctactcacacacacatgctcacacaaattacatacacctgctcatacacacacacatgctcacacgattacatacacatgctcccacatgctcacctatacacatgctcacatacacacgagtacatacacatgctgacacatgctcacacacacgattacatacacatgctcacacacattcacattcacatgttcacgcacacatgctcacatgctcacccatacatacacacgattacatacacatgctcatacatacacgattacatacacatgctcacacaggctcatacacatgctcttacccatacatgctcacacacacacatgctcacacacaagcacacatgatcacacaggcacacatgatcacacatacacaggcttgcacaagtttacacacatactcatacatgctcacacaggcatacacacatgctcacatatgcacacactctcacatgtataggcacacacaggattacacatgctcacacatgtgcttatacacatacacccatgcacatgttcacacgtttatacacacatatcacacacacacacccccatatactcacacacacgctgccacatgctctgtctctcacacatacctgacagttccgtgctgtcccgtttccctcggggtcttcccttcggaggctgcagctcgtctgagcatccagccttgaaggcactgagcaggcaaggaggtagggcttttctctggggaggcctgcgttgcagtacggcttcctcatccccaccaagggcagggaagggcaggagtctaggacttacctgaatacagaacacctgggagcgtctgtctcgtgtcggccttgtgctgagcatgtgcagaccaggacttgcgccctaagccacttgttggcccctccctcagaatcatgtgcagtggcttggcctcacccacagacaagggaggcggtaagaaatgccataaagagacgctgagcctgaaggacagcaccttacacctgtgcagtccacacttgcctttccaattcgccgttgcatttcatcctcacgtcccttgacaccaaggcccagaagcggagaaggcgcacgtcgcataatgctgagttggaagggagtttgcttttcatctcttgttactgccccgtgaacaactttccaagtgacacattttgtaaaaggagagaacctgcatggaactggctgctctggggctgtctccctgcccgaggctgcttcatgctgagttactgccaggactcctaactgtcttctctctgcgctttctccaggattacggtggctacctgagcacctacatcctcccagcaaagggagaaaatcaaggccagacattcacctgcggctctgctctctctccaataacagacttcaaactctatggtaaatagccctgcaggaccaagcgacgggctctgctcccgccccgccccgccccctgcctgcgtggccccacagccctcccttcagcaccaccgtcccgctaaccacaggtgcctccaggccacagtcaccaccttgggctgatggaagaacccggggaaggagagggaagggtctcaggtaatatgttttgaatgaaagtggtcaatccccagatgcctacaaatcacatcccaatgaagaccacgagttggaaacagctagtactccgctggcagcagtgggggcgaggaagccagggtgcgcaggaggggagcaggtgccacaggccctgccgggccgccctccttctctgctcccagaagaatccgagcagggccctgccctgagttctatgcctgggcatgggtatttggtgcacaggtgttaccagataaggaagggatggttgggagggaattgctaccatagagcaattcaacgaggtccacgtggctcagctctgccttcccatctccctggccatgcaaatggcacctggtcagcacctgtcctcagagagtatggctctccatgagcacaaggcagagatggggtcaggctgtcagggtgacctgctgtggggatcagatggagatgagcccacccaggtgtgggaaccagacctctgtccaggcacagaagggctttgctgtgtttgggggttccaggctcctgcattctcctccttatggtcacccaaccctttttctctgaacctgagctctgtgacctgaacccatttcttagaatatacagagaggtcttttctgtggctccgagaacttgaattcaggtcagggctccgtggcagccaggctgttccctccagctgtccccaccctaagcagcgctggcaagtgaggtggaaatggagggggcttcctgctgctggtccaccgcagtcctgccagagcctgacattccctgcaggttggaggaacgagtccagcccccattgccacacctagccctagccctgctgtgctggccgagccctgtagacaccgcccagcaaggcagggaccacggtgggcccagcagcctcctggctggtgcagccaagtctcccaacaccttcacagcgggctcactccagtgcaaattttaactcgtacaggaactctcctggtccaaaatgtgaatcatgtaagaggaatcttccctcaggaatgcgggtgccaccttcaaattgagtgagactttcttaattctttcatcatgctgtttcagatttgtctgattcaaatgcacataaatctgaatcagattgtctgattcaaatgcacacaaaagctgccatcatgtcttgatgggtcactgtgcccaaaaccagccagtcctcttcattgtctcctgggcgccctcaggcttaccctgcaggccaggggcactgtgcagagccctttcggccctcagccctgggagaagcccctgacactcttctgtcacccagctgaccgcagggcctcaggcagaaccaagagcagggatgtgcctggactttttaaaaaataagtaaatcttgatggaaatgtgctctcttaccacccatgcccttcctaagtgttgaaggaggaggttatcctacttatttaggaatcagattaactgggttttgcttaattaaggttctgcgatgctgatgaaaattgcaacaccggcactcacacacattaaggttcccgttgtaccgcctgatgccccttgtaaagacccaaatgatttaggtggtgtttttaaaaaaccaacaatctgccacacaagtggcaagtgggaatgagcctgagtcctcaccccgcacccggtccagggccctccctagagtttgggggctgcgctcacagggcctcgaagccagaggtaacctccctccctttgcttccgtgcagcctctgcgttttccgagaggtacttgggcctccatggacttgacaacagagcatacgaggtgtgtatgggcacaactagagaatgtgatgagaccagtcagcctctgccacagtctcccagcctgccctggctgtatggcccactctgccttccccagccccatgcttctccctcaccagcaccaaagcccactcagaaacctccgaaggatcattccaccagagagtggattgaggttaacatggcctctctgggttccgcctgatttcccattataggacttgagggatgaggaagaaagtaagaggatatttgatggcggagtcagtcccagcgtccatggatacctgatgtgcacaggactcctggctctccctacagccagagctgtgctgctgggggagagtgagctttttttttttttttttttgagatggagtcttgctccattgcccagtctagagtgtagcagcatgatctcggctcactgcaacctctgcctcccaggttcaagcaattctcctgtctcagcctcccaagtagcttggattacaggcacacgctgccacgcccagctaatttttgtattttcagtagagacggggtttcaccgtgttggtcaggctggtctccaacccctgacctcaggtgatccacctgcctcagcctcccaaagtgctgggattacaggtatgagccaccacccctggtccgagagtgagctcttgactgaggagcagaaggcctctctgatgcgacctcctgagtcagacctgttgatttggtgcagctgtcagacacggcatttctccagctgtgcgcagggagggaggccagagctcctggccgaggcagcactgcattttcagagtggaaacttggacaaaggaactgagtccaaccagggagtcagctccctgaggctccaggtgaaatgatggccctctaaggctacctggagttggaggaaactcttcctttttcccttcttctcttccaccccctcctcttccaaaaagggagttaatgtgggggaaagctgggtgtggtatattagtccgttttcatgctgctgataaagacatacctgagactgggcaatttacaaaggaaataggtttagtggagaacttacagttccacatggctggggaagcctcacaatcatgctgaaggcaaggaggagctggtcacatcttacacagatggcagcaggcaaagagaaagcatgtgcagggaaactctgccttataaagtcatcagctctcgtgagatttattcattatcatgagaacagcagcacaggaaagacccacccccatgattcattcatctcccactgggtccctcccacaactcgtgggaattatgggagctacaagatgagatttgggtggggacacagagtcaaaccataccactgggcttctgacatctgccctgcatttctttgcagatataaggcatcccggttctccgggaacttagtgttttcaatacacttcacctaccttctcagtcaggtttccaagcagaacacctggctccctgcagtgcagccccctaactctgtccccttgcccccgcatgtgcagatgaccaaggtagcccatcgagtctccgcgctggaagaacagcagttcctgatcattcatcccactgccgatggtaaggactgaaaacatgaattcactgtgtatctagtaagagcctcctccttgatggcaccatgggttttaacaaatgtcttcctctcttttttttttttttttttgcacagaaaaaattcatttccagcacacagcagaactcattacacaactaattaggggaaaggctaattacagcttacaggtacagtacgcatgttactctgttttgaacctggagcaagacattcctttcatggagaaagacctgacgggtgttcagggccttctactgcagcagacacgcctgtgctgtggtggtcggtgatgagcaaggtcccagcaggttggaaaatcagcacatgctcaacgttttcttataattaatgatagctccgctctgtacttcagcccggtttaaatccctttaggacaaccatctccccgtactcccaccccagccctgctcccctcctccgggcagtgagaagaaccaagccagcacccaccctgcccagcagtgtggctggggctatcccgctgcggagagtgggactgttgttctgggttggtgagagtggtgctggtgggccctgagccttgccccactgcttccctctgaccaacaccacatgttactacgcactagcaggatgtcctggggccatctgtagctaggcagtagtgaaagaggggtacccttcccagaactgaactcactttcccacaaccaacccgtggcccgtccacaacagcatcaagtgctgacccagcagcctcaaacctgggctcttcccagtaatgcacagggatgtctctggaaacttctgccatttccttcctgccttctgctcctttggtggaacaggtatgacccaatggtctcttcaggtccaacatgaatgaatgggagagctccttggggacagatgacaggcaggcaccctgcctccctcagagagctcttgccctgggctgatcactgccttggcctccagcatccctgcctgtgggagggagggaccacctgtgggcttgatcaggcagggagagctccagccagaagggagttggaccccagtgtggatgaagaggggcagaaggacggggttacaccacacttgagttcccttgtgaaagacgttcagatttcagactttttcaaagtaagtgtggcagttgcatggcagtgttaagcacactgaccatggacgctccaaaggtccatgtgtatgtgttcatgtgggcaactccccaagatatggggcgagctgaaccccccaggtacagagcagcctgcatcgctgcaggctccatgggtatcagggagcaggacccacccagggacacacatgtgggcacagcaaaggccttcacagacaccccatgcatctggagccaggcccagccccaggtaagagcacgggagacgggggcctgaggcaggaggagaaagcttcctgcccatatcctcttgtactacttgatgttttaatgacatatcatagcctaatgacagcattaataaatacttcaaaataaagatgaatttcaccctccaaaaacatacaaagaaggcaggaagaggcagtctagtgtcatagaaagatgtaggttttgggccagatgcagtggctcacacctgtagtccctgcactttgggaggctgaggtgcggggattgccttgagctcaggagtttgagaccagcctaggcaacagagcaagaccccatctctacaaaaagtttttagaaaatagccggacgtagtcatgtgtacctgtggtcccagctacacaggaggctgaagtgggagaatcacttgagcccaggaggttgaggctgcagtgagctatggtaacaccatggcattccagcctgggcgacagagtgagaccctgtctgaaaaagaaaagaaaaaaataagatgcaggctttgaatccctgcacgtgcacagatggttcacggtgctcctaggagatggtggcatcaccgcattggcagtagaataattagccatcatcctattggcatctgggaccgaatgagcccacattccaggcctcattctaagcacggcacggctataagattgtttaattctcacaaagtgtcatgagctggagtctgtgattatcctccccacccgacacacctggaatccgaggctcaggcaagttaacctccacagtcacacagggagtagccaggacgcaaaatctgtggggtgggcccgtgggcacccaggacagcacgcagcccttccacgggagtttcccacactcagagtgtaactgagagagcataggagtgtaatggcgcgatctcggctcacagcaacctccgcctcctgggttcaagtgattctcctacctcagcctcccgagtagctgggattacaggcacgccccaccatgcccagctaatttttgtatttttagtagagacacggttttaccgtgttggccaggctggtctcgaactcctgacctcaagtgatcctcccgcctcggcctgccaaagcactgggattacaggcatgaaattctatttcttttcagagcctgacaccctgaaaacttgggctgcggctctgtagtccctaagcttgtatccatgttgcaaattcaagcaagcagatccggactgtagagtgttgaatgaagagcttcccaatgttttcacccagttcccactgagcatttgctgtgcctggagagggccaggcaccgggggcgtggtggtgtttgaaggctggttggcttcacgaatgggtggtgcatgtccacgctaggggaggcgcccctctgactgggacagccaggcagatctcccaggaggaagaggcacttccatcaggagtggcatggttagcaaacccacttcatcaactacaatccagccccggacggggcccaggtttcactaaactccacaccttctgtgcgttcccgtcccctggggagcgtatacctgggagagtaatttctccgtgccttccttgcagatttacccggacgaaagccattactttaccagctccagcctcaaacagcatctgtaccggtccatcatcaacttcttcgtggaatgcttcaggatccaggacaaactgctgacagtcacagcgaaagaggacgaggaggaggactaagctcaggtcgctctaagcacaaacgtggctctttctacaaccagatgcaaccgagggatttccctgccctccctcttccctcggaggggcggggcggggcggggccgggtgttccatagcatgtgtgtctcggatgcggaaggcagttttgcttgggaaacaagctccttccccggggtcatcactcacggcctccatggcaccagggacaacgctgtccccgcagcagcgcctcctcccggcgcccgagagaccggcacgccacggcccctcccccaaggaacagagcaaaggatggtggccgcaggccccacgcgagcccacaggacaccggcccctagattccagccaccaagcggaagcatgagacccgcccacactagcctctgtgttcccgttagggacatcacaccctgtctcacgtcgcagtgccatggacgcagcagttacagcaccattgttttagcagtgcgtgttcatatatgggcttgctacttcctgtaatgaggacgttcaacatggtgaggggctacaagaaaacgcttttctgtacagagtcttactgtagctacgctaatggttaacctgatagaattaactcgtatttttctatggttttaacctgatgctccactgtctccgtcatggggttgttttgctgtttggggttgggccttgtttccctttcctttctccagtccacgtgtagactttgcgcttgatgaagaagcagatcggaagtaactgctccctcctcaaggttgtcttcagacgtcttggggacgttcctaaacactgagggggaagacagccaatagcacccattaaaagaaatacctaaataaaacctctctcccactcagctatgctagggcttggctgtaggtgtgcactgtctatttacatccgtccttacaaccatccttgtcctccttggtaccgtatcaagctctttcccatgacatttggtttaaaaaaaaaaaaaaaaaaaaaaaaaaaacagaaaaaagacaaagcgtcaactccacccacaggcccgctgtgtgtgctcgggccacgggagtcctgagggttctgtgggcctgcgcgcatccctctcccatcgtgggggtggctccgtgaccttcctgccacgagcaggaggttgatgatgtgctacgttagccttgtaagatacacccccaccaaatgtgcagccggtgttcccagtgtatatttcattctcttgtatataaaggaagcaatgtgtgtcaggcctctgtgcagtcaacccagcctcctcccgccagtgctaaccccgtgttgagcctgcatgctgacactgtggccgatctggactctagaagtgctagtttgaaatatatccattactgtcatttccttttgagcttgtggacaagctgaatgtcaggactgacttcgccagctcccagccctgcgggggtgtccttggcatcccatcagcagaggagatgcgtccctgttgcattttggcgtttggggctttgggtttatccacatgagctctgaacgtccgttatagttagggtgattggaaggtctccatcactgggtgttttaaaggtgattcaccaccatttgtgaaaggaccaacgtgctgataaacaggaccgatccgagtgctacatgactgtgcgtttgctatttcaatgggcctgaacgactacaaagccagctaggtctggaaggggaagccagctctggccacgacatctggtcggagggaagtggggatgtggcatggtagcgtctgttcatccatggaataaaacattattttacca

SEQ ID NO: 69 - DNA, 7464 bp, Homo sapiens
acaggtgtgagtcaccgcccgcagccgcacctgcctaaatcccttaatgtataagggaaaggagcgagaattcaggggaaaaaaaacaaacaaaatagcccccagcacttctgagaaagatctgccatacagaaaagccgtcctgagcgggtctgtgtggagggaggggactgcatctcagatccacagtccaccggcggctgcaacaattccacccagggctgcagcacgctggttcttcagtgtcgggccaggttggacctccggctggaggccttccacaccggaaacactggtagggctcctctccagtgtgggttcgagggcggtggaggagctcggcactgtcgctgaagcctggccctggcctcgccgagcggtccggccgctctgtgctgcgaggccttccgggctggctcagggtagcctggggcctgaaccgcctcccgcgagtcccgtcccgcgctcgcacagcttctgggccccatcgccccctcctgctgagctgccggctgggtggctggcggaacctgggcaacttccaggcctcccagaggcactgcaggcactgcgggaaggccggatggaaccagaggctggagactgagtggggggccaggataaaggaagggaggtcggggcaggagtgtggatgggggcagatgttgaaggaaggacccggggctcccacagggccggagcccagaggtgctgtccggggcgactgagctgggtgcgaggctgacgctctccacgctcccacccctgcaggtcttctcccctgggtgcggaaggacgcgctgggagagggaggtcttctcattgacactgtcaccgcagctgcagcagcagaagggacacactctcctgtgtgaattcgctggtggccgatcagcttccaccggtccccaaaaacctgctggtactggggacagacgcagggcttcggccagtgtgtgctccttggtgagccagcagcagagctggccgctaaacccttgccgcactcccgcagacgaatggcttctcccgagtggactcgctggtgcttgatgaggttggagcggccacagcaggtcttgccgcactggggacagcgacaaggtctctcgccagtcgctgtggacccgccagtgctggaggagggatgcgctctgagtaaaacccctcccgcaggccttgcacttgcagggctgacggccctgggtgaatctgccggtgctgcagcaggtaggagctctggctgaaacgctttccacagtcagggcaaaggggaggcttctcatgagcagggcttcggagatgaccgctcagggagtaactgtacgggaggctttgccgcacttggcgcagctgtggggcctctgccgcactcaggcttcccgtggccacgagctcacagtctgggagcagcacccggccccaggcctcgggggctgtctggagagttctctaatgtaagacgctgggcaatgtcatctgaaggtgtttcttgaggctctcgggcatgtccctgggtgttccccatcactaagtccatcctcttggatacgctggtcctcactgccgtgtccagttcctgcggaaggaaagatttcagatcccagagccatcattctctctagagggagagaaaaccacagaaaaattttactacaaactgcaaaggagactttgctttcagaatcctgtaatcaatgcttctttattactattttactttttctttccttcttttttttttttttttttttttttaagacagggtctatttctgttgcccaggctggaatgcagtagtacgatctctgatcactgcaacctttgcctctctggctcaagtgatcctcccgcttcagtctctcaagtagctgggactgtagttgcacaccactaggcccagcatttttttttttttttttggtagaagctggtttttatcatgttgcccaagctgctctcaaactcctgggctcaagcggttggcccacctgggccacccaaagtgctgggattgcaagcatgagctaccatgcccggcctcctataatcaatgtttttttttttttttttttgagagggagtcttgctctgtcacccaggctggagtgcagtggtgctagctatgtcggctcactgcaacctctgccacccgggttcaagcgattctcctgcctcagcctcccgagtagctgggattacaggcgcctgccaccattgccggctaatttttttttgtattttagtagagacaggatttcaccatgttggtcaggctggtctcaaactcctgacctcatgatccacccaccttagcctcccaaagtgctgggattacaggtgtgagccactgcacatggccaatcaatgcttcttaatagtaagatttattttaaaatttggattggggttataagactttcagtagtcttggatattaccatctttatcctgaatgaaagtgtagcaagaggctgggcgcagtggctcatgcctataatcctagcactttgggaggctgaggccagaggatccttgagcccaggagactaacctgggcaacaaagcaagaccctgtctgtattaaaattacaaaagcgtggtaaggatcatttcctcattaaccttgaacatccaaacacaaaccatcaaaaagaatcaacttcagaaagacattattgctttattggttaaggtgattaaaagaagggggcccctcaggccacaaagataattaactgattgtcacaaaccatattgaaactcttttttaaaaagggtatagataacttttaatttacaattttaacaatcaaagtagccaagagtagagtttgcaataggactagaaagtattccagtggctcatatataagtgggctaattttatctatttttaggcctattaggcctgtcagtctggattttccattacttggaaatggggactggggaacagatgcttctggccactctgagccctggcttgatccttgggtctcatctctctctctctccccgtttgtgcttcacctctcagcggatacttggctcttatctcaggacctgacctcccactgagctccaagcctgcaaagcatgctgccacccagttatttcccccttaacatcctgccatcacttcaaatttaatacccctatgccaaaaaatcactgactcctaatttcacttttgttggtggcaccagttttattctcttggacacctaagctcaaaaacagtggaacttcttttgactcatcgctctccttccttccctagaagtgagctaccatttaaaagtgatgtgctcattctcagcaaactatcccaaggacaaaaaaataaacaccgcatgttcccactcataggtgggaattgaacaatgagaacacatggacacaggaagggggacatcacacaccggggcctgttgtggggtggggggaggggggagggatagcattagcagatatacctaatgtaaatgacgagttaatgggtgcagcacaccaacatggcacatgtatacatatgtaacaaacctgcacgttgtgcacatgtaccctagaacttaaaagtataatgatacaaaaaaagtgatgtgctatcatcagtcacccgagaaatgcaaattaaaaccacaaggagtgcccttatgcacccactaaaatcgagcagactgaaggtgctaactgttgcctgaggatatggagtctcacacattgctggggaaatataaaatggcctgggcattttggaaaccagttttggttaacagtaaattaaatgtacacttaccacatgactcaataattctactcttaggatttactcaaggaaaataaaaacatatgtccacacaaagactttttcacaaatgtgcatatcagctttattcataataggcataagatagaaacatccaaatgtccatcaatgggtggaagaataaagtgtggtttacccatgtaacagaatactagcaacaaagaggaactgctgttacctgcaagcaatggatgaatctcaaaattatgttaaaccagagaagccagacacaagagaatacatactatatgattcaatttctgtgaaattccatttctacaaaaagcaaaacttactcataggggcagaaagtagaccagtggttctctggggctgggtcagggagagagcagctgactgcacggggcatgagagggtgacggcaaagttctgcaccctgaatgtgatgatggttatgcccgtgtacacattcaccaaaaaccagcaacctgtacacttaaagtgggtgtgttttatatataacttatacttcagtaagtgtcagcacagataggctaagcctcttctgagatgtaacacaggtagacaggagtatcagtgctgactggccaactatctttaaaatattttattaagctataaataatacggagttgaaatagccaggacttacagtgtacttactacatgccaggtactattctaagagtttccacatattggttagacctcacaacaactctccaagatactaacgattaccccattttatagatgaagaaactgaggcatagaaagtttaagtaatttagaaaagccatatatacggtaaaaaaatttttggctccagggagcttcctctgaactactatgccacaatacttctcattaggacaattttgaaatagacacactccttcctccataatttcatctcctctacaaaaaatattttcacgtttgcatattttattcaggctttgccaacatgcatatgcattttaactactccataatcatagtttagacacagagcaagaggaagccattccaagcaacagacgagtctaattttgctctctgaaaaataagcatttttttaacttatgaacatttctcattcattcacattctttcataatgatctattttaatggctttgtttgaaataccatattatattgtattcatttcctttattattggaatagatcattagtagagataatgctgtaatgagcatcttcatggaatgcacagagcttattttttttccatgtggaatcttttatgtaggaatcattcccaggagcgcagctgctgccccatataagaaagggcctctggcctcgataaagcagcagctcttataccagtatgaatgagctactgtccaatttgctagtgcctgagactggtccagactccagcccattcatggtcttgagggccctaggaagaccacagcaattcccgcagctctcctttgggagtcagggggacctgttaccgaaatcagtccttgtgccaattaaaagtaccacaggctgccagaaatttccatctagttttctactatcactcaacattcttcctgtgactataactcctctcttacattccctgtcatcagccttgcccaggctttcctaatctcttccctagatgagtgtgttttccagttggccttttgtgatttgattcccctctcttccaatggatgatctgacacaagggctgtcaagcatgcttgttactgtagggcagtgcttactgttttcacagcatggaacccacagaaaatgttacaatatgagtaactcacagggataaagggttgagattgctccctactgaaggtgcccggcccagtgcttcgggccaccctaggccctacctaccttcctcaggggttaaagcagtggttctcagtgctagctgcacattaggattacctgggagctttcaaaattattttgcctgtgctgcacccaggagtaacaacatacagccaaggttaagaacctttttagctaaatggttatctgtttatcctcagttaccgccacagcttatccttctactacagtgcctcctgagtaatgggcacaccgtacagtattattattgattattattagtattagagacaggctctccctctatcatccaggctggagtgcagtggcaccatcatggctcactgcagcctcgacctcctgggctcaagcggtcctccctcagcctcctgagtagctgggatcacaggtgtgcaccaccacacctggctaattttttttttttaaataattagtgtagacaggatctcattgttgcctacgctactctccaactcttgggctcaagcgatcctcccgccttggcttcccgaagtgctgggattacagacgtgagccgcagcgcccggcagaatacagaagtaataaactaaggtcaaggccatgtactgaggtgttcaaggctctgaactgctggactcaatgtcacaagataaattttaacctcaccaaaccctctcagcttaagagtatctgctaagttctgagaaagcaaacggggcgtgtgaaaagatgggtgttcatgcctgtgtgtatgtggggtcggtgatgcagttaaggacagaacccaggggaggactccgggacgggggaggcggctgagattttaaggcgggccgggtgtgctgcagccagcactgccggagaatcgctgggaaacggctccagcaggagaatggagggtggacggccggccgcaaaggcggtggaggtgttggcccgccccttccctcctgataacaccgacgtgcgtgtggggtccacggaacgccccaccaagcctcgcctggcgcggggtcgaggggctcggcggaggcgcgtgttcaggtggaggcggtgggcccgggctgcggcccttcgctcgattttatttatttatttatttatttatttatttatttttgagacggagtctcgctgtgttccccaggctggagtgcagtggcgagatctcggctcattgcaacccctgcctcccgggttcaagcgattctcctgcctcagcctcccgagtagctgggaccacaggcgtccgccaccacgcccggctaatttttgcatttttagtagagaagggatttcactatattggccacgctggtctcgaactcctgacctcgtgatccgcccgcctcggcctcccaaagtgctgggattacgggcgtgagccaccgcgcccggccccttcgctcgctcttacccggtgaggtcccgtgcccgcgtacctcccgcatgacacttgggcgtgcggccgagccgggagcgcccctgccccgcgagccgcccccgagagacacggcggatcggaacccagccgggcgcgtagctccgggaaggggacgtggcgaggacccggcagccgcggggcctgtggggaaacatggtccccgcaagggaccctgggagctggaggcgtcctggcccggcgtccggagcccacggcccaggactaggatgccgggggtctcgggcgtcctccctaacctcagtcatagggcgctccgtatccagcccgccctgcttgcctctcgcttcccccaaatactgccccgacctgtcccctggccctcaccaagacagggagaaacgacc

SEQ ID NO: 70 - DNA, 8172 bp, Homo sapiens
tcctctgaccgagcgagggctccccgtctgcggcgcggtcaggaccccgcactttcggcccggctcggggttctcggagtccgtcccaaggccgggccgcaccaccgctggggggcagcgaagcgagcctagaggagaaaaggcggtccccgccgagtgcacgccgggggcggggcacggcacgaaggctccgtggtcggacttctgggctgttcggaggccctggcccacctggagggccctggaagagtttccagcgcttcccgaggtaggcgtgagaagctcgacgcggaccacatctccctcatgcaccgcccgcacgtcccaggatgcgctgcgattaaggtactgccgcgcctcgtgtgcaaggacagacttccggggtcgagaactacaacttccgacttgcatcactgcggtggcgctaaacagcgtcagcgaggcggtgcccgacgatttccctgtcttccagttccgctccctgggatcagcggcgagaagcggggcggagtctgaggcccgagccaagatggcggctgcgaagccaaccctcacggactcgctctcgttctgcctcgcgcagctcgcggcggcggccggggaggctctgggtggggaaaaggacccagcgaccaacgagacacccctgagccgcgcgctcctagccctccgcacgcgccacatcaaggcagcggggggaatcgagcgcttccgggcacgcggcgggctccgccccctactcgcgctgctacggcgagcggctgcagcgggttccgccccgtcccaggcaggccccggctccgccccctcgtcggccgcgtcgggagcttctagccccgcccccgcgtcgggccccgccccctccgctgtgtcgtcgtctagtcctacgccgccagtgcgcctgcgcaagacgctggacttggcgctcagcatcctagccgattgctgtacggaaggggcgtgccggaccgaagtgcgcagactcggaggcatactccctttgggtaagtgctccgcccccgtttcctagaaagattaggtttgcaactcccttgctctctagacccgggcagtctggagttctttgtgtcctatcccggaataacgtgctttgtgatggcgcatcgctcctgtttctcaatctgttgtgccccgtgacgtcactgcactctctatagatgagagagagccctcccagaccagataattgtagccattatctaggaattggttgttgaggacttctttcgaagctggactagcggaggccaaagagttatttggtgattttttcagatgattcttaccgtccagttatgatgttcatagcagacattcagtgcccaactatgtgtccggccctgtgcaaggttctgaagccccactgatgagctggaaggtgtagtggttcagaaagggagatctgcaaaagtcacctaacccctccgaggctaggattccttgtaaaatggggcaataatagctacctaaaaaaatcagagtggggagaaaacgaagtacaaatatggcacgaatatgcaaatattctaagcatgatacgtatttcaagttattaaaaactagcataagctgggtgcagtggtacgcgcctgtagttccagctatttgggaggctgaggcgggaggatcccttgagcctaggaggttgaggctgcagtgaacaatgactgcctgtgaatagccactgcattccagcctgggcaacgtaacaagacctcgtatcttagaaaaccaaacaaatcagtagtcgcttaggaagcaggaaaaaataaataaaaataattaaaaccagcacagtaagaacaaatcctagcaaaacataagcttttctgtttaccagctaaattggtgcctcctagtggcaatgtgtgaaagcagtttacatgtcactacctgccttccacgaaattatgctagttttgatgacatcttaacttttcggataaagggaagcattaatatatttaaaatttacataaaatgtatctggaccatatatgtttgacaagagctttggttattaaataacccccatcattcagctactatttttcatcttaaatatcttctgaatttatctgcttctctctcttcctacttccattgtgtgcccagagactggtatctctgtgctgtgtgatgccagtagctgggttggttcaagctattgtcttttcatgcttggactattatgacagccttttgactccccccttcctattctttccccataatgcattctccctatggatgtcagattgtatcgtgtcactccccttcataaaacccttgtgtggcccccagtgccttcacattcaagtcctgaccccttggcctgacatttgaagcctttcacagacactgtatcttacctctgggcctttggaaaggctgcttccaaacctgaaatgccttctcacacccccatccaccgtgcttctggcaaataccttcctgtgtacccctccagacccagcccgagtgttagcctctttctttttatttttttgagatggagtcttgctctgtcatccaggctggagtgcagtgacacgatctcagcttactgcaacctctgcctcctgggttcaagcaattctcctgccacagcctcccgggtagctgggattacaggcgtgtaccaccatgcccagataatttttgtatttttagtagagatggggtttggccccgttggccaggctggtcttgaactcctgacctcaagtgacccacccaccttggtcccccaaagtgctaggattacaggcttgagccacggtgccctgccgaccattagcctcttctgaaagccttccaggccctctcaggccacattctccaggttattgatgtgagagacagtaaggggtagaaccctcacaagcccaaactgtcgttgcagtgaccattcttcagtgcatgaagacagacagcatccagaaccgaacggcccgtgccctggggaacttagccatggaacctgagagctgtggggacatccactgtgctggtaagaggctgtgaggttggggtctgctagggcttggggcagaagaaaggcttgagtgtctgtccttgttcaccctctgtgctcccctttcctgccctcaggtgctgttcccctgcttgtggagagcctgacagcctgccaggactcgcagtgcctacagagcgtggtgcgtgccctccgtaacctggcagactcaccccagcaccgcctggccttggcacagcagggagcagtgcgtccgctggccgagctcctggccactgccccagatgctgcactgaccttagccctcgtccgtgccctcctggaactcagccgaggctgctcccgggcctgtgctgagcagctaagtctgggtgggggattgggcccactcgtcagcctggcttcccaccccaagcgggcagtacgcgagggaaccattctgatcctcgccaacctgtgtgcccagggcctgattcggcctgcactgggcaatgctggtggcgtggaggtgctggtagatgagctccggcagcgccgggatcctaatggagctagcccaacctcccagcagcccctggtgcgggctgtgtgcctcctatgtcgtgaggccatcaaccgggcccgactgcgggatgctggtggcttggatctactgatgggcctgctgcgggaccctcgtgcaagcgcatggcaccctcgtattgtggctgcccttgtggggtttctgtatgacactggggccctgggccggctgcaggctctgggacttgtgcctctcctggctgggcagctgtgtggtgaggctggtgaggaggaagaagagggaagagaagctgcttcctgggactttcctgaggagaggacccctgagcgggcacagggtggaagcttccggagcctcaggtgagtccctgcctcagggcttgggagggtgagcagtgcagtgatgtggggtttgtgtctgtcttggtcctcttcactacctccacccctattctgtctgaataagacttttataacccagactcctgattcccacacgaccacctgccagttcctatttaacacactccactcccctgagtctacctttttttttttcgagacagagtctcactctgtcacctaggctggaatgcagtggtgccatctccactcactgcaacctctacctccttggttcaagcagttctcctgcctcagcctcccgagtagctgggattacaggtgccggccaccactcccagctaatttttgtatttttaatagagacaaggtttcaccatgttggccagcctggtctcgaactcctgacctcaggtgatccacccgcctcagcctcctaaagtcctgggattacaggcatgagccactgcactggctggatctaccttttaaccttggttccacgccagcacctttgaactttgggccccagacaagttcactgggaggtgggatatacgctggttaagatggtgggctctggagtccaagttcttactctcttaccatcactcatgagctgaagcatcacaggaaagctgaggaactctttatttttttttaaacattagcgttggggatctcgctttgttgcccaggctggtcttgaactcttggcttccagtgaccctcctggctcagcctcccaaagtgtagggattacagatgtgagccaccatgcccagcccccagcgcttcctatttcctttttattttctccatgacccctgtactctacactagccccacactaacataactcatggtactcttacttcttgtctgcttcttctcactggaacataaactccagggggacaggcactttgttcagtgcttctacccagcacctaaagaacggcttggcacgtgacaggcatcagtaattactgaatgaggttttagtcgtatccccctctcacttccgtttctcccctttctccgccctccttctctcccctggctttacctccctccaagacagcttttagctcatgcagtggctcacgcctgtaatcctagcaccttgggaggccaaggcaggaggatcgcttgagcacaggagtccgagaccagcctgggcaacatagcgagacccatctctacaaaacatttaaaaaattagctgagtgtggtgcacacagctgtagtgccagctacttgggaggctgaggtgggaggatcacttgagctcaggagttcaaggctgcagtgagctaggatcccacaactgcattccagcctgggctatagagggataccacatttctttaaaaaaaaaaaaaaaaaaaaaaaagacgcctcacgcctcttggactctgccccttaaccttggctctgggttcagtctccttccctttctgccctccgcaggtcgtggctgatctccgagggctatgccacaggccctgatgacatctcccccgactggtctcctgagcagtgtccgccggagcccatggagccggccagccccgccccgaccccgacctcgctgcgggcaccacgcacccaacgcactccgggccgcagccccgccgccgccatcgaggagccttggggacgcgaagggccagccctgctgctgctgtcgcgcttttcccaggcccctgacccaagtggggcacttgtgaccggcccggcgctgtacggcctgctgacctatgtgaccggcgcaccgggcccgcccagcccacgtgcactgcgcattctgtcacgcctcacctgcaaccctgcctgcctcgaggccttcgtgcgcagctatggcgcggcgctgctgcgggcctggctggtgctgggggtggcgcctgacgattggccggcaccacgtgcccggcccactctccacagccggcaccgagagctgggtgagttcccatacccacccgtctccttgcccccatgtgagtccccatcctcccccatggcttccatgggcccagaacctcaccttcccactcacctgtcctccccagcccgtcctccagacaacctgtcaccagagtggggtggggagcagggcgttccagtccctccatgggcccacaggcagagttctgctgtgtcctctgccctagccctgggacccagataccctaactctagatgcagccccgcgcccaggatctgggctggtctgtgcttctttcctggctctgccattggttcagcactgtcctgactgctccccaccagcacgctgacctgtgaaccccagcctcaccatcacccccagcactgccagggactgccctgtctgctgtgccctgaccacaggctgcttcatggcgttactgctagaccaaggagcccttctgctggccctgtccgggcataacagaaggctcgcactcttgtcttctggtcacacctcactatgtcccctcagctcctatctctgtatggcctggtttttcccaggttatgattatagagcgaggattattacaatattgggataaagagtaattactacaaactaatgattaatgatattcatatatctctaagatctatatctggtataactattcttgttttatattgtattatactggaacagctcgtgtcctccgtctcttgcctcggcgcctgggtggcttgccgcccacacttcaggggcccagacttacaccctgactgtcccaccttctgtccttgtcctggacctcaggttcccagcgtcccgagcccagcactgtctcttcagtgccctgatttctcacccagaggtttcaccctccttcatctcacgggcccagagccctgtctcactcaccccacctgtcttagaccccagttcccagcctgacaagctttccactcacaggggagaggctactgcagaacctgacggttcaggctgagtcgccctttggggttggggccctgacgcacctgctgctctctgggagccctgaggaccgagtggcctgcgcgctgaccctgcccttcatctgccggtgagtgggaagtgggtgccttgcggggttgggggaggagtgctgtgtttcccaggcccgttgcccaccttttgaaaggccctctcttccctgtaggaagccctctctgtggcgccggctgcttctggagcagggtggtctccggctcctccttgcggcgctgacccggccggccccacacccgctcttcctcttctttgccgcggactccctttcctgcctccaagacctggtgtctcccactgtgagcccagctgtcccacaggcagtccccatggacctagactcaccttccccttgcctctatgaacctctgctgggcccagcccctgtcccagctcccgacctgcacttcctgctggactcaggcctccagctccctgcccagcgagcggcctcagccaccgcctcccctttcttccgggccctgctgtcaggcagctttgcagaagcccagatggacctggtgcccctgcgaggtctgtcgcctggtgcagcctggcctgtcctgcatcatttgcatggttgtcgggggtgtggggctgccctggggcccgtgcccccaccaggccagcccctgctgggttcagaggccgaggaggcactggaggctgctggccgtttcctactgcctgggctggaggaggagctggaagaggccgtgggccgcatccacctgggaccccagggtggcccggagtcagtgggtgaggtgttccgcctgggccggccccggctggctgcccactgtgcccgctggacactggggtcagagcagtgcccgaggaagcggggtctggccctggtggggcttgtggaggcagcaggtgaagaggcagggcccctgacggaggctttgctggctgtggtgatggggattgagttgggggcaagggtccctgcctagactgttgacgtcccctgggaaggggacccaaggatgaattggctgtgaaggatcctccctgagactggcaagggaggaggctgagcagaaggagtcatcatggaggagcggtgagaacatggaaccggactccaagatgacgatctaaagacccgggagcgagaagccaaggccaggttctgggtgtagggcccagagaagcagaacagcccagagccccaggtgcctggcctggcctagacctctggaattgagattaaacaatttggagttggata

SEQ ID NO: 71 - DNA, 8172 bp, Homo sapiens; identical to SEQ ID NO: 70

SEQ ID NO: 72 - DNA, 5806 bp, Homo sapiens
ctgttcgccccgcgccaccggcccgcgccccgccatggaggacctgggtgagtggggccggatccccgggtccgtggcccctcaccgctgcccagagctgcctccccgccgtcgctctcccgcatctccccatccctgtcttcttacttctgcttttcgcctctgcccgcgcctcctttccaactccacgtcccccttcctgcctctcccttcctgcctttcctgggccggccgctccctcccttcttccctcgctgtgctcctccatcccaggctgcggcagatggaacgggaggtgcggcgcccgcgggcgcccgggcgcggggctctggggagggaggggttaaaggggcctcggcccggggaccgggaaagtagagggcacgggaaagtctggcatcaagttttggagaaaaaaagcgggcctgcctgcaccagagttttgggagaggaggagttaagggctcctgagcacagtgagggtcaggtccttgaggcaaggaagagaatagtaactcaggagtgcctaggcgcccgcgaaggcttcagggtttcacgcgggtgctcagagacgaagactgagggcaggacttctgggttctggaagtgaaagggctcaaaagacccggatctggggatgcagggatggagagaggtgtcttgtccggaagggggacccaggtatctcgtcctccctgcgaagcctggggctggaaggctgtgcgctccacgggagagaggggcttccggcccctggcggtagagggcgctgctcggtaggggtaactgacgctgtaccgcagataaacagccaatcagaaggcaggtcccagcgaagcgccagtgaggagcccagggcgggactcaggggcctgggagtggccaggctgggcggggcctgtgtaggtagagggaggagttaaccagcatggaagagagagcgtccaatcagaaagctgagggccaggcactgggccaatggagcaatttggaggggagccaaatttggcttgggtgaagagcccattttgactgcatcagagaagatggggagaataaaataatcaggaggctgggtttgtgcttggctccaagcgtgagcaactgggatattctggtcataaatattccttgctacccttcgagcagtgctctgcctggctctggccctgtgacctcttctcttaatactggcttctgtccttctccagtactgcccactgggaaccttatcttctgatctaaccgtgacccttgtctctctccctgatggcctcttcctgcagatgccctgctctctgacctggagactaccacctcgcacatgccaaggtcaggggctcccaaagagcgccctgcggagcctctcacccctcccccatcctatggccaccagccacaggtgagatcggatgttggggactggggcagccactagggccaggctcggcctggtctatggggatctcagcctcagtggggcagagtgcaggcctgtcatcccacctgtgcgtctccgctctgtagacagggtctggggagtcttcaggagcctcgggggacaaggaccacctgtacaggtgaggggcctggaaaccagggcatgggggccaactgagtctcaggtgaggaggcttggattccccacccctgaacccaggctcccactctgcttcccagcacggtatgcaagcctcggtccccaaagcctgcagccccggcggcccctccattctcctcttccagcggtgtcttgggtaccgggctctgtgagctagatcggttgcttcaggaacttaatgccactcagttcaacatcacaggtaccagggtgactgagagaggccttgatgcgataggggcaggggagggaagggtggggcagagactaagaggaatacacttcccagagtagcagttaaagggacctaaagcctcaagtgtgagggtgcgttgagcatggccctatatgtagcgtcctcctctcctctctccagatgaaatcatgtctcagttcccatctagcaaggtggcttcaggagagcagaaggaggaccagtctgaagataagaaaagacccagcctgtgagtttggcgtcgttgtcagggctgagagatgagtcctggatatctgagtcactagagggagcgttgctctgggaggctctgagatgacacaagcatgttcttcacagcccttccagcccgtctcctggcctcccaaaggcttctgccacctcagccactctggagctggatagactgatggcctcactctctgacttccgcgttcaaaaccatgtgagttgggcagtgggccagtgtccatttgtggctccccaaccccttctagacaattccacatctgctgctttgctgactcaattctcatgtcctccccgctgcagcttccagcctctgggccaactcagccaccggtggtgagctccacaaatgagggctccccatccccaccagagccgactggcaagggcagcctagacaccatgctggggctgctgcagtccgacctcagccgccggggtgttcccacccaggccaaaggcctctgtggctcctgcaataaacctattgctgggcaagtaagtggagccttgtgagaagggaggcagagacctgtcacagacccatctttagtgagagctgggctttatgctgttcccttttagtaagttaatctgggaagtgggtatcattattacttatgttttatggatgaggaaactgaagctctgaaccacacagcaggttagtggtagggtgaaaattccaaccatgttaccatttattgtggtcctactgtgtgccaggcactgtgccagctcctttacaaaccctcatctcatctgatcttcacaaaacactctgtggctccacccaatatctctcaggcatctacaaaggctctctcttcctccgtcagagtctggactgggttcactggtccttgttttattgactgagcagatgtgattgacaacagctgtgcctaggggttaacctagtgccccctgctagatcaagtacctgactcccagcccagaattgcccatctcagcaaaggagggtggcattgtgacttttgtggatcataggcactttcatcttcatgagtcccttcgtccattaaaataaatagatttttatgtctgtgttggtgtaaagatgggtatgttattattgtgtattacagcattttcttctagttcatttttttattctgaatttttaaaaacggatttttcacttcctccctcttatttattttgaggcaaattctcactcttgtgacccaagctggagtgcagtggtgcgattgtggctcactgcagcctcgaccttctgggctcaagtgatcctcccagctcagcctcccgagtagctgggactaaaggcgcccgccacctcgcccagctaattttatttatttattgtagagatggggcttcgccatgttgcccaggctggtctcaaactcctggactcaagtaatcctcccacctcagcctcccaaatgctaggattagaggcacgagccacccagcctgatcgtattttgattttaaaaaaattaaaacgtttttatgggcccctaaatgtattgtgggctccaggcgctgtgcctgctgtgcctcatgtataggtcaatcctggagcgcagctggaagacggaacacgggagctagatctccatcgcttacaggctgcgtgatctcgaacactggattctttattctgatcgctcagagaggactcgaaaaacgccgcgtaaatcttgcctcactgggcatgtggttgtcagagccgctctgacccgcctcacctcccactcgcaggtggtgacggctctgggccgcgcctggcaccccgagcacttcgtttgcggaggctgttccaccgccctgggaggcagcagcttcttcgagaaggatggagcccccttctgccccgagtgctactttgagcgcttctcgccaagatgtggcttctgcaaccagcccatccgacacgtgagccccgcccggccgcaccgagcccgccctatctcaccaggagagctgtgggacgggcctccaccgcatgggtcccgccccacccgcgataccccactccacccctaccccttccccttggcaatgtccacggccccttggactccactcttcctttctgacccccacgttcctagttagatcttctccccctccccccacgcatgccttagtccagtcacccgggttccgcgcgggagaggaaggcgcgaaggcacggaggccgcgctgagtgccctctccctccctgcagaagatggtgaccgccttgggcactcactggcacccagagcatttctgctgcgtcagttgcggggagcccttcggagatgagggtgagagtgaactcgactcccatcttaaaagctgcgggtcccctcgacgtctcgccccagcccctccgacctccggagtcctcagggccatggttttccttctgctctcttctggccctgccctctcctacacagactccggacccgagccctccccgctctgtcccgccatagacccggctcctccttccccaaggctccctcggactgcccctccttcggccccagatctcaggtcttgtgggtcccccgtcccgcccgcaccctttgctttcagcccactcggttccctctcctaggtttccacgagcgcgagggccgcccctactgccgccgggacttcctgcagctgttcgccccgcgctgccagggctgccagggccccatcctggataactacatctcggcgctcagcgcgctctggcacccggactgtttcgtctgcagggtgcgagctgcggggcggggcgttggaggggcgggtcaagggtacagggctgtggggcggggccttggaggggcgggtcaagggtgcagggcagggggcgggccctcgggggggcgggtcacgggaggtgctgctaggaacctcgggtggggcgagttttccgggcagggtcccaccggacgggattcttcgcgtctagggcgggctgcggggtcccagggcgttatccgctagtaacgcgcgttgtctggcagtggccgctgacctgtctgtcctctttcgcggcttcccttccccaggaatgcttcgcgcccttctcgggaggcagctttttcgagcacgagggccgcccgttgtgcgagaaccacttccacgcacgacgcggctcgctgtgcgccacgtgtggcctccctgtgaccggccgctgcgtgtcggccctgggtcgccgcttccacccggaccacttcacatgcaccttctgcctgcgcccgctcaccaaggggtccttccaggagcgcgccggcaagccctactgccagccctgcttcctgaagctcttcggctgacagcccgctcggctcgccctctcccccggaggccgcgccctcccggaaaagccgggtcctccagaccccgaggccttgctctcagagcgggaggccccacccactggagagccccgcccctaaggtactatgagtcctcaggggtcaagttcagaaacggcccagccagacctaaacccacacgcccacaaagtggattgcacacagacaagaactcccgtgcgggcctccactctattcccacccttgagggagcccccttactgggggagggtccttgcaattccagcgaatcggaggccaggccaggacgtccttgctccctgcaccctcactgttctgtgcactttttctacctacataaacacacgcattccacctctc

SEQ ID NO: 73 - DNA, 5753 bp, Homo sapiens
ggggccggatccccgggtccgtggcccctcaccgctgcccagagctgcctccccgccgtcgctctcccgcatctccccatccctgtcttcttacttctgcttttcgcctctgcccgcgcctcctttccaactccacgtcccccttcctgcctctcccttcctgcctttcctgggccggccgctccctcccttcttccctcgctgtgctcctccatcccaggctgcggcagatggaacgggaggtgcggcgcccgcgggcgcccgggcgcggggctctggggagggaggggttaaaggggcctcggcccggggaccgggaaagtagagggcacgggaaagtctggcatcaagttttggagaaaaaaagcgggcctgcctgcaccagagttttgggagaggaggagttaagggctcctgagcacagtgagggtcaggtccttgaggcaaggaagagaatagtaactcaggagtgcctaggcgcccgcgaaggcttcagggtttcacgcgggtgctcagagacgaagactgagggcaggacttctgggttctggaagtgaaagggctcaaaagacccggatctggggatgcagggatggagagaggtgtcttgtccggaagggggacccaggtatctcgtcctccctgcgaagcctggggctggaaggctgtgcgctccacgggagagaggggcttccggcccctggcggtagagggcgctgctcggtaggggtaactgacgctgtaccgcagataaacagccaatcagaaggcaggtcccagcgaagcgccagtgaggagcccagggcgggactcaggggcctgggagtggccaggctgggcggggcctgtgtaggtagagggaggagttaaccagcatggaagagagagcgtccaatcagaaagctgagggccaggcactgggccaatggagcaatttggaggggagccaaatttggcttgggtgaagagcccattttgactgcatcagagaagatggggagaataaaataatcaggaggctgggtttgtgcttggctccaagcgtgagcaactgggatattctggtcataaatattccttgctacccttcgagcagtgctctgcctggctctggccctgtgacctcttctcttaatactggcttctgtccttctccagtactgcccactgggaaccttatcttctgatctaaccgtgacccttgtctctctccctgatggcctcttcctgcagatgccctgctctctgacctggagactaccacctcgcacatgccaaggtcaggggctcccaaagagcgccctgcggagcctctcacccctcccccatcctatggccaccagccacaggtgagatcggatgttggggactggggcagccactagggccaggctcggcctggtctatggggatctcagcctcagtggggcagagtgcaggcctgtcatcccacctgtgcgtctccgctctgtagacagggtctggggagtcttcaggagcctcgggggacaaggaccacctgtacaggtgaggggcctggaaaccagggcatgggggccaactgagtctcaggtgaggaggcttggattccccacccctgaacccaggctcccactctgcttcccagcacggtatgcaagcctcggtccccaaagcctgcagccccggcggcccctccattctcctcttccagcggtgtcttgggtaccgggctctgtgagctagatcggttgcttcaggaacttaatgccactcagttcaacatcacaggtaccagggtgactgagagaggccttgatgcgataggggcaggggagggaagggtggggcagagactaagaggaatacacttcccagagtagcagttaaagggacctaaagcctcaagtgtgagggtgcgttgagcatggccctatatgtagcgtcctcctctcctctctccagatgaaatcatgtctcagttcccatctagcaaggtggcttcaggagagcagaaggaggaccagtctgaagataagaaaagacccagcctgtgagtttggcgtcgttgtcagggctgagagatgagtcctggatatctgagtcactagagggagcgttgctctgggaggctctgagatgacacaagcatgttcttcacagcccttccagcccgtctcctggcctcccaaaggcttctgccacctcagccactctggagctggatagactgatggcctcactctctgacttccgcgttcaaaaccatgtgagttgggcagtgggccagtgtccatttgtggctccccaaccccttctagacaattccacatctgctgctttgctgactcaattctcatgtcctccccgctgcagcttccagcctctgggccaactcagccaccggtggtgagctccacaaatgagggctccccatccccaccagagccgactggcaagggcagcctagacaccatgctggggctgctgcagtccgacctcagccgccggggtgttcccacccaggccaaaggcctctgtggctcctgcaataaacctattgctgggcaagtaagtggagccttgtgagaagggaggcagagacctgtcacagacccatctttagtgagagctgggctttatgctgttcccttttagtaagttaatctgggaagtgggtatcattattacttatgttttatggatgaggaaactgaagctctgaaccacacagcaggttagtggtagggtgaaaattccaaccatgttaccatttattgtggtcctactgtgtgccaggcactgtgccagctcctttacaaaccctcatctcatctgatcttcacaaaacactctgtggctccacccaatatctctcaggcatctacaaaggctctctcttcctccgtcagagtctggactgggttcactggtccttgttttattgactgagcagatgtgattgacaacagctgtgcctaggggttaacctagtgccccctgctagatcaagtacctgactcccagcccagaattgcccatctcagcaaaggagggtggcattgtgacttttgtggatcataggcactttcatcttcatgagtcccttcgtccattaaaataaatagatttttatgtctgtgttggtgtaaagatgggtatgttattattgtgtattacagcattttcttctagttcatttttttattctgaatttttaaaaacggatttttcacttcctccctcttatttattttgaggcaaattctcactcttgtgacccaagctggagtgcagtggtgcgattgtggctcactgcagcctcgaccttctgggctcaagtgatcctcccagctcagcctcccgagtagctgggactaaaggcgcccgccacctcgcccagctaattttatttatttattgtagagatggggcttcgccatgttgcccaggctggtctcaaactcctggactcaagtaatcctcccacctcagcctcccaaatgctaggattagaggcacgagccacccagcctgatcgtattttgattttaaaaaaattaaaacgtttttatgggcccctaaatgtattgtgggctccaggcgctgtgcctgctgtgcctcatgtataggtcaatcctggagcgcagctggaagacggaacacgggagctagatctccatcgcttacaggctgcgtgatctcgaacactggattctttattctgatcgctcagagaggactcgaaaaacgccgcgtaaatcttgcctcactgggcatgtggttgtcagagccgctctgacccgcctcacctcccactcgcaggtggtgacggctctgggccgcgcctggcaccccgagcacttcgtttgcggaggctgttccaccgccctgggaggcagcagcttcttcgagaaggatggagcccccttctgccccgagtgctactttgagcgcttctcgccaagatgtggcttctgcaaccagcccatccgacacgtgagccccgcccggccgcaccgagcccgccctatctcaccaggagagctgtgggacgggcctccaccgcatgggtcccgccccacccgcgataccccactccacccctaccccttccccttggcaatgtccacggccccttggactccactcttcctttctgacccccacgttcctagttagatcttctccccctccccccacgcatgccttagtccagtcacccgggttccgcgcgggagaggaaggcgcgaaggcacggaggccgcgctgagtgccctctccctccctgcagaagatggtgaccgccttgggcactcactggcacccagagcatttctgctgcgtcagttgcggggagcccttcggagatgagggtgagagtgaactcgactcccatcttaaaagctgcgggtcccctcgacgtctcgccccagcccctccgacctccggagtcctcagggccatggttttccttctgctctcttctggccctgccctctcctacacagactccggacccgagccctccccgctctgtcccgccatagacccggctcctccttccccaaggctccctcggactgcccctccttcggccccagatctcaggtcttgtgggtcccccgtcccgcccgcaccctttgctttcagcccactcggttccctctcctaggtttccacgagcgcgagggccgcccctactgccgccgggacttcctgcagctgttcgccccgcgctgccagggctgccagggccccatcctggataactacatctcggcgctcagcgcgctctggcacccggactgtttcgtctgcagggtgcgagctgcggggcggggcgttggaggggcgggtcaagggtacagggctgtggggcggggccttggaggggcgggtcaagggtgcagggcagggggcgggccctcgggggggcgggtcacgggaggtgctgctaggaacctcgggtggggcgagttttccgggcagggtcccaccggacgggattcttcgcgtctagggcgggctgcggggtcccagggcgttatccgctagtaacgcgcgttgtctggcagtggccgctgacctgtctgtcctctttcgcggcttcccttccccaggaatgcttcgcgcccttctcgggaggcagctttttcgagcacgagggccgcccgttgtgcgagaaccacttccacgcacgacgcggctcgctgtgcgccacgtgtggcctccctgtgaccggccgctgcgtgtcggccctgggtcgccgcttccacccggaccacttcacatgcaccttctgcctgcgcccgctcaccaaggggtccttccaggagcgcgccggcaagccctactgccagccctgcttcctgaagctcttcggctgacagcccgctcggctcgccctctcccccggaggccgcgccctcccggaaaagccgggtcctccagaccccgaggccttgctctcagagcgggaggccccacccactggagagccccgcccctaaggtactatgagtcctcaggggtcaagttcagaaacggcccagccagacctaaacccacacgcccacaaagtggattgcacacagacaagaactcccgtgcgggcctccactctattcccacccttgagggagcccccttactgggggagggtccttgcaattccagcgaatcggaggccaggccaggacgtccttgctccctgcaccctcactgttctgtgcactttttctacctacataaacacacgcattccacctctc

SEQ ID NO: 74 - DNA, 4756 bp, Homo sapiens
ggagaataaaataatcaggaggctgggtttgtgcttggctccaagcgtgagcaactgggatattctggtcataaatattccttgctacccttcgagcagtgctctgcctggctctggccctgtgacctcttctcttaatactggcttctgtccttctccagtactgcccactgggaaccttatcttctgatctaaccgtgacccttgtctctctccctgatggcctcttcctgcagatgccctgctctctgacctggagactaccacctcgcacatgccaaggtcaggggctcccaaagagcgccctgcggagcctctcacccctcccccatcctatggccaccagccacaggtgagatcggatgttggggactggggcagccactagggccaggctcggcctggtctatggggatctcagcctcagtggggcagagtgcaggcctgtcatcccacctgtgcgtctccgctctgtagacagggtctggggagtcttcaggagcctcgggggacaaggaccacctgtacaggtgaggggcctggaaaccagggcatgggggccaactgagtctcaggtgaggaggcttggattccccacccctgaacccaggctcccactctgcttcccagcacggtatgcaagcctcggtccccaaagcctgcagccccggcggcccctccattctcctcttccagcggtgtcttgggtaccgggctctgtgagctagatcggttgcttcaggaacttaatgccactcagttcaacatcacaggtaccagggtgactgagagaggccttgatgcgataggggcaggggagggaagggtggggcagagactaagaggaatacacttcccagagtagcagttaaagggacctaaagcctcaagtgtgagggtgcgttgagcatggccctatatgtagcgtcctcctctcctctctccagatgaaatcatgtctcagttcccatctagcaaggtggcttcaggagagcagaaggaggaccagtctgaagataagaaaagacccagcctgtgagtttggcgtcgttgtcagggctgagagatgagtcctggatatctgagtcactagagggagcgttgctctgggaggctctgagatgacacaagcatgttcttcacagcccttccagcccgtctcctggcctcccaaaggcttctgccacctcagccactctggagctggatagactgatggcctcactctctgacttccgcgttcaaaaccatgtgagttgggcagtgggccagtgtccatttgtggctccccaaccccttctagacaattccacatctgctgctttgctgactcaattctcatgtcctccccgctgcagcttccagcctctgggccaactcagccaccggtggtgagctccacaaatgagggctccccatccccaccagagccgactggcaagggcagcctagacaccatgctggggctgctgcagtccgacctcagccgccggggtgttcccacccaggccaaaggcctctgtggctcctgcaataaacctattgctgggcaagtaagtggagccttgtgagaagggaggcagagacctgtcacagacccatctttagtgagagctgggctttatgctgttcccttttagtaagttaatctgggaagtgggtatcattattacttatgttttatggatgaggaaactgaagctctgaaccacacagcaggttagtggtagggtgaaaattccaaccatgttaccatttattgtggtcctactgtgtgccaggcactgtgccagctcctttacaaaccctcatctcatctgatcttcacaaaacactctgtggctccacccaatatctctcaggcatctacaaaggctctctcttcctccgtcagagtctggactgggttcactggtccttgttttattgactgagcagatgtgattgacaacagctgtgcctaggggttaacctagtgccccctgctagatcaagtacctgactcccagcccagaattgcccatctcagcaaaggagggtggcattgtgacttttgtggatcataggcactttcatcttcatgagtcccttcgtccattaaaataaatagatttttatgtctgtgttggtgtaaagatgggtatgttattattgtgtattacagcattttcttctagttcatttttttattctgaatttttaaaaacggatttttcacttcctccctcttatttattttgaggcaaattctcactcttgtgacccaagctggagtgcagtggtgcgattgtggctcactgcagcctcgaccttctgggctcaagtgatcctcccagctcagcctcccgagtagctgggactaaaggcgcccgccacctcgcccagctaattttatttatttattgtagagatggggcttcgccatgttgcccaggctggtctcaaactcctggactcaagtaatcctcccacctcagcctcccaaatgctaggattagaggcacgagccacccagcctgatcgtattttgattttaaaaaaattaaaacgtttttatgggcccctaaatgtattgtgggctccaggcgctgtgcctgctgtgcctcatgtataggtcaatcctggagcgcagctggaagacggaacacgggagctagatctccatcgcttacaggctgcgtgatctcgaacactggattctttattctgatcgctcagagaggactcgaaaaacgccgcgtaaatcttgcctcactgggcatgtggttgtcagagccgctctgacccgcctcacctcccactcgcaggtggtgacggctctgggccgcgcctggcaccccgagcacttcgtttgcggaggctgttccaccgccctgggaggcagcagcttcttcgagaaggatggagcccccttctgccccgagtgctactttgagcgcttctcgccaagatgtggcttctgcaaccagcccatccgacacgtgagccccgcccggccgcaccgagcccgccctatctcaccaggagagctgtgggacgggcctccaccgcatgggtcccgccccacccgcgataccccactccacccctaccccttccccttggcaatgtccacggccccttggactccactcttcctttctgacccccacgttcctagttagatcttctccccctccccccacgcatgccttagtccagtcacccgggttccgcgcgggagaggaaggcgcgaaggcacggaggccgcgctgagtgccctctccctccctgcagaagatggtgaccgccttgggcactcactggcacccagagcatttctgctgcgtcagttgcggggagcccttcggagatgagggtgagagtgaactcgactcccatcttaaaagctgcgggtcccctcgacgtctcgccccagcccctccgacctccggagtcctcagggccatggttttccttctgctctcttctggccctgccctctcctacacagactccggacccgagccctccccgctctgtcccgccatagacccggctcctccttccccaaggctccctcggactgcccctccttcggccccagatctcaggtcttgtgggtcccccgtcccgcccgcaccctttgctttcagcccactcggttccctctcctaggtttccacgagcgcgagggccgcccctactgccgccgggacttcctgcagctgttcgccccgcgctgccagggctgccagggccccatcctggataactacatctcggcgctcagcgcgctctggcacccggactgtttcgtctgcagggtgcgagctgcggggcggggcgttggaggggcgggtcaagggtacagggctgtggggcggggccttggaggggcgggtcaagggtgcagggcagggggcgggccctcgggggggcgggtcacgggaggtgctgctaggaacctcgggtggggcgagttttccgggcagggtcccaccggacgggattcttcgcgtctagggcgggctgcggggtcccagggcgttatccgctagtaacgcgcgttgtctggcagtggccgctgacctgtctgtcctctttcgcggcttcccttccccaggaatgcttcgcgcccttctcgggaggcagctttttcgagcacgagggccgcccgttgtgcgagaaccacttccacgcacgacgcggctcgctgtgcgccacgtgtggcctccctgtgaccggccgctgcgtgtcggccctgggtcgccgcttccacccggaccacttcacatgcaccttctgcctgcgcccgctcaccaaggggtccttccaggagcgcgccggcaagccctactgccagccctgcttcctgaagctcttcggctgacagcccgctcggctcgccctctcccccggaggccgcgccctcccggaaaagccgggtcctccagaccccgaggccttgctctcagagcgggaggccccacccactggagagccccgcccctaaggtactatgagtcctcaggggtcaagttcagaaacggcccagccagacctaaacccacacgcccacaaagtggattgcacacagacaagaactcccgtgcgggcctccactctattcccacccttgagggagcccccttactgggggagggtccttgcaattccagcgaatcggaggccaggccaggacgtccttgctccctgcaccctcactgttctgtgcactttttctacctacataaacacacgcattccacctctc

SEQ ID NO: 75 - DNA, 7653 bp, Homo sapiens
ggggcagatcctggggagaatggaggagcacacagaggcaggctcggcaccagagatgggggcccagaaggccctgattgacaatcctgctgacatcctagtcattgctgcatatttcctgctggtcattggcgttggcttgtgggtgagaagttggggggtgtgctgctggtggctgctggctttgggggcctgggggaaaagtctcagggggaccctaggtgggagaatgatgcttggatctttgaaggagaaacctaggcctgggggcaagcaggtctttggaagttctcagggagacccagccaacattcctcccttgtcttcccactttgggactgtgctagctgaaggggtccgcggattttcatcagggtcgacattctaaatggggtctcattcccctggccacattgtggctgaccagcagaaaatattcaaggtccccaggaaggtcaagccaaatccacaaatgataaatcctggggagttgggatggaactagtggctcacacctgtaatcccagcactttgggaggccaaggcagggggatcactgaggccaggagtttgagaccagactggcccacatggtgaaaccgtatctcttttttatttaaaaaatttattttaaaaattatttacttttaaagagagaggggtctcaccatgttgcccaggctagtcttgaactcttaggctcaagcaatccttctgcctctgcctcccaaagtgctgggattacagatgtgagccactgtgcctggatgagaccttgtttcttaaaaagaaaaaagaaaaaaaaagaaagaaaggaaaaattagtcaggcatggtggtgtgtgtgcctgtagtcacaactactcggaggccaaggtgggaagattgcttgagcccaggagttcaaggctgcagtgagctatgatcatgtcactgcactccagcctaggagacagagcgagaccttgtctctaaaaagaaagacagatgtggggctgggtgcggtggttcatgcctcagtactttgggaggctgaggcaggtgaattgcttgaagccaggagttcaaggccagcctggccaacatggtgaaaccctgtctctactaaaatacacacacacacacacacacacacacacacgcacacacacacaaaaagctgggtatagtggcgtgtgcctataatcccagctactttggaggctgaggcatgagaattgcttgaacctgggaggtggaggttgtagtgagccaaaatcacaccactgcactccagcctgggcaacaagagcaagactctgtctcaaaaaatgagaaaaaaaaaaaaagaaagaaaaagaaaaaatatgtgaaaaaaactgggggaataggacactgggattagagcctgggttgccctgagtgtctgggaggagttgggggtgggagtgcaaacgatcagggaaacttggctcgttaatcttcagccagaaacaaggctgaggaatgtgttgaggtggctgatgaggtccaaggctgtgccctaaacccaggtctcccccgcctctgtctcccagtccatgtgcagaaccaacagaggcactgtgggcggctacttcctggcaggacgcagcatggtgtggtggccggtgagacgggctgggccgggaacgggaggggcctggagaagcagccctgctcactccctcctctggccacccaggttggggcctctctcttcgccagcaacatcggcagtggccactttgtgggcctggcagggactggcgctgcaagtggcttggctgttgctggattcgagtggaatgtgaggccctcttttttccaataaccccaccctcagtgagaacacctggaagggtcacaccttggggaaactccaggaaagggggaatgagactggcagtgggacttcccaactgcggggtgtgactgggctgggagtggaggtcatacatctagccaggaagcagaggggtgcaggggtgaccactgttggtcctgcttctgacttgccatgtgagccagcctgcaccagccactgcctctgggagcttccatttattcctctctgagtggggtgagcagcctcaaagccagggaagcacctgctcagatgcgctccgaagctgtggtctgtgaggaatttggggccaagttaaagccctttgcagaagagaggagcagagacaaagctctgggactgaggctcctgttggaggggagattgggctttgagctcagggcttcctggaggaggagactgctgagctgatccttgagggacacaaggtttgggtggctttggctcaggtcagtctgaggggtctatgctggggttcatatctagatgatcatagggacaacattgggaaaaacgggccagaagtgatagcctggggagacaaggagggctccagttaagagcccaggagggtgtcagctctgttccttggtgcccagggccccggggccatcacctgcagttgtcctctgggccccagatgtggcccttcccagggccacttgcttggagtagcaccttcacgaagaggtcagatcctcagggatgagggcaaagccaccctcagcggcagtactgccccccgtaggcgctcttcgtggtgctgctactgggctggctgtttgcacccgtgtacctgacagcgggggtcatcacgatgccacagtacctgcgcaagcgcttcggcggccgccgcatccgcctctacctgtctgtgctctcccttttcctgtacatcttcaccaagatctcagtgagtgcctgtggcagatgcgattgggccctagaagggtggggctcaagtggggtctctagagaaccctagagggcgtgagacctaggagaaaccactgcgagggttatgatgatggaggcagagcctgcaatgaatgtctccggggcaccagctacagtgctgggacctggaaaaatggagggaagctttgaggctagtagggcatggcctgggcaggaggtgggctggggacactgccctgggtcctgacctggcacttgcttctcccccaaggtggacatgttctccggagctgtattcatccagcaggctctgggctggaacatctatgcctccgtcatcgcgcttctgggcatcaccatgatttacacggtgacaggtgccagcaggggcttaggaaagggagtgggcctgggacactgctgccagctgtggccagggtttagggagctgccagaggaaagcaagctggagaggtctggaagggtggtgtggtccaagcaggagaaggaactaaatctttggagagcaaaggcttcctctctttccactgtctcttggattttgactggaagttcagagagaaagccatgctgggcttgagtgaggactttgagaaaaggaagatttagcagctcttgcctgccttgaacacctgggagagcacacctgacgagtctccaagatctctggcaaaacccagtatggttcatagggacctggggtggggcctgaggtcagatgcggaccagagtaggcagggcttggtgccaaggcccgcttgagggacccacctccagaaggaacggaactgagtataggaccttagacaatcatcctctcctacgatgacgcagaaaaaactggggccggctgggagcggctcacgcctgtaatcccagcactttgggaggccaaggcgggcggatcacgcggtcaggagtttgagaccagcctggccaacatggtgaaaccccgtctctactaaagatacaaaaaattagctggacgtggtggcccgcccctgtaatcccagctactcgggaggctgaggcaggagaattgcttgaaccgggcaggcggaagttgcagtgagctgagatccaccattgcactccagcctgggcgacagggcaagactccatctcaaaaacaaaaacaaaaacaaacaaaactggggcctagagggggctgctagtgggggtcctgcaagtaggcgcctggccctaaaactcagccacactctgcccgccaagccctgcttgttggtgcctgcgtgcatgagccccgagaacaggctatcgttttgaaatttattctccaggaaggggaactctttcaaattcccacaaagacgccttattgctaaggccagcctgtaacataaacagctgggctgtcccctgaccccggcctgttgcaggagggctggccgcgctgatgtacacggacacggtacagaccttcgtcattctggggggcgcctgcatcctcatgggttacggtaggggctcgcctaccagggaggggcgcggagggcatggtcgcggagctctcggcctgcgcgcggggccgttgcgcgtctccggtctgagggtcctaaggagggtcccctgacggccttgcccggcagccttccacgaggtgggcgggtattcgggtctcttcgacaaatacctgggagcagcgacttcgctgacggtgtccgaggatccagccgtgggaaacatctccagcttctgctatcgaccccggcccgactcctaccacctgctccggcaccccgtgaccggggatctgccgtggcccgcgctgctcctcggactcacaatcgtctcgggctggtactggtgcagcgaccaggtgcgggtatagggctgcgcctgcagtgaggccggggcggagccgagacgggcggagcctgagtccctccccgccttccccacaacggtctaaggcgcagtctgaggggcgggaacccctcgggttggtgctaaaccagacagaaggctccatctactccaagcgtgcagctgaacttggggcactcacgagccagaggcggggcacagagcggaacggggcgcggggcggggccgaggggaggcccgcaagcgggcagctgaacgcccctcccgtaggtcatcgtgcagcgctgcctggccgggaagagcctgacccacatcaaggcgggctgcatcctgtgtgggtacctgaagctgacgcccatgtttctcatggtcatgccaggcatgatcagccgcattctgtacccaggtaacatccctgccccgcccctttcctgtgccagcaaccgggcgcccgtcgcccagttccgtcaccctcctaagactcggcagtttgggcccggagtcccgcctccctccgggggtcgcacgcctcctctgctaggattcccagtccccacctcctgggattcccagaccaggccccgtcctaacggcgcggtggcctctctctggcagacgaggtggcgtgcgtggtgcctgaggtgtgcaggcgcgtgtgcggcacggaggtgggctgctccaacatcgcctacccgcggctcgtcgtgaagctcatgcccaacggtaagggcagccccgggccacaggcgcaagctcgctgcggagcccgctgctgggaggggtcgtccctcgcgcagctgcagccgccctggacccccagtggccccagcctcacggctgccgtcggcccgcaggtctgcgcggactcatgctggcggtcatgctggccgcgctcatgtcctcgctggcctccatcttcaacagcagcagcacgctcttcaccatggacatctacacgcgcctgcggccacgcgccggcgaccgcgagctgctgctggtgggacggtgcggcctgggctcccctcctccccaacggatcagcccggggcgggggcttgcgcacctgcaggggagcccagggtccgggttcgatccgacggcctccgccgcaggctctgggtggtgttcatcgtggtagtgtcggtggcctggcttcccgtggtgcaggcggcacagggcgggcagctcttcgattacatccaggcagtctctagctacctggcaccgcccgtgtccgccgtcttcgtgctggcgctcttcgtgccgcgcgttaatgagcaggtgagcggcacgcgcgtggtgacggcagggctgggcttgcacatcctcagcaggctgacctgtttccttcgcagggcgccttctggggactcatcgggggcctgctgatgggcctggcacgcctgattcccgagttctccttcggctcgggcagctgtgtgcagccctcggcgtgcccagctttcctctgcggcgtgcactacctctacttcgccattgtgctgttcttctgctctggcctcctcaccctcacggtctccctgtgcaccgcgcccatccccagaaagcacgtgagtggccaggtgccccaggcaagcactgtgggacacagcacctaccctctgcttcctggagtgcccagctgggaggacctgaatttctcgactgagggttgggaatgggctgggggtccagctgcagttgcaattgccgagcaagaatttttatttaaatacatttatttgaaccggcctgggggaggcttgatgttgatgggttggtgattaaagcctcccaaagccaatccttggcatggcctttgggactcaaaacacaggatctgactggtgggcacaataccatcttgaacgcccacaaaaaggtttggttttgttgccaaagggcaggtggctccaggcagggctgatggtggcagggtggggtgaggacaggacaagagatctgggtgtggaaggatggccgggtttctgcagcagcaggaggaaagggtgggagcacacaggcacagaacactgtgagcaggactgccaggccagtgtcacaagcgctaccatctgggtgtagacagacctgagctgacaaagctgggggagcaaggccaacggctttaaacacaagctcaggggcttggggtttatcccgagggcacagggcagccatgtagggtggagttggcatgagttaagcctgggctgggtgtgtagactggacagaggtgggtagggcaggcagtgacgagctggtgtgcaagagactttagggccaggcatggggggacagaactcccacctcgttcgtgctcccaccctccccagctccaccgcctggtcttcagtctccggcatagcaaggaggaacgggaggacctggatgctgatgagcagcaaggctcctcactccctgtacagaatgggtgcccagagagtgccatggagatgaatggtagggcaccatgctgggaggtggggctggaggagctgagttcccgcaaactaactgcagggcctcaatttccctcagagccccaggccccggcaccaagcctcttccgccagtgcctgctctggttttgtggaatgagcagaggtggggtgggcagtcctccgccccttacccaggaggaggcagcggcagcagccaggcggctggaggacatcagcgaggacccgagctgggcccgtgtggtcaacctcaatgccctgctcatgatggcagtggccgtgttcctctggggcttctatgcctaagaccaactgcgttggacaccataagccacagcctcacaggaagtgggggtgaggagcctgcggtgctccccagaaaaggggaaggggcagtggggtgagaaggtcctggctccccttctcccggccttcctctgcctggggcccactgcatctgattggcagtcacttcccatgagggcctggcccacccgctgcagttgccctaaggaaaaataaagctgcctttcccctgtcc

SEQ ID NO: 76 - DNA, 18945 bp, Homo sapiens
ttgccgagcaagaatttttatttaaatacatttatttgaaccggcctgggggaggcttgatgttgatgggttggtgattaaagcctcccaaagccaatccttggcatggcctttgggactcaaaacacaggatctgactggtgggcacaataccatcttgaacgcccacaaaaaggtttggttttgttgccaaagggcaggtggctccaggcagggctgatggtggcagggtggggtgaggacaggacaagagatctgggtgtggaaggatggccgggtttctgcagcagcaggaggaaagggtgggagcacacaggcacagaacactgtgagcaggactgccaggccagtgtcacaagcgctaccatctgggtgtagacagacctgagctgacaaagctgggggagcaaggccaacggctttaaacacaagctcaggggcttggggtttatcccgagggcacagggcagccatgtagggtggagttggcatgagttaagcctgggctgggtgtgtagactggacagaggtgggtagggcaggcagtgacgagctggtgtgcaagagactttagggccaggcatggggggacagaactcccacctcgttcgtgctcccaccctccccagctccaccgcctggtcttcagtctccggcatagcaaggaggaacgggaggacctggatgctgatgagcagcaaggctcctcactccctgtacagaatgggtgcccagagagtgccatggagatgaatggtagggcaccatgctgggaggtggggctggaggagctgagttcccgcaaactaactgcagggcctcaatttccctcagagccccaggccccggcaccaagcctcttccgccagtgcctgctctggttttgtggaatgagcagaggtggggtgggcagtcctccgccccttacccaggaggaggcagcggcagcagccaggcggctggaggacatcagcgaggacccgagctgggcccgtgtggtcaacctcaatgccctgctcatgatggcagtggccgtgttcctctggggcttctatgcctaagaccaactgcgttggacaccataagccacagcctcacaggaagtgggggtgaggagcctgcggtgctccccagaaaaggggaaggggcagtggggtgagaaggtcctggctccccttctcccggccttcctctgcctggggcccactgcatctgattggcagtcacttcccatgagggcctggcccacccgctgcagttgccctaaggaaaaataaagctgcctttcccctgtcctgctgtggccaaagtgtccttgctccaggttcctgccctgggcttgggcctccgtctgggctgctcacaagaccttcttttcgggagacagaagccatgtggccctccactcatccacctctagctggtgcttctcggtcttccagccggcatcctgcagtcctggggagagatcatggggtgctgccgggaatgctggggacaagggtaaggagaggcacaggctgggtgcaggctttgtgcactactggggctcccactgcctctgctgggtgagtatggcataaaatgaggctgaaaccacacctggctgcagcaagaattcgttgaaatggcacacagaagagcgctgggatggaacaggcgccagacaaaacgtcctcatcagccaatgtgagggcctccctgctccatcctcccatttcctacatgccaactgggattacacagactgtctacactgataccacttcaaagaccattctaagctctccgtcctataaacagggaaactgagtaactgagtcccaaacttaggattgcagagagaatccatcttttttttttttttgagatggggtctctgtcacccaggctggggtacagtgacacaatctggactcactgcaacctctgcctcctaggctcaagtgatcctcccatctcagcctcctgacagtcccacaggcgtgcatcaccatgcacagctaatttttttatatttttggtagagacagggtttcaccatgttgcccaggctggccttgaactcctgagctcaagtatctgcccgccttggcctcccaaagtgctgggattacaggtgtgagccactgtgcccgacagtcttttttttttttttttttttgagagagggtcttgctctgtcacccaggctggtacaatcatggctcactgtagcctcgacctcccccagttcaggtgatcctcccacctcagcctcctgagtagctgcaaccacaagagcagaaccacacctggctaatttttgtgttttttttgtacagacaaggatttgccatgttgcccaggcagggtctcaagcaatctgcccacttaggcctcccaaggcactagaatcataggtgtgagcctctgcaccaggcccaagaacccaagtcttttacctttcaggtgaaagggtgggagtgggggaaggcggggcccccagggacaaggcttcaggggccaagcagccatgggctgagggatgttacctttcaagaactttgggaacagcatgtccaacacttcgtgtgtctccttgacgacgacccagctctctttcttaggacctgggtacgggggtgcagaaccagaagctctgtgtcctccagcaggacagagtttgtcctctctcctccccaccctgaggcatcagcagtctaaatcttgaggcacttacctgcccgcacccggttcctcagctcctccagctctgctggaaggggtccatctccctgcagggccccaagcatcagcccatgtgtggcggcccttaggatggtcttggggcctgccttctggttcagaactacctgtacctggtctggagggacccagagacagactggtatcagggaagggccacctcccaaaccccttctatcccatcaccctgcttcccctgtctgccccaagaccttggcctggcacggaaggctagcacctcaccctttcctttccaattcatctcctgttgctccccaatgttcgggccaaactgaccaatttccaaatacaatttcccagccgctcactgggctgggtctattttgcatttctttaatggctagtgagaataagcaccttttcacactcaaccagcggaccagcacactcaaggacttgtttacccaagaggcaacccaggatggagagaagggtggtttcccacggacagcaaaggtcatagccttcctaagagtgctgcaatgtagctttgcagtcacattatttgatcctcataaaaacaccgcaaggaataaggcaggtactgttagctctgttttacaaagcggtgacatgaatttcactggggcattgcagctgtaatttgaacggtctagagcaacccccagaacaggcagcctccaaactgcccagagctcggggccctaggttggaggaatgagaggctgacctgggagggtgcgtcttaggctgggagaatgaggcacactcactttgtgactggtcccagcagaggaggtaggattcttggtgcccctcaaccagctgctgcagctcaaagacactgtgggggagaggacagtgcagtgggggtggaggacagcaaaggcaggcatgcccaaccagccactgaacagccacccagtgaactgaaatgatccaggcttcactcaggtcccctcgcttcctctctccctcagccattacccatacacaccaaatccatcctttcttcctgtatccagtcatccaacttccccatctacccatccttccttcacccatcaagcacatctcttacatctgcttcatgttatacaccctttccttcctcacacacccacaccaaccccatgtctgttcagcagcaatgaagaacccaggacagagaggtggggccttgccagggaggccagtgtgtaatcggagtgaggggagtgtgggtggcggtggtgacgagcgggagacgctaggccactcacctggagaccaagcggtgtaaggggacccccagggatagagacggagctggccagaaacctgtgggaagctggggtcaggatgcctaggcagtgggagaggttgagacacaggacccgagaccaggggcagggtcacctgtccacagcggctccatgcgattggctgcagttgggtcgagtacctctcccctctgaaggtagtgcttcaggaccagccggagccggccttcgttcaaggtctccatgaccagggctcggaccgcgcggtagttggcgtagatgtggagggcagtgaggaagaagaaacatccaaggctgaagctggggtgagagagtgaggtagctgaagtgggcagaggcccagctggggttctcctgcccaccctgcttccggcttacccagggcaacctgacaccagagggagcatcaggaggctgaccaagagccccgccaggttcaccagcgtctcctggaaaatggcagagggagaaggagttggaaggtgcccctccaggccagactgagtgcccgagtgcctttcacctcatcctccctgctccacaacctcccagggctccttactgcaatgtgggtaaatttttagtttttggtgggtgaaatgtcatttaaaagatgccagctcgaggtggctcacacctgtagtaccagcactttgggaggctgaggtgggcagatcacttgagtccaggagcttgagaccagcttgggcaacatagtgggaccctatttctacaaaaaaattaaaaatttggtggggcatagtggctcgcgcctgtaatcctagcaatctgggaggccgaggtgggcagattccctgagctcaggagttcaagaccagcttcggcaacacggtgagacccattgcatttttgtaaaaatacaaaaaactagccaggtatggtggcgcgtgcctctactcccagctactcaggaggctgaactgcttgagcctgggaggtggaggttgcagtgagctgagatcacgccacttcactccagcctgggcaacagagcaagactgtctccaaaaaagaaaaaaaaaaaaattaagccatgattgcaccactgtactccagcctgggagacacagtgataccctgtctaaatacatatgtgtatcagttgcttttttgcccaggtaggtgccctcggaatacccttgaacacatcttgtcttgcaagtcaccagaacagacccacactcaggcactcactaatgtgtacttttttttttttttaaagagcgagggtctcgctctgtcacccaggctggagtgcagtggtgcaatcataactcacagccacctcaaactcctgagctcaagtgatcctaccaccacgcctctgctaattattactgcattttttggtaaagatgggtcttgctatattgcccaggctgatcttgaactcctgggctcaagcaatccccacctcagcttcccaaagtgctgggataacaggcatgagctggaataacttttatttactgattttaaaaagttgactgctcccctcccaccaagctcctttggtatgcagtaactggcagatagatttgcaaaggggtcaaggaaccacccgggaagaaaaggaacaagacccacacctcttcccttgtgtatcaatgttaggagaacactctgatggctggattgagatcactctaggggaagggaccccaggctacctgcccccaactcatcatgagggaggagtctggattggtgcccctgactactgggctcccagggagagctggtcctggcatagagaggacccgagactggagagctcttctcaaccagccctcctgggaagggcatatgctgtgggaataaacgctgtgggtgtggcaggaaactggggatcagggacctggggagttcaggagctcctctctcccaggtgggaagagtcatttccagtggccacatccagtgacagcaaagctgcactggcagaaagctggagtctgctgcgggactgacacattcccaggttagtcccggatatgtccctggctctgtggaccgaggaagccctggggtcttgggaaaaatggcttggggttagggggaggtctggggaccagcgagagaacaggagagggacaccaggcatggagctgggagtcctgcggtgagggacctgtgctgtgcttcctgcttgctccttaacagcctgtggacttaggttcagaagagacaatgggtggaataagcccgagcatcctgagagaagggacttccccaggggcccccagggagatgggacctctccatgctttatttcttcatctgtactaaggcaaccatgagcatttactgcacatgcccactgtgagaatttaaagagttcccagaaccaaaatacttggcacatggttagtgcttaataaatattagcttgggttaagattattgagccaaacaatggaagagaaggccagaaagtaggaatgcacagaacagcagtttctaaattgcttcagtgtcaaagaaaaccatctcacacttctgggacttccctgggccttaatttcctcatctgtaaactagggataaagtagtacctacctcaaagggttggtgtgagagtttgtttgtttttgagacagggtcttgctctgtcacctgggctggagtgcagtggggtgatcttagctcaccacagcctccacctcctgagctcgaggctgggactacaggtgtgcaccaccacacctagctgaagtttcttttatatattatgtagagatggggtctcgccgggttgcccaggctggtttcaaactcctggcctcaagtgatcctcccacctcagcctcccaaagtgctaggatgacaggcgtgagagttaagtgatgcagtacacgtaagcactcagcacggggtttgtagaggtctaatccatgcggagttcagccttaggggtgtccctaccccaactccaggctccctagggtgggcaagggggctgggccagcaggcctgctaaactgctgagtggaggccccagccagtgacccagcaaccccacatgctgggtaactctgacttgccaattgccttgacatgtggggcctcatgtgatcagaacatccagcttgcacggtggggtctgaagagggcaaggctgagggcttgctctcagccacacaggtggcgggcagggcctgagatcagctcggacttgccgccaccagagcccaaacccctactcctgcctgggtgtcttgagtcagcagggagcacccatacttcttcctgtgtgttcctgggccctccagggcactcaagtggcttctctccccttcccctccccactccacgccctccctccagctctggcactcacctggctgctgtccttggctgacacgtcagccatgttgttcctccgagcctggtgcacggtcagggcagcccgagtggccccaccagcaacactcacgatgcactgggtgggaggggaagagagaaggttggcagagacacgtgtcctggtaacacaggcactcagaccagctggagaaaacctggccccggccaaactctgaatgctgtccttggcatctagttctcaccttgatgccccctaggctcaacttccctgtcctgttctaggaaactggagtcccacctgccactatcaccttggggactggcctcacagaagctcaatttcattccccaaggtggaggcccaaagatcattctcagcccagaactcccagccctccagctcctgcttgggctataccctccccattactggcgggaggctcaggctggtttccagcttcatgcttacatctgcctcctgtaattcctctactctcctcctgccccagttaaagctgtcgaaacctacactgatggccctgacctcccagggtacccagatctctccctctgagatcgcaggataaagctaatcaaggagggtcactggtcactcacaatcatcccgagttcatcaaagctcttttacttattactatttttatttatccttagtttttgaatacagacagagtctccctgtgttgcccaggcgggcctggaactcctgggctcaagagatcttcccacgccaacctcccaaagtgctgggattacaggcgtgagccaccgcccctggctgagggctcttttagatgccagacatagacttaggtgctgtgatacaagtcagacccaggccctgccctcatggagcatacagatcaacagataataaacaaataaacaagttaatacgcaggcagaggaaacagtctgttcaaaggccagaggaacgagggacaaagtgagggcgaagtggctggcagggacctgaccacacggagcctggcaagcctggtgaaggtctttccctaagagcaatggagcagcagagtgacctgattgctttcctctttgaaaggatcactgggctgctctgagagaggagcggcacggaggctacctgggaagcaacggtgctctctcagcagtgagaggtggtgacaggaagatggaggagagaatggactggagattttgaggagggaaaaataacagaactgaaggttcagccgaaggtgacagataaggggaagggggaagaggaggaggtggtggcagtggtggtggcggcagcatagatgacagccaggctggcttctcttggtgcagctggagatggaggttgtggagaggggaactctagagaggggtcttaagagggaagctcatggccctgttccattcccttgttggacagatgaagagactgaagtctcaaaggcagagtttgaagcaaaagccagatggcacaaccctcggtccatagctacagccatgcttttctctggggtttcctaccctgtttaggggtgctcgtagcatttaggcttgcaaccaaggaagctaaatgtcctctaccacaaggaaccgttgcaccccaaatgctagtacttatggagaaacacggccctaacgtgattttaagttgacacatgggccttggaatgggttttccattttcttgagtttctcctctgggccagggacttaactctgacaggatatgctctttactgaaccatgccaggcctcagtgtcctcatttgggtgagatcaacctgcaagggttgtgcaggcaacagcttggcgtggaggaagagtgtgcttgagccccgcgtgtcccccagctcactgtgcggtctgtgctccatctccacctcgcctccagaccttaagctgtgctgtttcttttgcccggaacacccgccctgcaccttaaactccatcttcaggacccaggctcaggggagctcttcctacactccctgaccaggctggaatccccgcctcagcctcttgcaggccccaacatttctcatttagaatacctgtacctataattccacaaacactggtgcaattatgtgtggtttcctttcaaagacgggggcccacattctgtgccaaatatgcagtaggcactcaataaatactgtactgaaagaaccaaagggaagtcaaggaagctggtcccaaaatgtcaacattggacaaccccttctagttctcagctcggagctccctccccagtcctgtggctctagacattgccttacactttctggggcactagatgctgtctggctggaggagggtcagaaaggatggttgggttcgagtagaaacatctgaactttcttattcttcttgaagtggcaggtaaactcacagagcccaggtaaactcacacactaccaaggcaggtgttttaggcagatgggtgcccccacaggcagctaccttggctaggttgctggtggagacggtcatggtgaaacagattgggtatacaggagccataatctcaaggaacatggctacgtcattgaggatgtccgcaaaaagcctggggagggatcagaggttagaggtcagaggtaggagactttcataatggaagactcccctcccccgtccccgcccctcctcacctccactgcttggcattgcagtccagtttgctcctgttggggaggagaggttgttgtaatttggacttaaggagaaacacatcctatgggcagtgtggggagtcttggaccacagtaaagtctgaagagctcaggaaaacccacacccccagacagacatctgtccccacagccggtcactgctacctaaaatgccaccattagctgggagaaccttcagtgactgactgatcacctagtgtctcccgcttatgaactcatgatttaccaaggaaaaaccctgattgtcttgtggctgctccccagcctctgtctgtccttggagggaggctcttcctgagttcctctgcctctctccgttcttcttcttgctttagagtgagggtacccagtgagcatgttttggactagtaaacatcacattgagtgtgtaaccctgcatgttacagacaactagccctcacaggggatatgatttccctggatcacacgcagagttggggaaaaggctaagagagccgggctccgacatccaggcctagggtacttctgttacacaacaccgtggacggctacctcacctgcccttttcgtcagacagtgactccctgccctgtgcacaaacacttggaaacaacttctctagggtcccagtggcaggagatactgcagccccagcccagctcaggatttgcagcattaggcccgagtctcagtatgagatctcctggagggaatgggaatattcttgggagaggtatcagacacacataacgagatcctgaacacatggcctggttgagggttctgcccagtgaactgcccaataccatggaaagcacaggcttcaggttcaaatcccatctcgctagttataagctgtgtggtttgggcaggtaacttccctcatgcaggtatatttcacatttatgaaatgtacacatccaatcccatcctacagagttgctgtaaggattagagacaacatacagaggctcagggggcacagttacagctgttaatggtagctagtgtttactgagccattatgtacgatgccacgggcattaagcactttgcatagatcatctcatggaacccttacagccacaattaatggcaatactattactatcattactaccactactgggaagagttgccagagttgctggccgggaagacaaactcaccctttccaccaggcaaagacgatgcggcccagcatgccagttgaatctgggggaaagaaggcacaggtaaggagcaaggaagaggtgtgggagctgtggggcctggcagaccctggcactgaactggccaattcactgagtcactgcctttgggaactcggtctggtactagaagttgtggatagtcatagctacataatggggtcagaagtgcctacaaatagcagttcctcaatatgtcccctaggagacatggacaagaaatgttctttgcagaattgttcataacagcaaaaaacctgggaataatgcaaatgttgactgacagaatacataaattctagtatattcacccagaggcattcattcatagatgaatactattaaactcttgcatgaaaataactcatgaagaccacatacagcacagtttgcaaagctctaaaattaaaactaaacaatatagcacttaggaatatttacctatttggtaaaactattcaaaaaagcaggaaatcttaagtggaaattcaaaggttattgctaacctgttctagctcttaggctgggcagttggctcacagatggctattatgggataaataaataaaaggatttaggctgggtatggtggctcaggcctataatcccagcactttgggattacagggggtttgggcccagggactgcttgaggccaggagttcaagaccagcctgggcaacacagcaagaccccatctctacaaaaagtaggaaagaaattagccaggcatggtggcatgcctgtagtcccagctacttgggaggctgaggcggaaggatggcttgaactcaggatcaatgctgcagtgagctatgatcatgtcactgcactccagcctggatgacagagcaagacccagtctcaggaaaaaaaaaaaaaaaaagatttgaactgcagctggggttgcacggcagagggacaggcctccttaggctgggcagagtaagagaagtctctggaatcagtgggaccttcgtttgcacaacaaatgctttctggctacctaactctctctgccaggtacttcatgaccacagtgaccaagatgatcccagggtcaaaatccagccaaagagcagataacaatcagtatagaaaacactgatttagaccaggaatcactaaactgtttctactccctggttttggaaataaagtattactggaatgcagccatgcctatttgtttacagattgtctatagctgtttttgcaagacaatgacagaactgagttgctgcaactaagattataaagcctgcaaagcattaagatctggccctttacagaaaaagtttgtcaatctggaccatccattatacagagagcagcacccattaagcctggcagaaatattttagaacgagacacctgggagggactcatacagtggacatgggagaggacagataccatggggagaggatttggacttgtctgagcttgagggcactgaccctgaggtggggatgtaggagaaaggacactacgttatgggaatgagggctgggagcttcccacgaaacataaatgcaatgacacgggccagccctcccattctccactgagagcagatgcattctcccctttccagagccttcttgggcactgagtcatgcttgcccaccctggacttgagggaaatcagtaagcgctccagtgcacacctgaaatacctgtgctttttcatcttcacaatgatcctgagactttgggagggatcattccccttcactaaggctcccattaaatcggtgaataaaattgaggtattttacaagaaaatatggatttccagcttctctggaagaacctgaagatatggccacactggggctgccctctctcacggccagcatcagctggggctacctcactgaaggaaagcatgggtccaagctactgccatctggcctgctttgtttctccatttctgtcctgactctggaagtaacacccaacaaggtggatttacaggcctcccatccctcactttaacctcttcccttcaagtacattatattctcggcaaaatcatcattgtgccagccaccacacctggctaacttttgtatttttagtagagatggggtttcaccatgttggccaggccagtatcaaactcctgacctcaggtgatccacccgcctcggccttccgaagtgttgggattataggcgtgagccactgtgcccagctcagactctatttttcttccctttagctacacacttgtatccactcaggtgtatgtcctccttgggccacctgacagaaagggagcctattctacctttccatggatcatcagaggcatttacaggacaaatgatatatatactccctagcatctgagtcactactgtccactagaatagaaaactcccacttgcttttttttcctcttcatttacaactggccaagctgtaagatctagaaacatctgagtcctaataaggaatcagctgaccacaaattgtacttggctccacttgacattcttagctggcaaaagagtgtggtagttaagagtagaacacaggaataagtctgcctaggtcaaaatcatggccctaagtgaccttggacaagttacttaaacacacttttgtctctgtttttccatctaaaaaatgaataatggcagctaactaatatggctgctgcagagatcaagacacatattacatgtaaccatacaaaatgtgtggcttaaggtaggttgccaaaatattagcaacaagttttattactattgctactcatgacaactggcatcacgttccactgagacaggtaactgaaaatgatcacatcaaaaaatcccaagtaagtttctcagatgaagctctgcacagaaatttcccatgtttgatgaaaatgagcttgtaaaatcctaattgagagcttcttttactatcaataacaagcctttatttatttatttttttagatggagtttcactcgttgcccaggctggagtgcaatggcgcaatctcggctcaccacaacctccgcctactaggttcaagtgattctcctacctcagcctcctgtgtagctgggattacaggtgcacacaaccatgcctggctaattttgtattattagtagagagggggtttctccatgttggtcaggctggtctcgaactcctgacctcaggttatccgcctgcctcagcctcccaaagtgctgggatcataggcgtgagccaccgcacctggccaataacaagccttttaagtagatttttcatcctttttctttgagacagggtctcagtctgtcatccaggctggactacaggtgcctgccaccacgcctggccaatttttgagttttttgttagagacggggttaaaccatattggccagggtggtgtccaactcctgaccccaagtgatccacctgcctctgcctcccaatgtgctgggattataggcgtgagccacggcacctggcctttctttttttttttcatatcttaaagtgatcttgatttttcttaataacttgtctgagctaaaggtttagcgttccttttttgtttcagacaggatactgctctgctgcccaggctggagtgcagtggcactatctcggttcagtgcaacctccacttcctgggttcaagtgattttcctgccgctgcttcctgagtagctgggattccaggcacgtgccaccatgcctggctaatctttgtatttttagtacagatggcgttttaccatgttggctaggctggtcttgagcatctgacctcaactgatctgccgaccttggccccccatcccaaagtgctgggattacagggatgagccaccatgcccggccaaggttaagcattcctaatccaaaaacctaaaatctgaaatgctccaaaacctgcagcttttgggagtgcagacacgatgccaccagtagaaacagccgatggtgaaatagcacaaactgttcttgtagggaaaagaaagagatcagactgttactgtgtctatgtagaagaggaggacataagaaactccattttgatctgtactaagaaaattgttttgccttgagatgctgttaatctgtaactttagcgccaaccctatgctcacagaaatgtgctgtatggaatcaaggtttaagagatctagggcggtgcaggatgtgtcttgttaacaatatgtttacaggcagtatgcttcataaaagtcattgccattctccattctcgattaaccaggggcacaatgcactgtggaaagccacagggacctctgcccaagaaagcctggatactgtccaaggcttccccctactgagacagcctgagatgtggcctcgtgggaaggaaaagacctgactgttccccagcccgacacctgtaaagggtctgtgctgaggaggattaggagagatatgctggcggcaatgctgctctgctactctgctacactgagatgtctgggtggagagaagcataagtctggcctacgtgcacatccgggcacagtaccttcccttgaacttatttgtgacagattcctttgctcgcatgttttcctgctgaccttctccccactatcaccctgttctcctgccgcattccccttgccgagatagtgaaaatagtaatcaatactgagggaattcagagaccagtgctggtgctggtcctccgcatgctgagtgccggtcccctgggcccactgttctttctctatactctgtctctgtgtcttatttcttttctcagtctctcgtcccacctgatgagaaatacccacagtgtggaagggctggcctccttcagttctgaatcaaggcaatcatggtaacagtgacaatgaagaggatactgttaccactacagaaaaagtgcctatagacagcacggtgaggatgtgggaggggattactgtggcactagagcagcatacattcataacggaacaagaaatcaggcagtttatagaatccaagagagacttctaagatagaaaccacagttaatgaggcaaatgactctggaggaaacattttaaaaagccatccagcagaacacttcctcatccctagaggacccgcttcctgtccttcaactgcttctaatgtttcttctcaccttaaaaaaataaaatatggtgtccagtaaccttttcaccaaaacagctgaagactgacagcctgccgtttttgttgctgctgctatggttcagaagctgatacaggtgttctggtgatctgctgtgctgcttagttaccctgaacacacaatttctcactgtattagtggtatatcatgttttatactgttaagtacttctgtgtgaataggtataagaaaatgactgcttcttggtagcatatacattcagagtcaggaacgatggggacgctaaccaaccagattgtccacgtgtggctgagacagtgacatctttgctttctgatggatcaatgaacacaaactttgtttcatgcacaccattgaaaatactgtataaaactgcctttaaggtatgtgtataaagtatatatgaaacataaacgaatttcatgtttagacttgagtctgatccccaacaaatctcattatatacatgaagatattccaaaatccaaaaaaaattccaaaatccaaaacacttctggttgcaagcattttggataagggatattcaatctgtataggcaacatgttggtgacatcacatgaaaacaaaaactactgacccaagctccaaatgcattccaaaaatacggccaacaagccgggcgcagtggctcacgcctataatcccagcactttgggaagctgaggcgaatggatcacccgaagtcaggagttcgagaccagcctggccaacatggtgaaactctgtctctactaaaaatacaaaaaattagcggggcagggtggcacatgcctgtaatcccagctacttgggaagctgaggcaggagaatcgcttgaacccgggaggaggaggctgcagtgagctgagattgtgccactgcactcctgcatcccagcctgggtgacagtgagactacgagtctggaaaaaaaaaaatagagatgggggtctccctatgttgcccaggatgcctcagcctcccaaagtacgaggattaaaggcgtgagccaccgtgcccggcccagttttctcagtcttaatggtaaaggtgtaaacaggaagctcctgttttctcaaaaaaatccagagaggctcacaagggatgtggccagactgatgctacgaatggaaagcgcttttccttagatctattaggttggctcaaatgtaattgcgggttttccattacctttaatggcaataacgacaaagaaaccccgcaattacttttgcaccagcctaataaatatcccctgcgagcagtagtgaaagacaaaggacagtggcaaaagccatggggcctcctcgtgtagaacatgtaacaatttcccttttctgttctatttccctctctgggtggcatggtaccaaactgtattttttttccttaaacaattttttaaaagctgtacatattcagcagatagtcactctattatttacagcatcatctggtatcccagagcatacacaataccttccattctttccaggctctcctctctccttctcaggaccaactatatcttttttttctggagctcaccaatttcccctatcctgggcagctggcagttttattccatcaattgcattcttatgcaatcttccacaaagagaatagggataaaggggaggggacgggatttgggatccagatgattgagactcagaagtctgtgtggggaatggagtgcggctgctaggctggtgagtgggatgagggtcttccagatgtgggaagtaagactgggttacaaagcaccactctaatcactggggagacctgcctgaattctacctaatggggcacgagtccatacatatatacacataagagcccagcgaaagcagggctgaaagcagcaatacgtgaggctccaggggtgcagctcacctttcacgagccaggtggccgtggcagctgaaacagtggcttttgcgttccccacccctatgcccagcaagactgcctgggtggctagggagccggagaggctggaagcaaacgcctggagaagaaaacaagtagggtgagaagcgggcgtaggagcgtggcggtctaagtgccttcatctgttcttgttcttggtgtatgaggcatgtcagaccccccgccccccgggctccgagtctcagtcacccgtccattattggggagggaggagtggcctgcactgtcctctgccccagacgaccgagctgacctgcacggaatcccacagctggtagggcaagtagtccgggctgacgctatcagggaagccctgaggcaggaacacggcctggagcccggagaggggcggtgagggggccccggaagcccccacttcgcccgcatctcgtccttcaggtttgaccgtgaaggccctggagagcccccaccagcgccagcccccgacctcccactgcaggctcccgtccgcggcggcgcggcagccccgtgcctccccggagccgaactgctcggaacacagcggggtctccaaacccgcgtcgtcagccatgccgagcttttggatcccagccccgcccctgccgcacggtggacgt

SEQ ID NO: 77 - DNA, 342932 bp, Homo sapiens
aaggatattacaacaagaactttactggtaacacctttttaataggtcaaagtaactgtacagttcattatattcttcctgagaataatttatatcccccaacaaactaaagggagggtatattttttcaaaattaacagaatggatggtgtaactggacatcaaaagaaaaccaaattcctgttttgcttcattctctcctgggaagacagatacaaggaagggttagttaactccagtggctgtaaaatagtcaacatggctttaatctttctttataaattatataaaaatggaaaaaggggatggttctggaacttctcctcaatgcagtttggaggtgctctggtacaaagcatttctgcttccaagagaaataacattgctacaaaaaactggcacattattctgtgaaaaaagacatgagtttttagttgtgttctacagctagttcccgacccaatgcttcacatatccacacgaaagtaaaaggcaggtaagacaaaaagggctgtagttttttctgaaataactcaagtcttcaaaatatagcttttatattctttgtaaagtgggattagcatattgcaactgaagggtgttctaacaaacaaaaattccagtctggataataattctatggtagacaaaagaattctcagcctcttgggtttcctggaattctttgcttcatgctctcctcttccactatgcagctaaggtagtttaggaattaagatgtcaccccttggccatccccctttagaacgtatcttaatgtgaacataaattgttcttcatgatgcttaaaagcttacatataattttcattcttagaaaaacgccacattttggatcctggatttttctgaatatcatgattgaaaaaaacaaaacaaaaaatgaacccaaatcaaagtgtggttaaacttatatgagaaagatttttcaaccagatggtcattcaaaaaagttggagctgtaagtgctggcgactgaggacacagggttaattcctcgctgctggtggaaggctagagaacatcttcaaaagagggtagcaagacgtgctcctaggggaggctcagtgtggtctcgtctgcccaagcattttcagtcttgcttggtcaatgacatcgagtaagtttttggcatccacagccagggcgtgagcagcagtcagcatttgctttttgtactcttgctggaggctggtcatgacatactgctgggccagtttcatcttgttgatgagctcacccaggtcagagttcaatagcttctgtgccatctcaatctgaaagacaagagataggtcaggagaactgttttcagtgatttttttttttcttttttagagagatgttcttactgtgttgtccaagcttgcctcaaactcctgggctcaaggaatcttcctgcctcagccttcccactagctgggaacacaggcacatgccaccaagccctgcaccaatgaacttttcagggaatttttatgagcctttctttcagtgcctccatgagaagaaaactttatttcctgtaaataaatcttccttaggagcaataggatgtaaaaatcaatctttaaattttttttttcttattttaacttcccacactacattcatgcatttaaacattttttttacttactttagaaattcagctattatagtgtgcctgtttgtgcatgccgattcacacatgcagatccagcatcttgttccttccattcaaagccttccctgacaccatgactaacttcgtctccatttgcgctgtttagactttattaatctcagtgactggcagggcttttgtttcataatagaaccacagaatctgacagaacttcagagatcatctattccaaacactttcacattagagtggacaactgagatacagtaagatgtgctgaaggccacacagctctttagtctccaagccaggacaaaagcctcagttctgacttctggtcttatgctttctactatgccaactctatttcaagaccttccttggctatacaaaaaatggtttaaggatggtggcagggcgcagtggctcactcctgtacaatttcagcactttgggcggcggaggcaggctgacggcttgagctcaaaagtttgaggccagcctgggcaacatggtgaaaccccatctctacaaaaaaatacaaaaagttagctgagtatggtggtgtgcacctgtattccaagctactcaggaggctgacgtgggaggacggcttgagcctggaagacagaggttgtagtgagccaagatcgtgccattgcactccagcctgggtgacagagccagaccattatgtacgcccctccccccgcacacattaagtcagggcagcaatggtggaagcagctaatgaacacaaaatgctgtcctacagggttcgaatgctttgcatgggagagtctcatgatccttcttatctgtttcttcaaccagtggtgacttatccatttgctcttttatcaattatggagcacctattatgtacgagacacttggtgcttggatacaaggaggaagacctgtttttacccgcagtctacaatgggaaaagcatacacaggaccctataatacactggaataaatcacgtagtagaaaagtacatagataagacagcaatgcattctgtctcagagagggtcagaaagacttcacagagagaatttgtctgaatttggcctatactgtaaaagtaggctggcttcaactgtgaaagccacacctagttgatctttatttggcaggacttggcaagagggataagagatttttaagaaggagaatgacaaaatctagagagatattctagaaagatggctcttggcggcaatgtggaggctgaatggaagggcaggggaacagacaagaggcagataaaccatctaagaggccatcttcagaggagaggtgatggtggatgtgcaggtgaacggaccaacctgagacctgatgagagatggaaggtgtgtggttgtttgcatgtgtgtaggggattgggaacagacatgcaagtgcatggtgttgtcactgactgtggaagcaaacaaggaaagcagaccgttcttgccaatggcagacagttggagatcagagctcagggcggggttctataaaatcaacacagatttgggaggcatcaaatacttgaatctatgagaatgagaagaactaccagagtgaaaaagtattttttaataaaacaagtgggtagcactttgggagatgaccacactcaagggtggcagggaacaaaagcctgagcagaggtcttggcaggagaggagtgagtgaggaagctctgggccagagcagggggtctcaagggggagttaggactgaggggaaagcaggggctctggcaattaggagaccttgaagggctgttacagcagagagagttccaaacagctggagcactggaatgctctgagctggcgctgagtgcagctgccatgtgaggaggtggccccatcagggatgggctgctctttcaggaagtacaatggggacaggaggaggcatgaggacagtgaaaggcagatgcaggatcaaagacaggctcctcttcttttcaaaaatgatttaaggccaggtgtggtggctcacgcctgtaaccccagcactttgggagaccgaggtaggaggatggcttgaagcaggaatttgagaccagcttgggcaacacagtaagacactgtctctacaaaaaaataaagaattagctgggcgtggtggtatacaactgtaatcccagctacttgggaggcggaggcaggaagatcacttgagctcaggagttggaggttatagtgagctgtgatggagtcactgcattccagcctgggtgacagagacagaccctgtctcaaaaaaaaaaaaattaataattaaaaaatactgtatacaggagagcaatttgtgtattggaatcaggggagatgaaaagattactttagactttatcaactagagtaggtgttgacaaatagtcccactaaaatatccacttggtaggacaccattttcttgcctctagcatatggaacttctccactttggggcaaaactgaggcttgtcatggaaagccagaggcccggtgaagcaggtaagtgagagaaccccatttggttgggatgtgaagttacactacagcaccagtcacaggccttctcaaaaacaagttaaagggtttatgcatatgaatcaatgccacttacaaaggaatcaccaacaggagttgtgtccaaccgtccttcagaagtcaatgtccagttggtcaactggaacatcccctggacatcgtatgtctctgggtatgatgctgagaaggattcagcattatttatgttgtattcctgactggagatgcaaaatctcaatctcatcaggaagaaacaaatgtttataggatatccctcaatccaactttaagaatactctataaaatcactgagcctatgtttgtcaaaaatgtcaatgtcatgaaagataaaaaaaggctgaggagctgtttcagatgaaaggaggctgaagaaagcaacaccacgtgcaaagtgtaatcctggtctggctctcacaggcgacggaaaagtgctacagagacaaccgacgaccctggaacgtgccctgcagagtgggacagtgcattacatcatgttaaagttccagaatgtggtgattgtgtggtggttatgtaggacaatggccttgttatgagaaatataaatggaaatcttaaaggggaagagggcatgagatacacagccattctcaagctgctcgacagcaggaagtgatgtgtgtacacacatagacaatggagcaaggtgacaatgtgctgacatgttaaaaggctgtgaaactcaaaggaaagttgggagttctctctattaatcttttaactttcatataaatctgaaatgatttcaaaataaaaaggacaaacaaaaagtgtgtgctgggatgaagaactgcccatgcttccctagaaatgagaaaagcaggcagctggagtcagcagggagcaaggctgaagcctgcagatcctggactctgtagtggggacgcatcccacatgcgtttgtcaatcccaaccacagaatgtacaccctaggctcaaagacactaaaacaaatgcaggtgcttcctttcatttgttagtcatataattgaaacaaaattgccaaaaggtagcaaaaatgatagttgttgctgggctacagtattttgggtcaacttttattccttaaaacttttttttttgaaacagggtttgctctgtcacccaggatggagtatggtggcttgatcctagctcactgtagcctgaaactcctgggctcaagcgatcatcctgcttcagcctcctgagtagctactgcacacagctaatttttaaaaattttttgtagagacagagtctcgctttgttgcccaggctggtcataaactggctttaagccatcctcttgtctcggccgcccaaagtgttgggattacagaggtgagccaccacactcagcccttaagaagcttcttaaagacattcattaatttaaaatgattttttttttcagatggagtctcactctgttgcaggctggagtgcaatggcacgatctcggctcactgcaacctccacctcccgggttcaagtcattctcctgtctcagcctcccaagtagctgggactataggcgcgtgccaccatgcctagctactttttgtatttttagtagagatggagtttcatcatgttggccaggatggtctcgatctcttgacctcgtgatctgtccgcctcagcctcccaaagtgctcagattacaggcgtgagccactgcgcctggcctggaattttttaagacaataattttatttattaattttttggtagagatagggtctcactatgttgtcttgaaatccaggcctcaagccatcctcctgccttggcctcccaatgtgttgggattacgggcgtgagctaccatgcctggcctaaaagaaattttttatattactacttgaaatggaaaaccaggatcatttgcaagctcaactatttttaaggagaattcgaggaagcagaccatgcacaatgcccgccccattcatatcagcattcttctaccttttaggttcatggcaccagcagcagtttcccatgtgccttcctcatccactgctcagagccacttgtagctcagatgaggaccttgcatagtggctctgcagtggactagcagcaggaagacccaggatctggaatttgagtggccactgctccacaccacccctatgccctagaatgaacagccccgtcctggttggggccagtgttagagggaaggtcatcgcttgtagggcagttgatgtctctgctggccacagactgaggagcggccttcagcaccacaggcatccctgaatgtgtccctgcccagtgctgtcacagagggctgcaaggggaagattgtgccctacctctcggtgggtgctggctggtaggaggggaatggtctcatccacagtggccaataatgtcctcagggccaagccgacttcctaacagacaagaatcacaaccaatattagaacacacacaaaggatttttatgcttttcagttatatatttttttatttcctttccacaagtttcaaggcaaatttctgtatttctttttctcagtgcttagccctatcttgtaagttatgaggctcctttttctcccaaaagatttagatctgactgttcattgctctaataccctaaggagtgagttgaagaccagaagttcatgtaagaaaagtcacacagatgctgagggtggaaagcaggatttttttttttctcatctactgcttccaagcagattataccaccctcctggctccaactgccaaccctgccaacacaggttaggataaatagtagcacctttccccaagtgtgttcaccaaatgtgttctcacccaggtactttcaaacacctcatgaggctggccagagatgacaccactgccccggatgcaagggggcagccttgctttggaccccgttctgaatctcaggcttcatctattaggcacactgagcagaaacactcctccctgccacttccgagttgcagcaaaaagggtctaactatgatttaaaacaaataattttaaacttcaaattttcattactgtcatacttatgaggaccaaataatgtaatgactaagacatcaaattacatgtaatatgaataaaaccagtaagaaaatgatagttacttataattggatcaacatacaaaaagaacgtcatttggccaaagtaaaacggttaaaaaaatagtgtctataaaatcaccatataaaatcttagtatgtacaaaattctgaatggtttcacctactgttgagttgtttaaacttggctgtgggttcatgcaagttcctccttaagaactttggttaaaactgttatgtggatacactttaaaaaagtgaaccagaatggattaactgtgctttccatgaaacattacaactttcaagcagctttttccacattgatggtttataagaagctgttgcaaagattgctaataggtatactaaaaaacagttgtaggggccaggcgcagtggctcatgcctgtaatcccaggactttgggaggccgaggcaggcagatcacctgaggtcaggagtttgagaccagcttggccaacagggtgaaaccccgtctctactaaaaatacaaaaataagccaggtgtggtggtgcatgcctgtagtcccagctactcgggaagctgaggcagcagaattgcttgaacctgggaggcaggggttgcagtgaaccaagatcgtgccattgcactccagcctgggagcctgggtgacagaatgagactccatctcaaacaaaacaaaacaaaaaacccaacaacaacaattgtaggattctataactcaacaacaaaatacagtatgatttaaaaaacaggccaaaaaagaaaaaaaaaacttgacatttttccaaaaaagatacacaaacgctcaaaaagcaaacagatgttcaagacctgtatgcaaatcaaaatcacacttagatacacttcacatccattaggatgacaattattttttaaaacacacacacaaaaccccaagcttcaaaataaccccccagaaaataacacgttttggtgagaatatggagaaactggaacccttgtgtgctgttggagggaatgtaagatggtgcagccgctgtgaaaaacagaatggtggctcctcaaaaaattaaaaatagaattatcagtgatccagcaattctgagtatacactcaaaagaagtgaaagcagggtctcaaaaagatatttgtatatccatgttcctagcagcattcttcatgataactgaaaggtggaagcaacccaagtaccctgtgatggttcagtaaataaacaaaatgtggtgtgaacatacagtggaatatcactctgccctaaaaaggaagaaaattctgacacatgctacaacatggatgaactctgagatactatgctgagtgaaataaatccatcacaaaaagacaaatacagtatgattccacttataagcggtacctagggtagtcaattcatagagatagcaagtaggatggaggttgccaggggctgggggaggggaaaagaggagggttgtttcaaatgcacagtttcagttttgcaagggaagggttatggaagtggatggtgctgatggtggcacaacattgtgaatgtacctaatgcttctgaaatgtatgcttaaaaatggttaagatggtagtttatgttacgtgtattttactatagtgaaaaaaaagtatgttcgagtatgtttcagaaatactggcttagagcaaatttcgaccacactctgtgaactggaggacacccctgtgcaaccaacatgccagtctgtactctttaaaaggagccattgctgactttccttggacctagtgtcctctttctttctctctctctctctctttttttttttttttaaagagatggggtttcaccatgttggccaagctggtcttgaacttctgacctcaagtgatctgcctgcctcagcctcccaaagttctgggattatgggcatgagccaccacactcagcccctagtgtccttttacacaggacacctgtcactgcctgctaggatcccactccactgaacacaatttggaaaacattagtttactggcatgatatttttatttatttttactctttttaaaagaaaattcaatgaacacccacatacccaacccttagcttaagaaaaacaacacagataaatcctcccaatgtacctttcttcagctggctcctccttacaggtgcgggatctgaatttgataatgatcattcctctacttgtctttgcactccaacaacgtaaccacatctccctaagtcttacacaggattattttgcatgtttttcaagtttacataaatggcatcatactgtaagcatacttttgcagctttctctttcactgcagactttatgtgtgagtggtaattattaaaagagtgtactgcttcaagacactcccatcctagtgtttactgacagaagaaaacaagataggaacggcaattcagaataactgcagttctcactaacattgtcactgtatggtgctttcgtgaagagcttctaaagcatcagttctgactttggtggggcggggggacctagagacatctatcaactggcaccacagcttacaggaaacaagaacatttttgccagtacacaaaatgactctattttaccttcaccatagggacatactcctctggtggggctggctggattttactggacatctcgatgacagctttcaccaggcccgtcacattctcgtacaccttatcattcgaccggtccaggttggcagtaggaggggggctgatttcctggggctgaagctgacaacacagaagccagtcatttttctgctctccagcagatggcgtgagatcaccacaatcaagctagagagggtctttacaagagatcaaagcagattgcagaaggtcattgattttcttgtgtgtgcgggatatagttcagattgagaatgacagtaaagtaattcctccaagtgacaaattaggcagtattttctttctaactttgagctcagttaaaggaaatgagatggaatcatacatattatactaaaaaccccagattctttcagagacctgattcaatgtcccctcaccccaaaatcatttaccacaagataataatccatctgggaatttactgaattttagacaaaattacctatttggctaaagagtcaaacattctacatgaagactataaggatttccacttagtttgaattctgcagtgaaaacggtatggctcagcttagctgccctcagccgcctaatggaaacatgttctttgtacaattataaaaagctgacatatgaatgcactttaaggggatagcatctgtttgcaggtcgtgactgaagtcaaagcagcagtggtgtcgctaggagcctctctgctcaagaccccggtttcagccagctctgtgctgactgctggaaagcacctgggcctacgcttataaagcctcagctctctcacccgggcaactgtgatcagggaagatgaggccaaagatgtaacaatgtctacctagggcctgggcacagaagagacatcaacaaatgttactaagataacttgagtactgatggtggaataacatgagggcctttgggaaatcttcagcagtatttaaaaattccaactggttagaattacaccagcataaaatggtatatatatatatatatatatatatatatatatatatatacactttttaaaaaagaccaacttgtagtacatatagtttaatcatgaacctgatgccagtgctcagtctaaatataagttcccatttctgaacccttgggtgcttttgcctaagtaatctggaacagattaattcttggttgttccaaaagtctgggtatgagatagaaaagcacaagaataattcatttactgcaaagatgtacatgtctcattcttttgcatatataaacactgcttttggcatctgtcagtcatgagaggtgacaaagcaggccgaagtgccctcccacttgggcttcctgctttccagtccaaagttacatgcagagagccgggtgtgatagagagagctggacagacacacaaagacacgatgtgcttaccctccatggctattgtcgaacggaaggtgaggaaaagttaaaggaatttatcagagaaagggaaaaaagaaaaacaatattaataaaggcataagacaaatcccccataaaaacacatgagcagaacaaaaaggagctagtttccaagcctgcccaccagctctcactcactgttgccagggtgtggctactgtgccacctgctcactgccccagcatactgcatagagaggtctgccatgcaccatgctcagttacaaaacaaatgcagggaacatgcaaagcccgaggaacaatccagcagcagtgcaaggtcaacagaatgagagctcttcaaaaagaaaggaggaggaggacatatggttttaattactgaaaagtgcccatctgaattctcatagattcaggagaaactgcagcagcctcaattcctgagcccggcccctcaatatccttgagatccacttcatcatctagccataatgctatcataaagattcctgacttggggctgagtttaaagatattaggcccagcctggccaacatggtcaaaccctgtctctactaaaaatacaaaaattagcagggtaatggtagtgcatccctgtaatcccagctactcgggaggctgaggcaggagagtcatttgaacctcggaggcagaggttgcagtgagctgagattgtgccactgtactccagcctgggtgacagagcgacactgtgtctcaaaaaaaaaaaaaaaaaaaaaaaaaaacaacaacacacacacacacacacacacacacacacacacacacacacacacacacattgggagcttattttaaaaacaaaaaacaaaagtagaacagaaaccccttttttgagctgattcttatgattaggttctactacttgaaactgaacagttttatttaatgtgttttctctaaagctcaagccagggcgctatcctactataaccacaccatttccaagagatgacttcctgtattttattttctgcactgagagtcacagtgtggtcttctgtttaacttcataggatgtaccagttcaaactacatcaacagggcttcttgaggagggggccacagggtgtttcatcaagaagaaatagacaattctgtaattctagggaggttgtcacctgtttaaagcttctgttcctttctactttaccctttgcccaattattgtggtagaggggcactgtcataatgcttctagggaccattcacagtgacattccagaagggaaagctgtttggaaagacatcctaatggttttctattttctggagcttgacaacttggaagctccttggcaggcagttgataaaccctctatagatgtagccaattccaaccacttaggttgatgcttaaagactcagttaagaaccaaaatgcagtgctacctaggaaaaattgagactgattttggctgttatttggatgaattattttagttatacataaaagtaaatattttagtattagttttttttaggcagaatctcgctctgtcgcccaggctggagtgcagtagtgtgatctcagctcaccacaaccaccgcctcctggattccagcgattcttgtgcctcagccccctgagcagctggaattatagggtcacactactatgcacagctaatgtttgtatttttagtagagacagggttttgccatgttggccaggctggtctggtactcttggtctcaagcaatccacttgccttggcctctcagtgttggaattacaggcgtgagccactgtgcctagctgcattgcagtattagaacaatactgttcttttaggatggattcaatgacctctaccaagcagacaatgaagaaacagaggtgtatatttcatgttatttaaaaatctacttaggtcgggtgcggtggctcatgcctgtaatcccagcactttgggaggccgaggcgggcggatcacaaggtcaggagatcaagaccatcctggctaacacggtgaaaccccgtctctactaaaaatacccaaaaaaaaaaaaaaaaaaaaaaattagatgggcctggtggcgggtgcctgtagtcccagctacttgggatgatgaggcaggagaatggcgtgaacccgggaggcggagcttgcagtgagccaagatcgcaccactgcactccagcctgggcaacagagtgagactctgtctcaggggggcggggggcgggaatctttacttaatatattttaagtacacatattattttcaagatttcaatttgcttcataccctatcctaattgtatgtattcattatgttattccagctgtgaaagatgtttcataatgatgtcagaattctaaggtggtaccgatctacctgtaaagttggtttttcattgtaatacaagccattttgaaagtctgttcttttggcttatgaaaataaataattcattaatctcattctgtccccttttctttttttaaagagatggggtctcactatgttgcgcaggccagattcaaacttctgggctgaagtgatcctccttcctcagcctcccgagtagctgggactatagtcatagaggtgcgccaccatgtctggctcctttttagaaatttattgaaagaagccaatattgggaagggtgtgtccttcctcaattttccttggagaagactcagtgtgtctttaacagaactgtcaggaggcatcctggggcttggaggcctggtgaactgaggaagttcctgattcccaggcacttaaaagccactggcatgaactctgggcaccaaccctaagggcagaggcatccctagcccagttggtactttcactatggccacagagggcaggcttggccacagagagcaggctagtttgtgccagtggctgcccattcaccctctggtcacctcctcaatgaacactggcaaacctgtgccctctaagctgcaggctatccctctgggcctggagatgacattttttcttaccctggactaactttctgatgactctgagaagacaacaatgtatctacatctaacgaagcttcagctttggaggcgagtgcctttgagtcaagtatgtgctcagccaagcctgcggccaagcacagctcagctatgtggaggctgtgtaaccttgaacaaactgcttaatctctgtgagccttggtcaactgagaaatgataccaccaccagtcctgtgaggttcacatgagaactgataatacatgaaaaaggactgccacagaacttggtaaagggatgacagtcaataaatggtggttattggtaaagcaaagtttatcttaacctgatatgacatttttcggattttaagatgtcttccactataagatgcatccttttttttttttttaacctcgagacggaatcttgctctgtcgcccaggctggagtgcaatggcatgatcttgactcattgcaacctccacctcctgggttcaagtgattctcctgcctcagccacctgagtagctgggattgcagacatgcaccaccacgcccagctaatttctttgtatttttagtagagacggggtttcaccatgttggccaggctggtcttgaactcctgaccttgtgatccgcccgtcttggcctcccgaaatgctgggattacaggcatgagccaccacacctagctcaagatgcaccattttttaatgaaccactaagaaaaaaaaatgctgccaattaaaccaaaacaccatcccaattttagagatattaaaatgtgaataaaaggtatatgacaattgagaaatagcgtctattttgagaggtaatttgtcattttaagtggaaagtaaaaagatcccatctccttacaggacacaggctagaaaagaagagcctcctccgtcagatctctcagggaggagggctgctgctctagtggctccagcactcggtgagggctggtggggacccaggagagtcacaggcgccaacagttccagctggcacccctcggggcaggctgcacctgacttctgactgccaaactcagaagcttgtggttgtttgtgcctgagtcaaacactccccttggtttgaggatggctctactcagcatacattgcttttacaaacccaattctaactttaaatggaaaataaataagtcttccatgaagccacacttataaactcctacaaaaagtcctcacttaccccaagcatcctggtttaattaatttttaaaaccagaaacaatcttggcactttgttctaaagaaaacattctgtctgatcagaggaagatgtatgtagaaaatcagaatctgactgaattcctaaaatctattacactgagaggaaaatggaaaagaaaatgtttgcataaagcttttccctgactctcagaggggttcagaaccagaccaattgactcctgggtctcactgcagttccactctgcactgttctattttcagcaccaactccactctatgacatgaacacatcaactgagaactaggggacaccacaaatcctgcaagcagaaggtgctgcacaggctcagatgcccaccttgacaccctcgttgtagctgtcagcagggctgctgaggctggcaaggcttcccagatgaccgggagctccagggcgaggcggtttctttggtggagctgcaggatctggtgagagagaatgattcccattaagtcatgtgcgttaagaaagattaagaggctgggggcagtggctcatgcctataatctcagcactttgggaggctgaagcgggcagatcacctgaggtcaggaattcgagatcagcctgaccaacatggagaaaccccatctctactaaaaatacaaaattagccgggtgtggtggcacatgcctgtaatcccagctactcaggaggctgaggcaggagaatcgcttgaacccaggaggtggaggttgcggtgagttgagatcgtgccattgcactctagcctaggcaacaagaacaaaactccgtctcaaaaaaataaaaaaaagagaaagaaggctgagcacagtggctcacgcctgtaatccctagcactttgggaggctgaggcgggcggatgcctgacctcaggagttcaagaccagcctgggcaacacgatgaaaccccatctctagtaaaattaaaaaaaaaaaagaaaagaaaagaaaaaaaaattagccaggcatggtggtgtgcaccatagtcccagctactcgggaggctgaggcaggagaattgcttgaacccgggaggtggaggttgcagtgagctcacaccactacactccagcctgggtgacagagtgagactctgtatccaaaaaaaaaaaaaggaaagagaaagaaaccactgctaaataaatgcctactgctgttcttacaaaagacactaatcttgcattctaaggaggcatttctttctttttttttttttttgagaccgagtgttgctctgtcacccaggctggagtgcagtggcgtgatctcggctcactgcaaccctaaggaggtatttctgatgcattataccaacaaattctttttcccaatactctagtaatgagctgaatgtggtaaacatcgtacttgctgtggtctgtagaggaaaaattaaccatgagggtattccaaagctacgacactatatacattcaaaacctgctttcatcaaattaaactaacttctttccgcccaattcttttcttctttacctggtttacccacaggctgatatatatgttggtttccaatctgtgggaaaagaaaagttcagtcaatgcactggtatatacacttgggcaatgacctctctcacccaccctgtctatccacccccttgaacttctaggctagattctagtgtatcaaaatgaacaaaacagggttctgcataaggtctcagttggggtgggggatcaggcaaataagcaaatgatgccaatagcatgtgtggaaagggctgtgagagaagcaagcatgggacactctggaaccacaaacacagtggtcataacccatttaaaatgttcttacacagctgaggagaatgtaaattagtacaacctctatggaaaatgaactagaaaaactcaaaatagaactacttatcaaagaactcaaaatagaactaccattcgatccagcaatcccatgactgcatatacgcccaaaggaaaacaaatcattgtatcaaaaagatacctgcactgctatgtttatcatggcactactcccaatatccaagatacagaatcaacctaagtgtccatcaatgaatgtctggattaaaaaaatgtggtatatgtatacagtggaatactatttaaccacaaaaaagaatacaattggctgggcacagtggctcatgcctgtaatcccagcactctgggaggtcaaaatgggcgataaccttaggtcaggagttcaagaccagcctggccaacatggcaaaaccctgtctctactaaaaacacaaaaattagctgggcgtggtggtacgtgggtgtaatcccagttacctgggaggttgaggcaggaggacagcttgaacccaggaggcagaggttgcagtgagccaagatcgtgctactgcactccagcctgggcaacagagcaagactctgtctcaaaaaaattaattaattaattaattaattaattaattaatatatatattcctgtcttttgcagcagtggggatggatgcagtaatgtgtaggccattatcttaggtgaaacaacttacaaacagaaaatcaaatcctgcatgttctcataagttggagctaaataatgcgtatacacatacgtaagaatgtggaatagtcactggggacttcgaagagttgccgcggtcggtgggggcggggggaacagcgttaagacattacttaatggcgccaggtgcagtggctcacgcctgtaatcccagcactttgggaggctgaggcgggtggatcacaaggtcaggaggttgagaccatcctggctaacatggtgaaaccccgtctctactttaaaaaaaaaaaaaaaaaaaaaaaatagccaggtgtggtggtgtgtgcccgtaatcccagctacttgggaggcctgaggcgggagaattgcttgaacctggtgggggcggaaattgcagtgagccgagatcacgtcactgcacttcagcctgggcaacaacagagggagactccatctcaaaaaaaaaaaaaaaaaaaatgacttaatgggtataatgtacactatttgtgtgatggttatactaaaagcccagacttcaccactatgcaatatatccatgtaaaaaaactgcacttatacaccttaaatttatacaaataaaaaaaatttgaaattttcttatatggatgtctccagttgacctctaaagggtttaaaatcccaggacttcccagtgtctgcatcctctcctgcctggcctcccaactatccttatcacaaaaacaggtacaaccagaaaaatgatggaaaggggcttggtagcactgggtgtgtagattcccatgggcctacattgtcatcacccccaaagcactgtgtgtgtcaggacctgttgttatacctccatcagttctaggccaagccagagaagccaaaccacagcccagaacttctgtcccaggtacaggataaagtttcacttaacaccagttctccttcaagttgtcatacctgaaactgcacttaaaatagtctttctgaggctaactacctggaaaaaaatctttttggaactattttctacttttgaaaagaaagacttttcttgcttactttaaaataatgaactggctaatagatataacctaagacactttactttctattgaaaagagatccacttctttacaatacaagtgctataaaaaatagcacacaaaattaaaattgttcctccctcacacaatcaagttgttttcaacatgtcatttaacacctctgattttaaagacttgcaaaaagtctcagagcttgaaggtatgaagaatgataccatatcaacttatttttgtgtagtgctttctacttcatatatcactatcatatcattcatttgttcaatgaacagttattgaacatccgctttgttctagcactgttctaggtataaaacaaagatcctgcctggggagcaaacagctaacaatgcagtggaaggagacaggtaataaacaatgaacatgtattagtatattctgtgttctgttaggagaagctgtgtcccacaaagaaaggagatggctgggatagaaggagaggaactacacgttttttggtattggttgattgattaagtgagtgactgagtctcactctgtcgcccaggctggagtgtagtggcacaatcttggctcactgcaacctctgcagcccaggttcaagtgattctcctgcctcagcctcctgagtagctgggattacaaacgcccgccacgatgcctggctatgtttttgtatttttggtaaaaacggggtttcaccatgttggccaggctggtctcaaactcccgacctcaagtgatccacccacctgggcctcccaaagtgttgggattacaggcgtgagccactgcgcctggcccttatttttatttttctgagacagggtattactctgtcacctgggctgcagtgctgtggcatgatctttgttcactgtagactcgacttcctgggctcaagtgatgctcctgcctcagccttttgagtagctgggagctgggaccacaggtgcatgccatcacacctggctagtttttatatttcttgtagagacaaggttttgccatattacccaggctggtttcaagctcttgagctcaagcgatccacccatcttggcctccccaagtgctgggattacaggtgtgagccactactccagaccaaagctgcagttttaagtaggaaggtcaggccttctaagaaagtgatccctgaaagggaagccttgtagcaacccgggagaagagtagcttcgagagggaggagtccagtagggcaaaccgaatgtgtgaggaacagcaaggtggtcagggcagatagagaggcgtgagggcagggaatggtggaaacgggccaatactttaacaacagacaatgtctactggctgtgctgtactcactgcttcaggcaataaaatccatgcccttttttttttaatttaaaaaatttttaaatttatgtggtgcctgtttccagtcagccagctcacggccagctgagtgctccccatgtttttttttttttttttttttttttttttttttttttttgagacggactcttgctctgtcgcccaggctggagtgcagtggtgtgatcttggctcactgcaacctctgcctcccaggttcaagtgattctcctgcctcagcctcccaagtagctgggattataggtgtgcaccaccacgcctgggtaatttttgtatttttagtagagacagggtttcactatgtgggccaggctggtcttgaactcctgacctcaggtgatctgctcgcctcggcctcccaaaatactgtgattacaggcgtgagccaccgcgcctggccccatgctcattttaaaaggtttaaaaatacaaagaactttctggttgatactcgggtaacaagaaagtttaatgaactagaaaatcctattctcagaacatcctggagtaatctagccaatgtgtgctcacgtacaacctgctcgggtactcaggtacagaaaaggagagactctgcttcagaagtctgacagtatgagtgtgtggagctaggcctcgtgcatggttctgtgcggaaccagctgtttactttggaaaagctgcagagctgttaggggctttggtttttcaatttgtaaactgaggctaataacacttacctaataagacaactgggttgtcatcacaaaatgaacatgctgtcaacctgtgtattaaagtctaaataaaagtttaccttttatgcacactgatgggatcaattttccactaggcagttattaatgtttactaactagttcacatccatttataatctacacggctttctagtcaaagggttctccctgaagccgtggcacatttctaaaagtgttaaagctggagtgtttcacaaaatggggccaaaaccaaattatcatctttaggaaagcacaaaagggaaaaaaatcaaatggtcatagcgtgttaacagtccccaggaaggcagtgaagtctgttgagcaaggctggctaccggtgcataaatgggggcacttaggcaagttttctctgagtcctggtctactcatttgtgaaatgtggatgacgacagtacccgatgtgtcaagagtgatgcgacacagtaccttgtagtactaagccaggacctcagttagcactaagcactcttactattgcctccacctggcacaaagcaaactgagatcttagttgggcccatcatgtgtcatctgattgtcttagaagttctttttttctaagacagagttttgctcttttggctcaggctggagtccaatggcacaatctcggcttactgcaacctccgcctcccaggttcaagcgattctcctgcctcagccttctgagtagctgggattacaggtacccgctaccacgcccggctaacttttttgtatttttagtagagacggggttttaccatgttggccaggctggtctcgaactcctgacctcaggtgatccaccgctcctggccacaagttcttattaataaagcagttctgcataatccttctatccaggtttgattaacaaatttacatttttttctgagtaccttctgtgggccacacactggaacacaaagaattttccttatctaacaaatttcctattagcaacgttctaaatagctagtatcttgaataggacttattttcacaccgattctcactccttcttaacaatttaggaccaactgctttttatgcatttgtctcttcaatacaaggaaggagctcagtgtatgggaatgttaaatggctgataatgcaaccttcttgctcgtgaactaaagaatgtcagccactgtgcccgactgggtgctattttatatagaaaaaatgtttgcaagattttaaggtaagtgttgacagttgcatacacacctgtgactagaagtcaactcagtagtttcacccttattagggtaaaactttaactccgtaagtctgctacctgacaggcacagcaaatgtttaaggaaatctgcatttaacttaaacagacatctgctgatggaaatttggcgttggtttgctcaaattagtaagattaagaagatcttaaattcagctgggcgcggttgctcacgcctgtaatcccagcactttgggaggccaaggcgagtggatcactggaggtcaggagttcaagacgagcctggccaacatggtgaaaccccgtctctactaaaaatacaaaaattaggcaggtggctgtaatcccagctacttgggaggctgaggcaggagaatctcttgagcccggtaagcagaagatgcagtgagccgagatcctgccactgcactccagcctaggtgacagcgcgagactccgtctcaaaaaaaaaaaaaagatctcaaattactcaaattaataacctaacatcacgccctgaggaactggaaaaacaagagccaaccaaccccaaactggctgcttccttatgttgaagaaactaatgtgtaacaagcagttggccgggcgcggtggctcacgcctggaatcccagcactttgggaggcggaggcgggcagggggggatcacgaagtcaggagatcgagaccatcccggctaacacagtgaaacaccgtctctactaaaaatacaaaaaattagccgggcgtggtggcgggcgcctgtagtcgcagctactcgggaggctgaggcaggagaatggtgtgaacccgggaggtggagcttgccgtgagccgagatcgcgccactgcactccagcctgggccacagagcgagactccgtctcaaaaaaaagcagttggtcctaaaacgttaggaaggactgggaattggtgtgaaaataagtcctatttctagcaggctttaacctatttatgctggaggttgcaaattttttggtgtggaaaaatcagacactggcgatgaccttaagcagtaggatataaataactctcacaagcttagcgttccaataatggaacactaggcataaataggttaaatataattggaataatcataagctagttctttaaagagaatttcaggcattctccccctgctacatccagaagaaaaaaatattgcttgaacaaattttctgtgattctggagacttttacaaccatgtagtaagagcataaaaatttagcaaatgggccaggtggatcacttgaagtcaggagtttgagaccagcctggccaacattgtgaaaccctgtctttactaaaaattcaaaaattagatggacgtggtggcacgtgcctgtagtcctagctactcaggaggctgaggcacaagaatcgcttgaaactgggaggcggaggttatcacgccactgtactccagctctgggtgacagagcaagaccctgtctcaaaacaaaaacgaaaacaacaacaacaaaaaatttagcaaatgacagcgtgtgttaacaacggctaatatgtgtatatatttcttcacttgatcttagccaaaaggctgagaagtgatgtacatatttctttaggtcacaaagagtttggcttattactaaaaggcctttattaaacaacagaatataaatgcttctcatctgcacatggtacatactctaaaataaaccacacaattggctataaaacaattctatagctaattaaaaaaaaaaaaaaaccgaaatcacaccaaccacactctaggaccacagcacaataaaaacagaatcagtactaagaagattgttcaaaaccatatgattacgtggaaattaacctgctcctgaatgacttctgggtaaggcagaaatcaagaaattctttgaaactaataagtacaaagatacaacacactagaatctcttgaacacagctaaggcagtgttaagaagaaagtttatagtgctaaacatctacaacaaaaagttaaaaagatctcaaattaataacctgacatcacaccttgagtaactagaaaaacaagagcaaatcaaccccaaagctaacagaaaacaagagatacccaaaatcagagctgaactaaatggaactgagacatgaaaaaccatgcaaaagataaatgaaaccagaaattggttatttgaaagaatacataagaatgactgatcactagctagactaattaaaaaaagagagaagatcgaaaaaaatacaatcagcaacgacaaaggggacattaccaccaaccccacagaaaaatacatagaactatcatagaacattatgaacaactctatgcacatgaactagaaaatctagaagatatggatgaattcctggacacatacacattcccaagactgagccaggaagaaagcgaatccctgaacagaccaataatgagctctgaaattgaatcagtaatagatagcctatcaaccaccaaaagcccaggaccagatggcttcacagttgaattttaacagatgtacaaagatgagctggtagcactcttactaaaaccactccaaaaaattgaggaggaggtactcctctctaactcattctatgaggccagaatcattctgagtcccaaacctggcagaaacaacaaaaaaagaaaacttcaggccaatatccctgatgaacatagatacaaaattcctcaacataatactggcaaaacgaatccagcagcagcacaacaaaaagctaatccaccacaaacaagtaggcttcacccctgggatgcaaggttggttcaacatatgaaaatcaattaaatgtgattcatcacataaacagaactaaaaaaaactacaggattatctcaatagatgaaaaaaaaaaaagcttccaataaaattcaacctcacttcatgttaaaaaccctcaaaaaactaggtaatgaaggaacataactcaaaataataagagccatctatgacaaacccacagccaatatcatattgaatgaatgggcaaaggctggaagcactcccctgaagaactgaaacaagaccaggatgcccactcttaccatatctattcaacattagtgctggaagtcctaggcagagcaatcaggcaaaacaaagaaataaaaggcatccaaataggaagagaagagatcaaacttctgtgtttgtagatgatgtgattttatacacagaaaacgccatagtcttggcccaaaagctcctagatctgataaacgagcagtccccaatcattttggcaccagggacaggtttcgtggaagacaatttttccacggactcaggggatggggtgggggatggttttgggatgaaactgtcccatctcagatcatcaggcattagagtctcataaggagtgtgcaatctagatctctcacatgcgcagttcacaatagggttcacatgcctacgagaatctaatgctgccactgatctgacaggaggaagagctcaggcattaatgcgggctagcccgccattcacctcctgctgtgtggcccagttcctaacagactatggaccaataccagtctgcggcccaggaagatggggactcctgtgataaacaacttcagcaaagtttcagggtacaaaatcaatgtacaaaaatcagtagcatttctctacaccaacaacatccagttgagtgccgaatcaagaatgcaatcccatttacaacagccacacacacaaaatacccaggaatatagctaaccagggaggtgaaagatctctacaataagaattacaaaacactgctgaaagaaatcagagatgacacgaacaaatggaaaaacattccatgctcatggataggaagaactgatattgttataatggtcataccgcccaaagtatggtcgtaccgcccaatggtcataccgcccaaagctttacagattcaatgttgtacctatcaaactaccaataacatgctttacagaattagaaaaagctattctaaaattcatatggaaccaaaaaagagcctgaatagtcaaagcaatcctaagcaaaaagaacaaagctgaggactttacattacatgacttcaaactatactacaaggctatagtaaccaaaacatcatggtactggtacaaaaacagacacacagaccaatagaacagaatacagagcctagaaataaaacttcatacctacaaccatctcatctttgacaatgttggcaaaaacaagcaatggggaaaggactccctattcaataaatggtgctgagacaaccagctagccatacgccaaagaataaaactgggacccttccttacaccatatacaaaaatcaactcaagacggattaaagacgtaaatgtaaaacctagaactataaaaacccttgaagaaaacccaggaaatactattctggacataggcccttgcaaagatttcatgacgaggacaccaaaagcaactgcaacaaacacaaaattacaaatgggacctaattaaactaaagagcttctttacagcaaaaggaactaagagcagaataaacaactcacagaatgggagaaaatatttgcaaactgtgcatctgacaaaggtctaatatccagcatctataaggaacttaaagcaaatgaacaagtaaaaccaaacagccccattaaaaagtgggcaaaggacatgaacagacacttttcaaaagatgacataaacatggccaacaagcatatgaaaaaatgcccaatatcactaatcattagagaaaagcaaatcaaaaccacaatgagatgccatctcacaccagtcagaatgtctattattaaaaagtcaaaaaattaacagatgcaaggttgtggagaaatagaacacttaagacactgctggtgggaatgtaaattacttcggtcactgtggaaagcaatttggcgatgtctcagaacttaaaacagaagtagcatttgacccagcaatccccttattgggtacacacccaaaggaatataaatctttctaccataaagacacatgcatgcttatattcatcacagcactgttcacaataacaaggtcatggaatcaacctcaatacccatcaatgatagactggataaagaaaatgtggtatgtatacactatggaatactatgtagccacaaaaagaatgagatcatttcctctgcagcaacatgggtggagctagaggtcattatcattatcttaagtgaactaatgcaggaacagaaaaccaataccacatgttctcacttataaaggggagctaaacactcagtacacacggacacaatgaagggaacaacagactccggggcccacttgagggtggagggtgggaggagggtgagaggagggtgaggatcaaaacactacctatcaggtattatgcttatcacctgggtgccaaatgacctgtataacaaacccttgcaacatgcgatttccttatataacacatctgtacatgtacccctgaaactaaaataaaagttaaaaaaaaaagcctttatcaataatagtgcagaaaacttctgtatctgaataaaaattctaggctgtacatcatagattttcataatcttaaaatgttaactttatagaatattctgttccctattacaaatattagtaaacttggatatattgtgacataaacactgatggtccacgcacaggagaactggaaatcaaatcctgctgaaaactcaggcttaccggaccctgaagacttccatcctccctgtcaatactgcctcgagagagtctcacatcaggtttctgaagaaattaaaacaaaatcaaaacaatttcatttttgatttgaaaatttttgacagattctgtattaaattccttcctttttaacacaattgtcctctgaataagaagagttgaaagttcccccgtttcaaaaaaattccagtgatgataaatgaaggttggctgccttgggaagaactgcattcctctccacacacgcacaccttacagactggtacctgcactggcccacccagtgctggagaacctgcactttacctctattccaagtagcacagatggctttcttcttcactgagatacccgcaaccccaggataaaaatatcaggcattacttgcggctttctgacagaatatggcttatacggatttagctgtcttgccaaagtagcaaatgagttcaattacaagactgttttcccacactgcatctagaatatagaaaccaaacagagaaatctagattttacgtaaataatagtacggaaatttcaccaatatcagaataaacgaagtaggctacgtgcctttatggtgaaggaacagggcagaaaggcttttcctcatgaaaacaaccccgtgctcccgcagtatgggttacgggccttctaccacagtggctcctgcctcccctttgcccgtgaacactggccacatacttcttcccggaaaacttctgttcactcttcaaggctgagccagacaccctttcttggcagcatatttccctcttcaagcagagctggtcgcttcttagcctgtgccttacagatacctctatgttggcacctatcaggcataattacttccctcattagagatggagcatcttgatgtctgattcgtctgtgtatctcctatttcccacacctgagcctgccactgagcacaccatctgcaagcacttgttgggtgggggatggagaaatgagcttcacctctcccttcttttccaattccaattccagtgctgtagcccaaacccttttcattgtatcagttcctactaggctttttgtctctgtcttaactatctctaatcaaagcggggtcagtcgtgggtgccagggtgtagtaggaagttggtgaaggacacggccaccattaaggtaagagtgatcctctgatggctcagaggtaaaaacaaactttccagggcaggggccctgcactgtcctttgccttcttcctcccttccccctttccttccctcccaggcacagtgcctggaggtagctggctgaggtctgagaacagctcctaccaggaagtgggtaaaggagctcctgatggctaatcactaaaagggggctctggctgattgttgttaacagtcctcagggattccatatgggaaaaggtgaaacttgtgtgttgtccctgaatttagggcagattttggatcacttatggaaaaacattctaataatcagaggcatcctgaaacagaatagacagccctgacagcagtagcagacagtaagcaaagagggcaaaagtcacaacttacttatctgttcattcaacagaattacaaaacagctcatgtatatcagccccatatccctagtgcctggcacagttcctggttggtgcgcactcaacacatcagtgttgactgaattaacctccatgctactatataaaaaaacatgttccctttcacgtaaaaatattcatttaaaagcaatagttaaatatagatgaaaaatgacctaaatcctcaaatgtagcgttgggtgtggtggtgtgtgcctgcaatttcaccttatctgggaggctgaggtgggaggaccctttgaggccaggatatcaagaccagcctgggcaacatagtgagaactcatctctacaaagaaaaaaattttaacaattagctgggaatggtggtgtgtgcctgagtcccagctactggagaggctgaggtggggcgatggtttgagcccaggagtttgaggctgtagtgagctaccattgtaccactgcactacagcctgggtgactaagcaagactctgctctgttagaactctctcaatgagtaaaccagaaaagttcagaataaatatttctgaactctgaagagcataacttaaaacattgtactgtgtttatatgtactataatatcaaggaacaataatttaaaaaatgaattcttactgcagatgtgatatatataactaatgcccatacaggggaagtcaaacctagaggcatgcagttggcgactatggcagaaagtatgctgtgttttttaccagagaggactatcccattagatatagacagctgtggctgggtgtgaaatatagctcaagagaaaattcagaggtaggtagttcctgacttctaggatagaatcttctctgacaggtaagatagacatgaatagacagaaaggaaaccaagcaaacacacgtaatacattgattccaactggcaactgaaggggaactcactggggaggtcctattccatgtagcagaactcacagatcctattccatggaatgctgaggttctgccactgcctgaatgaagaggcagctttgtggggcccaaacatcccagatatgcttaagaaaaaatattccaaaacacaatggactttgagaaaaagtacctgagaagacgagactccaggttgacaattcacagaacattactcaatgtaaatatcaaggtcaggaaagatttcgggaagacccaggaactgttcaagcttaaaggaaactcaagagatgtgataactaaatataactcatgatccaggacttttttctagaaagggcattctgtggacaactggtaaaatatgaatagtccattgattagctaacagtattgtattattgttaatttcctgacattggttaactcagctatggttatttaagagaacatccttatttttaggaaattcacattgaactatttaagagttaaaaagcaggatatctggtatttacttccaaatggttcagaaaaaatggtatgtacaaatatgcaaagcaaatgaggtcaaatgttaacaactggagactctaggtaaagggaacatgggaattctttgtaccattcttgtaactttaaaaaactctgaaactatcctttcctcttctgcccattcacttgagggaccagctgggagctggttctgcttaggggttctgttgaagggctctaaacagagagtggaggtgattaggtttgactctactgtagcagaaaggacaagtttttattttcattttttatttatttatttttttgagatggagtctccctctgtctcccaggctggagtgcagtggcatgacctcagctcactgcaagctctgcctcccgggttcatgccattctcctgcctcagccttctgagtagctgggactacaggcgtccgccaccacgcccggctaattttttgtattttcagtagagatggggtttcactgggttagccaggatggtctcgatcacctgacctcatgatctgcccgcctcggcctcccaaagtgctgggattacaggcgtgagccaccgcgccaggccaacagtttctatttttaagagacagggtcttgatctgccgcccaggtcagagtgcagcgactattcacaggcacaatcatagtgcattacagcctcgaactcctggcctcaagcaatcatccgcctcagtttctggagtagctgggactatacatgcacgccaccacgcccagttagagctatagtctaagaaaacaaaagacccaccaggcccaacttacgatgtggtcatttaatagttacatgattttggttattttaaaatattgtatacctcatttgtcaataatctaacaaaagaaacatgcacttactgtagaaaaattaagatactgcaaaaatagatgaaaaaattacaaatcactcaaccttaccatttggaagtaattatcattagttattatggagtaattaaaatgtaaaagtaattatcattagttaatactgtggtgtaaatgtatgtttacaaacatggaaccacaacatatgattctacagccttcacataacatttatatagggcaaactgacaaaacaatgtttaaggctgcacaacgttccactgcatgattatcatcataaaatagacaatggtagtgaagggtgggagctgtggcaccaggtggcctgggttctaatgaggatccagtccttacaagctgtgtgacctgggcctcaatttcttcatttctaaaatggaacagtaattgtaaccaacacataggattgttaggaggatgaaatgagttaatatttgcaaagtactaagttggtgccacacaagagttaaaataaatagttcttttattgttggatattagggtcattttcaaaatccctcataaataggctgtagatgaacacctttgtatacaaatctttgactaagtccctgattatttccctgggacagatttcttttcttcttcttttagagatggttgggggtggggggtctcactatgttatccaggctggtcttaaactcctgtgctcaagtgatcttcctgtctctggagcagatttctaagaaaggaattactaagtcaaagagtttgaacatttgaaaaatcttggtataagtttccaaactgctcaaggctgtcctgattttcatctatgtagcaatatgtgatagcatttctctcactgtaccctaacaccactgtattatcattttaaaactctcaaccaattcataaagaaaatactgtataatatattgttgtaatttgctcctctcctcctccctttccccaaatagttgaccatttttgtttcttatcatgagatgctaagttccatgaagacagaggctatgaagctgtctgcctcaccgctgcgtctctgttacctgctagaacaccggacaaacaggtggaggaaatgaatgccctgtgcatttttctagtgaactgattgtccatgcctctttggacaaggcatataacctctctaggcccagttcctcacctgtaaaataggcagaataatacctcagtcagtcattatcagaatgaaagaagtgcctggcagcattgtgcacatagatgtgtagtaaatatttgctgaaggaatgcttcaattaatatccaaggcacaagagatatgttatagacgaggaacttgacttagaaagatttagttgcttggggtaacacagctcttaaacagtggaggtgggcttcaatcagtcaacagataataagaaccttctacaggcaggaaatatttactgttttacttaaacaaaaaatgcaactcatatttttgcctatagaataaggtattgtttcatgtgtttacatgaattaatctatttttatttccatatacatttcatgaaatgactttctttaatgcataattccctaatgtggtattttcctaaagacaggattttaattttaaaatgagaaaggcttatccatataaaatctacttgtgttctgtgaatgaaataaatacttgagctttttcttttcatagagcatacacggacctcctgaatgaaagatgagtgcctattgggaactgaagagcaatacagccaaagacagccaatcagaaagaatagattctcagccaggtgcagtggctaacacctgtaatcccagcactatgggaggccgaggtgggtggatcacctgaggtcaggagttcaagaccagcctggccaacatggtgaaaccccatctctactaaaaatacaaaaattagccgggcatggtggcaggcacctgcagtcccagctagtcgggaggctgaagcaggagaatcgcttaaacccgggaggcggaggttgcagtgtgccaagattgcgccatttcactccagcctgggggacaagagtaagacttcgtctcaaaacaaacaaaaacaaacaagccaaaaaaaaaaaacagttcggcttagctacagtctctactttcatgtgggtatggctctagaaaacttcaaatttaaggtttatagctcagtcttttctcctttcactatactgtattgctttcaaatctggaatctggtatgagggaaaaaataggagagctgttggccttgctgcgtagcagaagcagggacagcagcctggcttcagacagacagcctcttgccactgctctttagttccccgtctcggcattcatctttcattcagactgactggatctgctatgtgagggaaaaatgctcacatatttctttctcaaaacacaaagtaggctttatatagatagggctttctcatttaaaattaaaatcctgttttaagcatagtatcacattagaaaattattgtgcatgcagtaataaaaaaaaaaagcaagttgcaaagttactctatttttaagcaatgcccaatgggaaagaaagctctttcaaccaactgaggttctaactaaggttgccagcaatctctggcactcactttgtaggacagctttcagagtatatttgcaggcacagaactatttcagaaaggacagtatctgatctgggaacaagaaaagggagtgtggggccaggcgtggtgactcacgcctgtaatcccaacattttgtgaagccatggtgggagaactgcttgagcccaggagtttgagaccagcatggacaacaaagtgagaccctatctctataaaaaaaagtaacaaaattagccaggcttggtagcatatgcccgtagtcgcagctactctggaaggaggctgaggcaggaggatgacttgagcccaggaggttagggatgcagtgaactagtattgtgccactgcactccagccagggccacagagtgagactttgtctcaattaaaaaaaaaaaaaaaaaaaaaaaaaaaaaaaaaaaaaaggagcactaggtatagtacagagtatctgctgtggggccatgtgaccttgggcaagagcatccgggctgctatcataaaacacattctgtgcagggttgttgagataatgcagagatccagaggagggactcctgacccactgaagtactcaaaaagtaagagatgtgactagcagtagcaaccataaaaaatgatgtgatgatgtgatctctgaaaacagatgtcaaaacagatgtcttctgacatctaaaatttgggtaatactactgacaaagcaagttaatttttcaaacaagaacagaacttatctaatagggtgcacagctgaccttactgaagtaaatggcagggccagagcagtaggcctgggtgggtctaggaatgaaccagtttatgaagatgaaaacagaagctaagcatctttttttcttttcttttcttttttttttttttttgagatggagtctcgctctgtcgcccaggctggagtgcagtggcgcgatctcggctcactgcaagctccgcctcctgggttcacgccattctcctgccttagcctcctgagtagctgggactacaggcacctgccactacgcccagctaattttttgtattttttagtagagacggggtttcaccatgttagccaggatggtctcgatctcctgacctcgtgatccgtctgcctcggcctcccaaaatgctgggattacaggtgtgagccaccgcacccggcctggtaagcatctttagacatttttatagcaatttgaaacagtaatttttgggctgtcaaaaaagtctggcttatatttttatgtctttttctagtcaatgattttgaaattttattttacaagagtattggtctgcaacggtttagaaagaaagatacaaactggcccttccatgcagtctgagaagccctgtattggaagtttccttggcctaacaggagagaaagacttctgacacacagcttcaacaatgacctgattaacctaaaagtaggtgcagcggcctggcctggtggttgcaaggacacagaccaatagctctgggcctagctcatgccaaaggccaagacccagaaacaagcttgtaaatagcagataccatggaaaccaacagtaatttttacacatacacagcataaaaaggaccacaacgagatataattaccattgttagagtctcttcaccaaattaaggaccataaagcacgtgtgctcataaccagagacctagctgccaccatcaccacttgacagtgtcacgagagcttctacaaccgacacacactaccttccaactgacagagggtcagggtggccctcacactacaccgcaccaggcgttattcccagtgcaccaagctttccatgcggctgtctaaaaatctgcatctccagcgcagaccacctcctctgggctctatgccctatatccagctgcctcctctgcattcccatttgcatatcccaaatgtccaaacctggcatcatcatgtttccctgacatggactcctcattctgaattttatttcatttggtagcacaatgttatttttggtgacaccaatgctatgattcctgtcccggattcttccttcctcttgacctcctataccaattcaccaaatcttgtcccttttaagtccgtcttctctgctccttcccactttgcctcttccagcttagaccctgctgtcatttatttgaatgaccactcaacttcctattggatctctgcatttcctatcttgccttctgagccatcagtcagcaagcaacgctaaggtggtcctattttttttttttttttgagacagagtctcactctgtcacccaggctggagtgtagtggaacaatctcagctcactgcaacgtctgcctcttgggttcaagcaattctgctgctgcagcctcctgagtagctgggattacaggagagtgccaccacgcctggctaatttttgtatttttagtagagatggggtttggccatgttggtcttgaactcctgacctcagatgatccatccgcctcagcctcccaaagtactgggattacaggcatgagccacagtgcccagccctaaggtgatctttctgagatgccatctgcttcaaatcttgaaaagcattgccaagcctaagtaatcagagagtgaccttgggaccacgtctcaacaatcaactggggtgcttgttatctctctaggtccttggcctctccagatccactgcagttctctagtcctggggaactgaattttaaaaggtcccctgtgacttttatgtatattaaattttaatttattcatttctaaaataattataatatctacttccccagggttcatgtatgacttgtttttatttttcatttagatgaaaaacagtgacaccaatgctatgattcctgtccgggactcctccttcctctgggcctctaacgtttagatgcttaacactgtacggtggtacattcattcattcgcttaataaatgctggctgagccttattactgctgaacaaacggtacgatgggagctgggggagagtgctgaataaagaaagttcccatctttgtgatgcttacactttagtggaggagacaggaaaacaagtgagacattgtcatacagtgagaaacattagaagaaaaatgaagcaggataaaggcagttaagtcacagttgttgcccttaaggaacttacgttttattagagaaagagagtgagagtgagcatgtgtgagagtgcagggggttgggggagagaacgcagtagtgcacatcataataaaataagttaattcaagcttcacgcttggcgctcagtaaggttctctggcaccttgtgggtagaggccagggatgttgctaagaactcctactattcataggacagcctcctacaacaaagaattacccagccccagaggtcaacaatgcccaggctgagaaaccctggtgtagggaatgtgtcgtccttgagatgacacaaaaataatctttaaagacaaaaaggtgttcctcaggcagattccctgagcattccaggcagacacagcagcatgagaaaaggcatgagttaaaaaacactcatttacaaaaagaaaaaaataaactcataaaagagaaaaaagaaactttcatttaatcagtcaacactgacagctttccatatgctcggcatggtggactgaatggggaataggaaagacatggtccatggtctctgcactcatggggtgctcagtctaagtaaggaaaacaagcaaagagaaaaatacaataccatctcacaggcattaagaaaggtacttgttccagcctggccaacatgatgaaactctaccaaaaatacaaaaattagctgggcgtggtggtgcgtgactgtagtcccagctacttgggaggctgaggtgggaggacagattgagcccaggaggtcaaggctggagtgagccgtgattgtgccactgcactttaccctgggtgacagtgtgagaccctgtttccgggaaaaaaaaaaaaaaaaaaaaaaaaaggaaaggtacttgagtgggaaagtgcctcgatgccatcatggcctccaagtttagcaccaggcaaactatctcagaggttacccaacagacaggtttaggaccaaatgaagatgctccaattacatggttattaagttaaaaacaaaaacaaacaaaaaaaaaaacaccacatagtgagaagtattttccatttccccacaaacatgctctgctttgctcacatctagctacaggaagttcttagaatacggtttgtgtgtgtgtgtgtgtgtgtgtgtgtgtgtgtgtgtgtttttaaacggagtcttgctctgttgcccaggctggagtgcagtggcacgatcttggcttactgcaacctccgcctcccgggttcaaacgattctcctgcctcagcctcccaagtagcctggattataggcatgccagttttgtatttcagtacagatggggtttcaccatgttggccaggccggtctcgaactcctgacctctgcctctcaaagtgctggggttacaggcatgagccactgtgcccagccagaacagtctttttttcttttgtctatcattcatatatatttctgttcctttgtatgtcttgtaattttttgttggagattagacattttagataatatattgtaggaattctgggtacttgatcctcctccctttagggtttactgtttttttttttttttttttttttttttttgccacagggtcttgctaagcccaggctagtctcaaactcctagacttaagcgatctccctgcctcaacctgccgagaagctgagattatagtcactgtgcctggctggaatatagccttttgactccatgtcattacccgcactcttcgctcttcctggaatgtatttcctgagcctgtctgccctaaaaattccaatttctcctttaagctttggctcaaatgctatctatactctgctgcctcccccaagtccccctagtgacacacagggtcctcttctgctcttccttatgttcttctttgtcagagcaacatcacagcagtaccacaacatttggtagcaaaccctttgtccaaatgcagtcatacgtgggactgaaatacaagaactctagtttggagaatttataatatctacttttaaaaacacaaatcaattctgtctggtaaaagaggctatctagacaaaaaataggtttaaaatgtaggactagagaacagtagatatgttcttagaatagatataatatccaaattaattcactcagattagtggtagtaaataataacatattttttctttttttccagacagagtctgactctgtcacccaggctggagtgcagtggtaccatcttggctcactgcaaccaccacctcctgggttcaagcaattctcatgcctcaacctcctgaatagctgggactacaggtgtgtgccaccatgcctggctaatttttgtttttttgagacggagtttcactctgtcacccaggctggagtacactgcgccatcttggctcactgcaacctccgcctcctgggttcaagtaattcttctgcctcagcctcctgaatagctgggattacaggcatgcatcaccacatctggctaatttttgtatttttagtacagatggggttttgccacattggccaggctggtctcgaacttctgacctcaagtgatcagcccgcctcagcctcccgaagtgctgggattataggcatgagccactgcacctgcctaatttttgtattttttttttttttttttttttttagtagagacggggtttcaccatgtgggctaggctggtctcgaactcctggcctcaagtgatctgcccaccttggcctcccaaagtgctgggatggattacaggtgtgatccaccgtgccaggccaaaaataacaatttttttttcccatctgccttacaatctcaagatttgctttaattcagaaggaaagttttatcctatgctttcgaaattctaaattagttaaatttaacacaaagttagtgtcagtgaatgtttaatgatacaaagcatgagagaccaggtaaagttactggctcaaaattatgaatcctggcttctttcagccataatacgattgaggcaactacaggaagattgaaatagctattctgggttcaaggagagtggggaatgggttctcacagtccttagttctgaggctgagggcatagaactgcttggcaacagggaccaggagtctaaaaggacctttgtgtcaagtaacatacagagattgctctgtcccaccacttcctctctgtccccaagggacttctgaagtggttttcaataagggttgcctgaaagaagacatttcccatgcatatgtccagacacatccgggaggaggttcacatcagtcataaatgccaggaaggcaaatcttagctgtcttgttatacagcctgcagtagcaagatgcaatagtttatacgtaagctgacatggaagcaggagttgtttctgggtaaacaatgtggtaatgcaaaaaccaaacaaatgctcatatttctgagcccataatgacactactaaaattttagagaaatttatccctaaaagataattaaaaaagcaaataacccattattgcaagttttttttttttccttaggagacagagtcttgctctgtggcccagggtctctctagatctctatttcctgttctgttaaaatgaagataataaatggacaggtccacattcctctatcctcatttccaaaacctaaaaagtgctgaaaatgttaagtgtgttttttatgtttgaaacaaactaatatggtagtaaaacctgaaccgatgaagcatcttataatcttcatttaactgttaatgtgattatttgcattctgctgcagaaacactagtggttttaactctgggatgctattagagtcttaaataatgtataatgttcagcatactacactaactttttagtatttaaaaaatactgaattctgaaacacacatggcccttaagggttttggatataggattctggatctattagagggcagtggcacaatcatagcttaccgtaatctagaactcctggactcagtcttagcctctcaaatatttgggactacaggtgtgagccacaatgcctggctaatttttttttttattttttgtagagacagggtcttgctgtgttgcccaggctggtcttgaactcctgggctcaagtgatcctcctgccttggcctcccaaagcactgggattttaggcattaaccaccacatccagccatattatttcaagtagtttttttttttttttgagatggagtttcactcgtcgcccaggctggaatgcaatggcatgatctcggctcactgcaacctccacctcctgggttcaggcgattctcctgcctcagcctcccaagtagctgggattacaggcatgcacccggctactttttgtatttttagtagagacagggtttcaccatgttggccaggctggtctcgaactcctgacctcaggtgatctgcttgcctcagcctcccaaataggccaccatgcctggcctattccaagttttaagaagtagttgtaaaactaactctcctgctttgaaagataacattttgcaataatttgcaatatagtagactctaacagggcttaaaaagtcaaagaagcctttcagaaacacaattaccagaaatctttcctctttttccagccagcgctgatcttcttccatttcctgttgctgtcggattagacgctcttccatcagatgggttggcaacacttgcccaatccctcgcaggtccaatactgtagagtcctggaagaagggttgaaaacagcatattcagtctcataagtctattcctatgctcttaccttgttttatgtgtctttcaagaaaagataagcaaaacagcaagtatgagaaacaggatctctcatactgtgcttgtgggaataacttttctgtagggggcaatttaatgtgcatcaagcatctttaaaaagtatgcaatcctttagctcacagattcacttgtaagggtctattttaaagaaataacacaagatatgtgcaaagaatacattgttacttatagtaaaaaagtagaaacaatctagaagtaatagaaggctgaaatacaatacatattacagagtattaaatattaaataaaagaacataaatagcagacaactatagatgctctttcattcaaataagtaattttttgtctttttaatgagatggggtcttgctatgttgcccaggctggcctcaaactcctaggctcaagttatctacccacctcagcctcctgagtagatgcaactatgggttgtgttactgtacctaggtcaaataaatttttaaactataggagtagttcttggttttaccaagaaaatttagtaaaaattaacatggtccaaagaactgaatgctctgtcttcctgtttcttcgttggcctcatgtacatgctgacgatagtccacttagggctttgcctttcaaataaatggactaaagattttagtatttctccctgggttcttttagttaaaaaaagttcattaaacctgaaagcatttgagtagatggggtatcctgatctttgaattaagtcattaaaatatgaccgggtgtggtggctcaagcctgcaaccccagcactttgggagggtgaggtgggtggatcacttgaagtcagaagttcgagaccagcctggccaacatggtgaaactctgtctctactaaaaaatacaaaaattaactgggcgtggtggctcgcacttgtaatccaagctgctctggaggctgaggcgggagaattgcttgaacgtgggaggcggaggttgcagtaagccaagatcgtgccactgcactccagcctgggagacagagtaagactctgtctccaaaaaaaaaaaaaaaaaaaaaaaaagtcattaaaatcaataaatcttaggatttagaaataaaaggtaccttaggccatgctttatttattacctttttttttttttttgagacaagctcttgctctgttgcccaggctggagtgcagtggcatgatctcggctcactgcagtctcgacttcctaggctcaaatgatcctctcaccccagcatcccgagtagctgggactacaggcacataccaccatacgtgactaattttctattttttgtagagacagggtctcgctatgttgcccagtctggtttcaaactctggggctcaagcaatcctcctacttcagcctcccaaaagtgctaggattacaagtgtaagccaccatgcccagctttgccatgctttataagttaacaaactgaagcccaagacacccgatttacctccacattgggctgccacattgctatctcctgaggtctatgattccatgaatctgtttggtccaaaagagatgcctgacctggatagatgctgccagccatggctgtgattccatgtgaaccagggtagccagaaacctgtgaatgagtaaggaggcaaggtaatgttcaactataacatctgcacagttctgcttcacacacaaaggaaactaaaattacagagaatattgtggtaggcagaattatggccccccaaagatacccatgttctaatcccttgaacatgtgaatatgtttccttacgtggcaaaagagactttgcagatgtggttataagtcaaggaccttgggatgggagggtatctgggatatctgagtgagtccagtgtaattacaagggtccttaaaagtgcaagagggaagcataagaggagggagggacaatgggaccactgaagaagggtcagagagagttagtactgctggctctgggccaggcacggtggctctagcctgtaatcctagcactttgggaggccgaggcaggcggatcacaaggtcaggagtagcctgtagtcccagctaattgggaggctaaggcaggagaatgaacccgggaggcggagcttgcagtgagccgagatcgggccattgcactccagcctgggtgacagagagagactccgtctcaaaaaaaaaaagaaaataaaaacttctggtttcagaacatggagtaaggggaccatgagccaaggcatgtaggtgccctgtagaagctgataaggcaaggaaatggactctcagctaaaatctcaagaaaggacatttgttatggctgcattagagagctagtgcaaatatatactagaaaacaagaaactgtttctttggaatttcacatttactaaaataatgagggcaggccatccttggatgcaaaagcaacaggaagccacaaaaatgtctgtgccatactttgctctagaaatcccctttcctgcccaacaaccactatcccccaacaagaataacaacaacaacaaaaatacacaaaaaatcccccaaatgtttgtcctctaatgacctgggagctgatggtagggtaagtcgtacctttaagttctaacaatgatgactaaggcagagagaagacattcagttggacatagagaaaaatttcaaggcagagggaaaataagatgggtttctttacatggttccttctctcaatcaagagaaagagaacagaatcagtattggtttccacacctcattaggctagtgttgtatggtgggtgttgtcagttaattttttagtgagataaagcacagccaaaaccgtatttccaaatatcaacacatccttcaacaaaggttttgtgcatttattaggtctctaggcattaatttataccaaaatttcatatggacaatatgaaattaatgaatcttcaagtaagacatatagttagttctcacagtttatttgaatgaaaataataataaaaactgctactaaatgcaaaatgctctatcaagatttctggtgaaaagggatgtattattgccagaaaacatttaggaattttcacaacaaggaggtttaaaatggtctaaggcagttttctacataatagtaaccatgtagaaggatcactttaggctaaaaatgaagtaacatcaggaaatgtctcatagttggtctcatttacaagagaggagaatttgggcttgggaaaggttaatcatacattagttcaatgaaaaaaatcaatgttttacttaattctctatttactcatttttacacaccgttctaagcccttagagacaagtccccactctcaggggcttccactgcactggtgacagacagccactaacaaacacgtactagagtttcaaatcttgacagtgccgcagaccaggcctgctgggacacaaagagaactgtctctctgctaacagcttgtctcattaagcaggtgctgcatgttttctcaaaacaatgctggtattcaattcccactcagggccagttcactttccataccagccaggcacagactcgggctgttcccctggggcccatctgcttgtctgccagaggtcagggtctctcagcaatcatagaggtggggtttctttctttaggccacctacgtacttcccattgctctgacccttgtgctgggtcagggttttggcttcttcacttatggaaatggtagtaatccaaactgacaaagggccctgtgagctccttccatgagaaaaaagagtactttatttgtcttcatattcccagtccctagaatagtaccaggcagagtagatgaacattcagtgcaaccttgctgaatgaacagacaggtgccctcgaaaactcaaatgattcactcttgactctgccaggcaagtggccatctcagaacagtgtctcccaaaacacaggtctgagtcatctgcctcagaacctactgaggctgcttgttaacaataagctattcttgggctccagaattagacattagaatctggcggctagataaagaggctaaaatttgctgttctaaactaccactgacatatcttttccaataagaaagtgcttacattctcccttattactgacagttaagtaccaatagttaagattttttgcccattttgacccaagaggccttaatttaaaccacgctttcaacaactctgtgaaggaagtaggaaaggttaagtactgacaccttcaataggactctgacttctacagacattacgagtaaaaaaagataagccctaaaaagcacactctatatgatctatttatataaaattctagaacaggcagaaacctctgatactagaagtgagaagaatggttgctcctggggcaggaggtgcctgatgggaaggggcacaaaggaactgccggggtcacagacacgctctatatcctgaagtgaggatgggatgcactggggtatgcacctctcggaacaaagacctgtgcattgtaaggtataccccagtaaaagttaataactttttctcaaaaacaaatgaattgtttactttgtgtcaagtccttttctttgaaggataattttttctaatttgcacaggatatctatctataaatctaacacttttcacacttgtccatatggtatttcatctgggttctgttaattttgaattttgttcttgccttccataaaaactgtccagttcagtactccctctgcagtgtgtgtgcccactggcttcaccttgccctttaccacagcaagtggatgaaaacgtgcctaagaatggcagcaggccctggtcctgcccactcgaagatggagtgaaaaacaaacgccttctgcgtggggtgtcaagacaacatcattcaatgattagggtaaccactttctcagctttctatcggccaaatcatactcataagtacataaataaaaatatgcacaatgtaccgctctaccccaaaagcgctaaataataaaataacacagtttatatctgtaatgactggcatacctggtaatgattggtttgtaccatgtgctgtgggctgggataaaatccttcgctggacctcggactgggataacccggtctgctgggctgtaaaatcaagagagcatcatatgaatgaaccttttgattttgacaaacctgtactttatgaatcgaaaaagacattttcctaatagagcttacttgaaaagaatgataaaaagatgctaagacatttcaatagggaaagaacagtcttttcaacaaatgatgctgtggcaactggatagctacatgtgaaaaactgaagtctgacctcttcctcccacatgcacaaaaattaactcaaaatgaattacaggtacaggtctaaatgtaaaagttaaaaactaagattcttagaagaaaacttaagagtatatcttgggcagggcatggtagctcatgcctgtaatcccagcactttgggaggctggggtgggcggatcctttgaggccaggagttgaaaaccaatcaggccagtctgttgggaatgtaaaatggtgtagtcactatggaagacagtatggctattccttaaaaattaaataaagaattagtatatgatccagcaattctactttcaggtatatgtaaagtccagagacatgaaaatatatatccacacaaaaacatgtagatcagctactcaggaggctaaagtgagagagttgcttgagccgaggaattagaggccagcctgggcaacgtagcaagactgtacctttgaaaaaaacaaattaagtaaacacaaacatgtacatgaatgttcttaacagcattattcacaatagataaaaagggggaacagtccatgtccgtcaactgatataactggataaacaaaatgctgtatacctacgaaagggacattatttgtaattaaagggaataaaatactgacacatgctacaacatggatgaatttttgaaacattctaagtgaaaaaagccagtcacaaagaacatatgatttctttaatgaaatatctagaataggaaagattaatatagatagcaagtacataagtggttgccaggggttggaaggaggaggagatggggaatgactgctaatgggtgaaggatttcattttgggggtgataaaaatgttataggctgggcgctatggctcacgcctataatcccagcactttgggaggccgaggtggatcacacggtgagaccccgtctctactaaaaacaaaacaaaagtcctaaaactggttgtggcgatggttgcacaactctgaatatactaaaaaaacatcgaattgtacaatttatttatttgagttgagactgccgtataggctggagtgcaaggtataatcccggctcactgcaaccactgcctcccgggtttgagtgattctcgtgcctcagcctctcaagtagctgggattacaggcagcggcacctcaccaggctaatttttgtatttacagtagagatggggttttgccatgttggccaggctggtcttgaactcctggtcttaagtgatctgcctgcctcagcctcccacagtgctgggactacaggagtgaaccactgtgcccagccgaactgcacactttcaatggataaattgtatggtatgtaaattgtatcttaataaagctattaaagtatcattaataacaaaatgggatactgaatattctgagcctgagggacccaaatgctctctgtccagtagtctgggacctggagagaaggcacttgtgttctattgtttgactacttcccggttgcgtgactgtgatcaagtgacgaaactgactggcttctagttcctcacccataagatgggggtgagctacaggatctctaaagtcacttccaggtcttaaattctcattttgtttgtgggataaatgaattcaaagttcatagtgaaagaacaatttagtctgaaacagaagtctgaaagaagtcaataaagtcttttaaaacttggggggtttaacaaggtggaaacccattactgtctagccaaattaagtacagaataaaaggaaatagatttaagttccaacaagcttaggaaagaaaacgccttagtgtctgtctctctctcccacagtgctgggtgaacacgtgctttgctctagttaggtccggagtatgttttggtctctaaaatctgtctcatttccccctcagttttgcttatactgtcccctctgcctggaatgtctcctccttccatctgtagtatacttctgatcctttcagtcttttagatgttacttctttcacgcaacagctcgtgattttgccagcctaacataaacatatgtcctctgctctcctaaggaggcctttttcacaccctaccttcggttgcaggtacttttgcacttgctctagccctgctattatgagctgttaaattcctgagggtgaaaaatccttccttttggcttaaccctgtcacgtttcaaacagtgttccagaaagagtctactctaaacttaactaaataacaacatgaattcccccaaaaacaccccaaacaggaaaagggtataaagagagcattctaggcttttctctactgtgtgtgctagggtggcaatttccaaagtgtgttctacaaagtggttgtgctgaattaaaagaggttaaaaaaaagagttcggctaccttggtacttgttttaaagatatgtgttaatatatacgcattaatgatggttgcaggggaaagggttttctgaatcaaatgctcttggagtccaagaatggaaggaggcagagccagggaccagaacaataaacagagctgacagttgcacagtgatgtactcttgataaattcaggcaaaaaaaaaaaaaaagttacaatttactgtgtattctgtgtgtactgaactacctactttacatacaatttgataattttgatcaccacattgctatgaagcaatattataacccctattttacagtctcaaataaattgggcaatttaaataggggcatataggtggtaatggtggaactgcatgactccaaaatctactgtgccatgatgctattctatgacaagcatacttctgactcaccaaataaaaaggaacatacaaaacaaatagatcagagaatggcaaaaccaatgtaaaatatctcacagtgatgcaaagacttaactgggtagcaaatgataacacaaggttccatttcaaaataaaaataaaaggtaaaaagttgaaaatatgttttatgatagacaaaatatttgcacaaaggacaacacaaaatcaaatgttgctaaccaacagccatggagagtgcaaatgtattggtaaaatagctctacttctgttctctacaaatcagaggttagcatggtggtcaagagggcaggctttgagccagactgtcagtgttcacagttagggtgcttcagctctctgtgtctccctattgtcaatgataaaaggagtacaataaccagcagctacctcctggagctgccgtgaagattaaatatgttaatatatgtcaagatctttgaaaatggctttcatatgagtccaaaagtgtcaactgctggtaagtacgatgagttagcaaggtcatgacacttcctcctccaagacagaaacttggattttaatgaagcaaaatatggaacagggaagttttgctgaaattctccctaatgaggaaggagagaaaggaagacactggtattctaaaccagaggtcctcaactggatggcactgttccttcagaagcatttagggtacagtcagccctccatatccaaaggcccagcatccatagattcaaccaattgcagattgaaaacatacaggaaaaaaacaaaaaacaacaataaaaaataatacaaacaaaaagataagtataataactatgtaagccgggtgcagtggctcatgtctgtaatctcagcactttggaaggctgaggcaggcagattgctttgagctcaggagtttgagaccagcctaggcaacacggtgaaaaaaatatgagaagattttcatatttcaaaaaatatgaaaatcagctgggcaatggtggcttgcacctatagtcccagctactcaggaggcagaggctggagaatcacttaagcccaggaagtggaggttgcagtgacctgagatcatatcactgcactccagcctgggcaacagagcgagaccttgtctcaaaaaaaaaaaaaaaaaaaatctgtatctatatttaaaataatttaaagtatactgaaagatgggaagatgggccgggcgtgatggttcaagactttgggaggccgtggtgggcagatcacctgaggtcaggagtttgagaccagcctggtcaacatggtgaaaccctgtctttactaaaaatacaaaaaaattagccaggcgtggtggcacactcctgtaatcccagctacttgggaggctgaggagtgagaatagcttgaacccgggaggtagaggttgcggtgagccgagatcgcaccatggcactgcagcctgggcaacagagtgagactctgtctcaaaaaacagaacaagccaacaacaacaacaaaaataagtatactggaagaggtatgtaggttatatgcaattctgtgctattttatataaggaatttatgcatctgtggatttgaatctccatcccttgcagatatcaaggcagaactgtattagtgagggtgctttccatgatcacacaattggcattaaggtagaggtcagcatgtgagatttctggcaatgagaaggacaggcctgaacagcaggatttgtttcatatcccgcgggacttctttcttttgttttgagacagtcacgctctgtcgcctaggctggagtgcagtggcacgatctcggctcactgcaacctctgcctcccgagtttgagtgattctcatgcctcagactcccaagtagctgggattacaggcatgtgcaatcacacccagctaatttttatatttttattttttgagatggagtcttgttctgtcgcccaggctagagtgcagtggcgtgatctcggctcgctgcaacctctgcctcctgagtttaagcgattctcgtgcctcagcctcccaaatagctgggattataggtgcataccaccacacctggctaatttttgtatttttagtacagacagggtttcgccatgttgcccaggctggtctcgaactactggcctcaagtgatcagctcatcttggctgcccaaagtgctggggttacaggcgtgagccaccatgcccggcccccgcaggactttctgctgtttctctcaattttatgtaagtaaaacaacagcaacaataaaatccctgtcacttgaacacagaatgaattctgctttatatattttgtatagtttgtatagatattttgtatagtttatgaggcactgaactttccagaacagcaactactgtgtatactgatgggcaattttattttgtttcatttaaactttaccaagattttcttaccattctagaaaatgacatcaccaagaccaatgaaattcctatcagttatagctgtgggggtctgctttgtcactgctgtattcatggtgagtccacaaacaggtgtaaggatctggctatgccaccgtgtctcccaatgtcatcagatctgagtgctttatacatgcatgcataatgttataaaaaatgactttccttttatttctcctgtatagttaggtctccaaacactagtattcctccattgatattttgaaattgctaagtcattctattacctatgtattttatttcaggattagcaaatgggacattataaaatcattttttatataaatgccgtgctgggtttgattagggttgaagaacaatgttctgaggcagttattctcaaacatttaatcattttcaggacccctttacagtcttaaaaattactgaggactctaagagtttttgtttatttggaatgtaactaccaacactcatactgttagaaattaaaacagatactaaaaagtatttattaattcacttaagaataagctcatcacatactaaaaaaaaaaaacctactttttcaaaaccaaacaaaccaaactgagaagaaggacacatgtacatctacactgatgtaaatctgctttaatgttaggcttaacagaaggcagcaggttctcatatctgtttctgcagtcttacgatgttctgttttgttgcaatatatgaggggaaaaaaagtaaactcatacagctgtacaactggaaaagggaggagtattttggtagattctgggcacaactgtggtattgttttttgatttgacaccaaaatgcaagtggtagcttcttaaaggtgagttgcaatgtggaatttacaatggtatcatctgttacattaaaatccatagaattaaggggggaaaaaaggagaaaaaaatccactatttatcttgtactttcaatggaacttctactcatgtgtgatttttaacatcctgtgtaggtcatttggaagatactgatttactgagctatagagatcctcccaatgttaacacatttcagtaaacaacatatatttttaaaatatcacatgttaataccatcctgagcttactataacagtctaagaatttagaaagctgtcaagatcacggtaataagtttttcaaaattctaatttttgcttgaaaactcgaattttataccggtaacaaacagttgttttcttcaaagtcacagcctcacctctttctcttttgagaaaatgtctaccaaatatgcaactctgaacagtatgtctgccagctgttctttcaagtaaagctggtcttccatgaaaaaaagtgtttagtccagctttgcaactcaactgtatagtgctttcctcaagataagacatcgtgtctaggtgtgcagcagcagggctaacatgcccttcccatgtcttcacatcagatatttttcactgcttcatcaaggccattcttctgtaaaacagcatttttttctttttgtgtgagcacaggggtgaagaacacagtgatgactagtacaatttcatcccactgccctgatttgtgctaaggtgtcagcagctctattagcggaaaaggcaaataacatccttttgttttttgagacagagtcttgctctgtctcccaggctggagtgcagtggcgcgatctcagctcagtgcaacctgtgcctcctgggttcaagtgattcttgtgcctcagcctcctgggtagctgggactacaagtgcaggcaccaacttgcttagctaatttttgtatttttagttgaaacggggttttgccatgttggccaggctggtctcgaactcctggcctcaagtgatccacctgcctcaggcaaataatatcttaacataattatcagatgagttctgatgtcacggacctttggaatggtcacggggacctacagaggtccaaggactacactttgagaatggctgttctaggatacttttatcctgaggcactctattgatccaatgggaatctgcaggaaagcaacaggcacagatgaaaatgagcatttaatgggacactcccatgcagggcttgtctcagggaaagttctctaaatattattattatatgaaaaaattggtattaagtatgatgaagtgatccatacatattcttaataattggctttgtggttataatgcttttactattaactaagtaagctttaaaaaaaattaaaatttcattattgatttatttttttgagacaaggccttgttctgttgcccaggctggaatgcaaaggtgcaaacatgactctccatgcagcctagacctcctgggctcaaacgatcctcctgcctcagtccactgagtagctaggaccacaggcacacgccactaaatttggctaatttttaaatttttctgtaaagacagtctcatcctgttgcccaggccggtctccaattcctgggctcaagtgatccccctacctcagtctcccaaagcaccgcaattataggtgtgagtcaccacacccggcctgtaagtgaacttaattttgaatcttgattgggaaagagaaagacttttcacctataaaacttacaaaacttttcacttataaaactaattaagctacattaaaatttttctatattagtattaataacacaaaatttatctacagaagcctgagatcctatctaaatttcagaaatctaagtggctctggaggccgaagcaaagggattgtttaagcccagcagctcaagagagcttgggcaacatagtaagaccccatctttatttaaaaaaaaaagaaagaaaggaaggaaggaagaaataaaaaaaaaaaatctaagtaagacagccgggcgtggtggttcacacctgaaaccccagcactttgggaggctgaggcgggcagatcacctgagatcaggagtttgagaccagcctggccaacatggtgaaaccctgtctgtactaaaaatacaaaaattagccaggcatggtggcaggtgcctgtaatcccagttactcaggggcctgaggcaggacaattgcttgaacccaggaggcagaggttgcaatgagccaagattgcgccactgcactccagcccgggcaatagagcaaggctctgtctcaaaaaaaaaaaaaaaaaaaaaaaaaatctaagtaagacttacttattctaatatatcacaagcagaattatgaaaactcaccagaatctactgaattctcacttcacaaagtataggaagtgaggaaatactggcctaccatcttggaaatcacagactcattttagacgtgctaaatactgtgaccatagaagcagaatttgattctaacgatggacactgagaaggtaaaaactgcatacaggacttgattctgattggcatgaaagttcaacaattaacatattagtatttgttaataatcatcaagcatctgtatatctatgctactttagatgattttctagccattaaaaccgtttttttttttttttttttttttttttttttttttttgagagagtctcactttatcgcccaaactagagtgcagtggcgtgatctcggctcactgcaatctctgcctcctgagttcaagcaattatcttgcctcagcctcctgagtagctgggattacaggtgccggccaccatggctggctgatttttgtatattagtagagacggggtttcaccatgttggccaggctggtctcgaattcctgacctcaggtgatctgctcgcctcggcctcccaaagtgctgggattacaggggtgagccaccatgcccggccgccattaaaacttttaatctgggggttgccaaatcttttctttaaaggtcaaagagtaaatattttaaattgtgtaggctatactgtctctgccacaactgctcatttatgcctgtgtagggtgaaagcagctgtggataatatacaaataaatgagtgtgttccaataaaactgtgtttcaataaaactaacaaaaacacagtgggctatagtttcctcatctgtttacttaacaaataaacctttgtgtagagtgcagcaatctgcttatagaaaagaatctcaaaatatatattttgaaaatatcttttaaaaaaaaaagtgtaaggatatttaaatatttaagccaatctagtctttgtactctgaaaccaaaaaagaagccaagaagcctcatcaccactgcccatgaacctaatttggaaaattagtcatattaaactcactaaaaatccaacagattgggatatagaaaaatgtgtagatgaagagttgatttaatcctgtgagttttagggaagtgttgcattctttggtgctcattaccaaatacttatgttactttgcacttctgtgtactaaataaagtgctgtacagtgaattatcttcttaacatccccacccaagaggtagggaatacaaatagtcattttgtaaataaggaatgtgagatttggagtaggtaggtgacttgctcagtcatcagaatgtaaatagcagacccccatgtgaatgaatccacttgacttcaaggcctgagaagttaatgatgagattctcccgactctcagtactggactattctgcagtagtaaacaaatttaaaaataggcaaacttgtaaacagaacatgaagggcctcagatgctgggatgcggggtacgtgctagttttttctgtgggtaactaaggatttcctgttgttgttaagctgggaatgacagagaaacgacaggtgttctcactgcctcgttcaatgtaacatccatcagacaggtatgtgtttcttctctgggcctcggtccttctctctgtagagggggctggtctgaggcaccctctgtctctaaacttctgcataattgtgttaatcacttattttcactttcagtgtacgtttactgttacagagctcaaaatgatgaccaagaaagtaaaagttttcagccttcaagataaaaaaattggtatatttaaatagtactttgtcttatcaggtttctgaacacttttcataaagaaaataattgtcaaagtttcttaatatattttttaactagtcaaatatcaaatggtggtagttaataactactaactacaaaaaatcctattatcttttaacttttgagaaaaagaacagaactggagtattcatggcaagtaacccagtgtgtgaaaatagcatcctgtcaaaagccaatggtatataaagacttattaatctagggcaagtgttactctggctaaaacccccagccatggcatggcccagcaactgtaaaaggcctgggctgacctctccgaggcaggagagggcaccagtaaaggataagaacataagcgggcaagtaaggtctaaggatgctgccggaagatcttattaaggaaacaaaagcaactgcaatgtgctctctttcccaacaaacaacccagccaccagctacgaaagaaaaaggcaaaaaatgtgcagagttctcaacaaacaaaacaaaggaatatggtcaggtagagacagactcatttttaaataaagcaaaatgcaaagcatctgtgacctagtctggtattttaatccagacttgatcattagggagatctctgacaatcaacaaaggaaaaacctcctccaagttagggcagcataggaaaagcattttaagatgacatctgtccaactgctcatggcttcaaagagcccctacttgaaatacaaatgaggaaagtgagtgcacatgagggtaatacgagaagacgagcaaaaaggaaacaattagttggtgttataactattactcttagaataacctgatatttgactttctcctcatagaaaacagctgcctaactgtaaatcttgaaagttagtaagagtaaccccaaagttggggtggggactgtagctaccttgggcggtgcttcatcagaccctccggagtcccaggacactgtggcctgtcttctggactccatcctcatgcgctcttcttgctgagccttctcttcctccaggattgtgctagagagacaacacattgtcttaggggagctgacaacccagagttagcacacactagaccccaccctgagttatctaaggaacaccagttggctaacagtagatgataacaataaaggatcctatacacaggggaaagaaggatcaggtttctaactctccacgaaatgattctagaatagccttggtccaaatgggcaagtccatttaaagcacagccataggtaagaaaaagacagctggtaagaaaaagaggttgcagaaaatgaaggatgggccaagatgaaatgtttgcatgccaaagtttatcttgagcagaacagaattcctctgagaaatcccacgcagcactttatcaagcatatacatgtctgaggacagattcttttcacacctaatgtgatcacgccagcacttacgtgatcaattagcaatctggccaataatctccctaaattgctcaatacaatcttcctatcgttcagcttaaccagtgctttatctgatcaggaaaataagcaaaaacacaacagtatttacaagtgcttctgaaaatactacttgctttaagctggaaaccccataagttggtaacactgctacttaccactgcttgactactcagaagctatctgaagtcccacataacgctgcagccgctgcagcgactgctaggcagcttcttcatcttggctgtttgccatcacataaacccctcagaatgcagccaaagcgagactttgctagtttcccattccacgcagatgccccagggctcagcagacagtttgaaaccctcgtcctaactgtggcaaacagctcttcctacattcctacaactctagagttctaataatgacactcattcaaagtttctaggctcctggtagatagtgtgcagtaaacaaccacccaaaaattactcaggaaagagtgacatcagtgcaccagactttctaatctgggaatttgctcaactgtttaaaaagacattcctgcttggctggaggctagaatgtgctgtttctcacacaactcaacttacacagtcaccttctgagtcaggaaaagagacaaaatgtatttcataactgccccaagtcagcaaaccatcactacagatgttaagacgtttttcatccccaaaacaaaagggaatgtctgcctcaagaaatgatcacatcaggaccgggcatggtggctcacgcctgtaatcccagcactttgggagtccaaggtgggcagatcacgaggtcaggagttcaagaccagcctggccaacatagtgaaaccccacctctactaaaaatacaaaaattagcccggtgtggtggcgcgtgcctgtagttccagctactcgggaggctgaggcaggagaatcccttgaacccaggaggcggaggttggggtgagctgagatcacgccactgtactccagcctgggcaacagaatgagactccacctcaaaaaaaaacccccaaaatcacataagcattttacataaaagcttttaatcaaaagtcccactccattctcaagatacgattttggtttctttcttgctccagttagatgatcatggctgagcaaacaccacaaaactcttcacagtatttaagaattctgcagcagccttgacagacaggcaagatgctcactgggtgccagcactgttgggaacctggtcccatgtgccaggcccaggtgagtcctggtgagtggtgcagggaagtttggggccaggtctggggaaggagcagaggggtcctgagagggccactctctctgccctgcccctccaatcagaagagcgctcccctccgctgctgggaggattaagggagatcatggctatgagagcatctgctataagcgttagttgtcatcagtgggtatttctgatggcatttacttgagggctgctcattcagcaagtatttgttaactttgctaacttgctctgtgcaagatgcacgtgacgaggtctttgaggtgctctaacagaaaagaaaactcaaaaccttgaaacagggccaggcaagttggcttatgcctgtaatcccagcattctgggatgctgaggtgggatcgcttgagtccgggaggtggaggctgcagtgagccaagatagcaccactgcactccagcctgggtgacagagtgagacttgtctcaccaaaaaaaaaaaaaaaaaaaaaaaaaaatcaaaaacaacaacaacaacaacaacaacaacaaacaccctgaaacaggacacaaatgttgtgatgagcactagagaagagctcggcctggtacgttctagctgcagaactaagcgggagaggacactgtcccaggcactgggggtggtttgggaggaagagtcacagcatctcagcaggtcacagttacagactcacaccaagcacataatgtttgtgtgcttttggaaatgtaacgagcattacatgaccaaagcacagcaatgctttctgtccatttcttatgtgaaaataaatacctttatatttcaattttccttatttattttaatttatgacttaaaaaaacaccttctgttatactttgaaacagtgcctggcacatagctgacacttaaatatttgctaaatgaacaaatactgcatatagataaaatacatgcattatcatgatctattagatgtttaactaagctgagtaaattcagggatcattagtggttaaaaaaaaaaccggatgggaaaacagcaaggctcaatcaaactcaaggagtttgagtcacactgacatcaggtttaaattctaccatagacaggttagatgaccatggacaactctgtccctccaagcctcatccacaaaatggggtacctccctaactacctatcttgaagggttgttgcgaatatctaaatgaaaattagacaacctatgtgacgagctctgaaatgcaagaagcttttaaaaaatagaaggaactattagaaattccccatcagataatatcctgtgtaactaatggctaccattcccacaaagagctctaagtctttttctttctttctttcttgtttttggggcggagtcttgctctgttgcataggctgaagtgcagtggcacgatctcagctcactgcaacctctacctcccaggttcaagcgattctcctgcctcagcctcccaagtagctgggaccacaggtgcatgtgccaccatgcctggctaattttttgtatttttagtagagatggggttttaccatgttggccaggctgctctcaaactcctgacctcaagtgatccgcccgccttggccttccaaagtgctgggattataggcatgagccaccatgcctggcctcctacctttctttctttatttttttttttttaaaagagatggaatggtactaagttgctcaggctggtcctgaactcctgcgttccagagtaactgggactacaggcttacaccatatgcctgtgcaagtatttcaaatgagttaatatccaagtagagcttgagatacaaaggagcaaccatgtctttttacaaatccatctaatcacctatgaagtgttagcaatacaactactaagactggctatcaatcaaaccaacagatcaagaatatgcctgctaaaacagtcactgatatacaatgtctttgaacttgacaaatgtaaagatgttacaactataaggaataggagttgatactttggtatgaggtaatatagcttcacccagtcctgagaatttaccaatgaaaatgtgggaaggtatatcttaactttctagatcataaaacaccagtaaatccatacctcaaaaggctgctaaaggagttaaaaatatgtatttttttttttagagctagggcatgtgcacacatggcgggaactaccattgcttttaaaagtgaagtgattaatctcgcttcacttccctttttcctcacctatacaccttcttcctttatgtcctggcaagttctccgaagtcattatgctctcccatgcctctttatgttgtgtctcttgcctggaacacctttctcttctttctctggccaactcctacttgtatttcaagtgtcaaatagtagttcctccagaaaaatcttccctgaagctccctcctccctttaggctaagttacattactctccttattctcttccaaagaaactagtgcctaacttgctcttaactcttgccaaaaggcattgtaaatatctgtttgtttgacttttgctcccattaggccaaaagttgttacctgaaggcccattttcaaatgctcagaattagcacagaccctgaaacataataggaattaataaatgacaggtaaatggatgaataaagccctatcagtggagcaggtctactgactagtgaagaagagcacattaccaagcttcctgttctttttaaatttatttttatttttaaagagacagggtttcgctattattgctcaggctggtctcaaactcctgggctcaagtgatccccctgccctggcctcccaaagtgctgggattataggtgtgatccactgtgcctggccaatttcttttttctttttttgagacagggtctaactctgtagcctaggctggagttcagtggcacgatcattcctggactcaaataatcctcccacctcagccctccgagtagctgggactacaggtgcatcaccaggcctggttgattcttttttattttttgtaacaattaaataataaataaaaatctcactgtgttacccaggctggtcttgaactcctgggctggagtgatcctcccacctcagcctctcaaagtattgggattacagatgtgagccaccatgcccagcccctgttctctcaactggccaaacaggaaaggacctgcgaatggtcactgggagcaggagaccagtcagagaccaggagcaaagaaggcctagctggcctgagagagaagcacatccctggttagtggttttacagtgccctgctctctattgcctcacccttaaaataaacaccacaccctcagtcagagtttgtaaaagttttagttttaaacaggtaaaaagtccataaaaatcaagaaaaaaaattggggaaaacaagtgtcttttcttctactccttcaaataattaaaataaaggcaagctaagagaaggctaagtgggacatattcttcaaggcaacgggaactcagttttaaatgggttctcatcaggcaatgttatttcacacagattgttttgtgaaatgggccactctgatcttaaggctacttactgttttccccaagcatctctaaaaggaccctgtggagtcccttgccacaagaagactctctcaggctccatctgccctgatatttctacctacacacacttcccctattctctgacccactgaatttactgcctgaatgtttcatttcagcccttaatcacatattgccatgttgtggaatttagcttgtaaactccctacagttgtcagacatgaatctaatttctcttgtaagctaagtatcacttgcatattatagacactttgatatttaattaaacatccgagttgttcctcaaagaacataatgacaactgggaagcaagttccttcaatctcactacttcattctcatacccaaaatagcctgtcaaaacgtttctgagaaaccataatttgctgctcagaggaaccaagaatataaataactcataaaaaatatctgtttttacaatgggaagactagtccatagatggagtaggagggcacaaggagacagtactgaacttttctctttacagctgctgaagaatccacagtaacaaactagaatgtgcagagtatcaaggaggtcaaactgaagcatattttcccaaactataaatatttttagtagcaatacattccatctgaaagctcttagctgcctaatgtgaactggcaacaaatgagccctcatgttttttcccagaatggtggtttccaagtctcaaacttgcaaatagatggaacaatgaaagctgagacttgtcatttaacaaacattagcacaatgataattacactttattgatccacgtgcaccactgaggaacagaatcctgaagcggggaaaggagtactttatttagtgttagttttattttttacttctcttactttaaaataaaatcattgaagtgatcagttcacagtaaaaggacataaaaacagttgctctgattttcttcttttggcctgcaacattccctatacaacttgatggtgagcaagaaagtagtccttcatttccagtatggacagctaagacacaaaaatacagctccaacaaaggcaattttcagaagtagaaaaggccaattgattctgagtgtttttcttcaagctgtcccagaagaagcaacagatagataaacaagctgcttctctggtgagttatgcaattccagaggagatcctgcctacttgaacctgttttgtcatttacaagtaaaaatcacagtctaccctaactattgttagaatggaaaaacaacatatgtattaataaaaaattagtaaacttctaagtaaacgttaattagctctgtattttacctgcctcatttaccactaggaaagaactgtgtttttgtcttcatttctgtaatattttccctgagactgactgtactactaacttttctctttgcaaatacaaaacatttctccttttaaatgtaataaatactttttgctttattaaatatgggaagaaaaactttttaaaaaagattggattttgatacttaaaggaatcatgtaaaactaaggatctgttttatgatcctgatcataaaatttgctttggatataaaatcagtctgggtttgcagttatttaagttaatctagaaaacacccagagagagaacagcaataaatttgaagggaaaaaagtcaagcgggaactggcttgttttggcaagttcatgggaataccagttttgaaacatgatttcttataattagtcaacgctgcttcaccacaaaggaatggaattggccttttaaaaacaaaacaaaaccaaacaaaaccctaccgtctttgcagaaaacaagtctgaggtttgagatgaagctagggatggcatacctggaagtagctgacctagtagctaaaggccatgatcacagcattactgcttatgcctctgctctttttctcttttctcttaagcagtgatgctggagattatggcctttagtctccaggtggactggaaatccagcttcatggatatattgaaatcatatttctctcattgcttctccaactgcagtaaataaagtcttttgtttggttattgtgctgtatcgatctcaaaattatttttaaaaaaaccctgatatccactaagactgtacctttatttttttctattttttgaattggggttttgctctgtcacccaggctggagtgcagtggctcgatcacggctcactgcagccttggcctcctgggctcatgtgatcctcccatctcagcctcctgagttgctgagattacaggcatgagccaccgcaaatgttactttaaaatgttgacacctttttctgtttctgctacgtgtgagtagctcttatttgaccaaccctcttgcagacaggaactgtatactctggatataagaaacaactgtgacagcatgggagagcaaccataggcagccagattctggagggagctgtcatgagaaggaagagaacggcactgggtgggtccccacttttcagtggccattagtgagaaggcaggcgccagtgttactggcttgaataaccagagaaatgagtttggagcaattatagctagcaaaaaggtaatcggaaaaaagtgaagggagaaatcccagaatgaagacaggcagagaaggagtgcttcaaattctgagtatatattctgcacacatctctgctgatcctagaatcatgcacacacagtgcagactccaagcagcccagctaaggctaaaataatggaacagagatttgcactgctgctcacagcggaaagaggctctgctacctacccatcagccacaatgtctaggatataatctaacattccttgatatacaaaaaaaaaaaaaacccataaaaatgtgacccattctcaagaggaaaaaaaattaaaggaggctgattctaaagatgactcagatgttgaaatcagcaaggatttaaaagaagctattatattcaagggtataaaagaaaatttattcataatggatgaaacgataggaaatgtcagcagagaaacagaatacaaaaaaaagaagcaaacaaaaattctattaccaaaaaatacagtatatgaaataaaatctccattggatgaagtgatcagtaggatggggatgacagaaaaggagttagggtacctgaaggtaagtcagtaaaaatgattcaatctgaagcggggaaggtcaggaatggggagaggaggaagaggaaggggaagagaaggtgacaacgagagcttctgggactcagcctgaaggacaccatcagaagtcttaacacacgtgcgactggaatctcagaagagagggaaaatagaacagaaaaatgtatctgaagaaacaatgatctaagtttttctaaattttataaaagatatgtttatagattcaagaggctcagcaaatcctaaacacaactgacattaagaaaaccacacccaagcacatcctacttaaattgctgaaaaatcaaagaaagaaaatcatggaagctgccagagaaaaacacacactgcatacaaagtaacaattgtatggccagtgacttctcattaaacataacagggcagaagacagtaaaagaacatctttaaggtgctggggaaaaaaaaaattacaactctgtcaacccaaaattcctatcaacaaagttaagttcaactcatttttagataatataaaactaatagaattcaccaccaactgatctgcaccacaagaaatgctaaaaaaaattattcatctgatgggaaaccaaatggaaataagctcttcaagaagaatggagcactgtacgaagttaaatatagaagagtgagtttgcttactttatttaaaatggtatttaagataaaaatcataaactaattttgtggggttaatggcatatgtgaatgtaacatacatgacaatttcagcataatggaccaaggtggtggtggtaaatggacattcctgctggcaaagtttctacattttatatgaagtacaatgattaactctaactaaactatgaaaagttaagatgtatactgtaattcccagagcaagcactgaaaacataatacaaaaggtattgctaaaatgcaagtttgagaaaaaggttaaggcagagaaagagaggtggatgttaagttattggtttcaaagtgccaaattgtgcactttggcaaattgtgcaaagacagaactatgatagggacgtgtgggtgagaaccaaaaaggggtaagaattattgttagatatgaagcagctaagaataattttcagtagaaacaatttacgttttacattaaattcctattaaattcagatttgcagtttgttttttatcactgggaagactgcgggccaaaacagaacacaaacaaaaaactcctgaagttcacatgctgtgaacattttaactgtacgtagctataattgtgaaacagcttagtcttctagataatatctagacccaataggatagcaatgcaaaaaaaaaaaaaaatactggtataatgactaaggaggaatttagacaccacctttgaaaggaattttggaagcaaatacaaaatcgcttaaaaaaaacacagtagtacaagcaatttcatgtcattaatcaaacctagaacttctaatttaaagttcgtgttgtgggataagggaagaatccaaaacaggttaaacatgtttaagatgctgttcacagattaatattttaaaattcatatctctataatacatctataaaacatcaaaaagatgtgcttggtattttgataacaagtatcttggtattcttattatctgaataataagaatagttaatactcattcaaatctcacaagaaccctagaaagtagctactgagtagaaagagtactacactttttagaaaagtagagaaagacggccgggcgcggtggctcacacctgtaatcccagcactttgggaggcccaggagggttgatcacttgaggtgaggagttcaggaccagcctggccaacatggcgaaaccctgtctctactaaaaatacaaaaaaaagtagcccagcacagtggtgcgcgcctgtaatctcagctactcggcagggtgaggcaagagaattgcttgaagcagggaggtggtggttgcagtgagcagaagactgcgccacagcacaccagcctagatgacagtgtgagactccgtctcaaaaaaaaaaaaaaaagtagaaaaagaaaagttaaagatgttccccaaggatattaagtggtggggccaggattcaaagtgagatctgtcattccaaagctcataattttgcacgattctgttactggttaccttaaaattaaatacaaataactatatatttttaaggatgtctaactataactggtaactcttctgtactctaagatcaccaggtcccttctggattttcaggaaaatctctgttgttactactacctacttctaaattagctaacacagtgtgtgtgcttaccatgagcaatggacatggattatttatttatatgtttgtttgagacagagtttcactcttgttacccaggctggagtgcagtggcacgatctcggctcactgcaacctctgcctcctgggttcatgcgattctcctgccttagcctcctgagtagctgggattcacaggcatctgccaccacgcccggctatttttttgtatttttagtagaggcggggttttaccatgttggccaggctggtcttgaactcctgacctcaggtgatccacctgccttggcctcccaaaatgctgagattacaagcgtgagccactgcacccggccagattatttatttaatcttgagaatatgggtagtatttgtgatcctgctcttacaagggaggcttagtaacttgcccaaggccacataatcttttaaacattctttgaaaaattgatacacgcacacatgtccatttactctcaaggtgttgctataatagcttgaactggcagtctcacagatcaactgaaatagtttgtgttccttagatgccttgcagcttcacttaggtatgatactgagaagcgatatgaaaaaaaaagtaagaaaatctgtctgcacccatgctgagctaagctataaccctgaccaaacactctcccaaaggctggttttgtttgataaagttaagaagcaaaacatgacagcacatggttaagacaaataactaaaaactgaaaaccaaaaaaacacgcacgcacaaaatcaaaaacaaaaactccaaacaaaaactcccaacaccccccagctggagtgaaagctctatatacaagcggttcccagcaggctctctggatgacaccgtgtcatggcttggctctgatttgcttgaagtcaactctgggtgacttgttcaaaacttccaaatcggctccccactgtatgtgaaattattgtgttccacagaagcaaaatacaacacactcaaaatatgccaatgaaacaagtaaaaccagtaagaaaatactttgaaagtacaaaaggaagccatgtccccctcaaagcccgtgggtagggcctctgtgcatctgctagtgatgctgccattccttttaaggactttggttgatactcaaacaatgtaagaaaacaagctgcaggaattctctgtaatagtatttttttcctttctttttcctttttaactaaccaatattaacaacctgctcaccagtccaaatcataagatggcaggcacacttaatgacttctagccaataaacatcaaggcagtcagtagagcatgacagcttatagctcaagctctggactcaggtggacctagcttgaattccagctctgtgtccttctatcaggtgcctaaccacacagtttcagtctcctcatcatcgtaaactaacgatgaagatactacctatacgtagtatgccccaggactgtgaggattaagatgaaatagtgtataaaagttcatggcacaatgcctgccaacagacattgctctataactactagttatttcaatgttataactagaagagctaactgcagaggatggagacttgctatcaatgcacatggtactggttctaaaaatattcctaaagagctcaatgatagaagaccagttcaaaatcatggactgctttccaaggtgatacttgagactggtgttctttagaacataaagcctcaggtaaatctgtttacacaacacttactatatcctctctacttcacagagcaatattcttgatagccccaaattagaagtatacaaatttccaccaacagtggaataaactataggatattcacaaatggaacactatataacaatgagaattgagtataactacacgaataacatggattaatcccacaaactgttgagtaaaataaattatatatataaagtaagtactgactgataccatttacatcatgttcaaaaacaggcagaaccaatctatggtcaagatagaggttacccttggagggtgaacagtgattagaaaggggcatgtggaagatttctggggtgctggtagtattttcattttggttgctggtgacagactgtatccaactggtggaaatccagtaagctgtcacttcttggtgtgtttattaaacatcaataaaaagttttaaaatatacaaaaatcataacacaaaattttaaagtgataattgtgtttactgccctaatttgcctaaaatatatttaagaattttaacattaacctaaaatatttttctaatatgagataaagctgatgttcttttttaaaatagtggtaccaacaccttagtcaagaagagtactgttgggacatattatttttgaacatacctgcaaaaaggcaaataataaagctgtttattatggtttccctgtcatagtacctaacaaagaattaactgaagtaaccaggaattaaattaaaccccccccccccttttttttttgagacaaagtctcactcttgtctcccgggctggagtgcaatggcgcaataccggctcactgcaacctctgcctccccaggttcaagcgactctcttgcctcagcctcttgaatacctgggattacaggtgcctgccaccacgccgggctaatttttgtatttttagtagagacggggtttcaccatgttggccaggtttgtctcgagctcctgacctcaggtgatccacctgcctcggcctcccaaactgctgggattacaggcttgagccactgcgcccggctaaatgatttttcactcaaaaaatatttggtgcgctcttataacctgacagtcataaagcacaaaaatgctagagtacgcattataagaaaatttcactgttgatcaattgaaagtattcctattgaggaattttttatacttgataataggccactggcaggttaatctcattctacttctcaatgaattcatacctatgaataagtaaacaggatgtaggaaggacaggttccttgagtcacagacatcacctcatcaaagtaggaccaaggtgattttcctatgagtttgcccaacatgttccataccaaaaatcacttctcaactaatatagtcaaaaacaaatatacaaggctgggcatggtggctcatgcctgtaatctcagtactttgaaaggccaaggtgggtggattgcttgagctcaggagtttgagaccagcctgggcaacatggcaaaaccccatctctaccaaaaatacaaaaaattagctgggtgtggtggtgtggtgtgcatgcctgtagtcccagctactcaggaggctaaggtgggagaatcacttgagcatgggaggtggaggttgcaggcagcagagatggtgccaccgcactctagcctgggcaacagaggagaccccgcctcaacaaaataaaatacacacgcatacactccagttaaagatgaggggaatcccacagtaatttgagtctacttgcaaatattctttcaaggtagggaaggagaattctttcgaggtcaagaagaagaatgggatttgggaaacatttttaactaccataattttaacgaccaaagggctatccaaacttattatttctttgttaaaatcttggaaataataaaaattttgaaaaaaattaataacctatttagttattgtgatacactgttatatgcaaatgtccaagtaagcaattatattatatagtgacattttataatataaaatggtggcctatttggtagcctaattgtatatgttcaaaacgcaaagttaaacaccatttctaaaacagaacaatgcagaatgaatgaatgctcaactacctgtgctagtagtatataagaagatatccataaattatactacaggtacctatttaaagtaattatatgtagttctaaaaatatgtattggatactttttggagataatttacctcagtggagcattccttagtattaagaatcactcatatgttctaagccttgaattcagtgcctgggtgactcttcctgtatctagctagctaggctactggcctggaggtttgggcaacaccgaggtgagtatgaccatccctgtcctcaaggagcttcagtctagtaggggatgagacatactagactgtgagctcctcgagggcaggaaaagtgttttagtcatctttgccccagtgactagcaccaggctcagctactgtaggtgctcaacagtgtttatcgaactgaattgaacacgggttgcagccatctatagcagcatagggtaagcctgacaagaagaacaaagagctttggagactcagagggtgaaggctagtcagctgtgaagtcacagaagacccagtgcgtgaaagaagccgagaaagatgggtaagatctccccaaatgaagaaggaggcattctgggctgacaggagggttagtttagctactgtgtgtgaaagggatgagaagacaatctcaggccataatgaaatgaggcctaaatgttactgtggaagcctttacccaaacataaaaggtgacaaaaccccactgaaagttgttttgaccaggggagttatttttccagtgacatttcaggaagattgactaagctggtcatgccagacagatgggaaaagagcgtgggatggagggtggggggcaggcacaaggagtgaagcatgactccaagatggtgccgaagataaaggcactattccaacctggaggaagtgaggaggaagggctggcatagaagagaatgtaacagcttgctttctggataaacatgatgcccagccagcaatttaaaatgtaggtttgggacttgagaaaagggcaggaccagaactatagacagacagaggtaagcagcaaagccatgtgaatgggtcagacatcctgggaagagtaatgagagaaaatgggagaaaataagaggctgaaaacagaaatttggttaatattcatggtaaaggtggagagatggcaagtcaatgaggtagaaagagatgccagggaggtggggtgatagaactggtatcagagaggaacaatgccaaggacagaatctgtcaaatcctgaggaaagatcaaggaggaacaaataggagcaaaacaacatgcaataaagcatgtccaaaagccagctgtaaaggtgagagaataggcagttaagttatatgagaattaattaaggaactgaagatttttggcttgaagaaactaagaggaggtaaggaagctgtttagaattaccctgaaggcctatcgtgtgaaaggcagagtagggttgttctatggggccttgaaaagtagaaccaggccggtgtgtgagagttatggggacggagaccaagagcgtggctggtctttccaatgtggggctcactgtattgtaataaccagtgatacctcggtctcctccaccagactttaaactctctgggggcagggattgggtcttgttcactgttggacccacagaacctagcttagaataacaaaggtgcttagcaaacattttcagactggatgaatcctttgtgcttctacctataggtcttaattcttctttgaaatactctccttaaaaggaatcctgtctagcaggttgaacagcttgaacatgtggtgagaaggctgggctagatggtgaaaggcctggaccctgcagttgatgatttttaggaaaaagactaaaatacagcatgaaaaacaaacccataaaaactcacataaaatggaggaagtccccaagtgtgaaaacaggtgacacagcacacactgaaccatggtattgtttatataataaagcttctcatgcctatgtgttatattacagtatcttgtttattacagtattaagtctcattctagactccaattcaattcaattcaacaaatgtttattgagcacttatatggtgccaggttctaagcttggcattggggctacagaaatcagtaagacacaatgatgcccgtcaagagctctgagtgtagctggggacatgcacaagcgaacaagaacctctccaggccaggcaacagggtagagtatgcacatgcttctctgagggattcagcacactaatgtccctgcgtgcttcctccaggggtttaacagtacctggcacaaagtagtagccacaaaatggcacctgaacaagcaatggatgttttaaatataaaaacagaagtattcaaaaggtggcaaaggagtaattctctctttcggggcagggttgattaggaagccttcctgaagcaggtaacatctgagctgggttctgaaaactgaataaaagtttataggtggcaaaggtcaggaaagggatttctgggagtgaagacagcatgtgaaaacgcagtgagctgtgttaggagaattataagtaggtattgctggatcacaaagtgtgagggagacagagatggagggttgtgttagatgagattagtgaggaaagccgggactaagttattacgggtcttgtaagccatgctaagtcagaagctaggggagagagatttgaccataattggagctttattaaaattttaaagatataatttacttaagactctagcaaggtacaaagaaatgcaaatcaattttaaaagtaattgcatttgaacgaaaaatagttcggccttagacatactgatataatgaccttaaaatgctattactgcaaggaggagaagcagcataatctgcccccacccccaggccctctctcccgccaactcctacctgagctgagctttaagttcagtaaacctgggccgcctgctggggtcataggcccagcatttcgtcataaggctgtagagggtaggaggacaatttggaggcattggtaatctttccccattttcaattcgaccgattacatcattgttcttcactccttgaaaaggcttcacaccatgcatcagtatctcccacatacacacacctgtcaagtgggaatgaaaacacaacagtgagctcagtatgaagaatgtaactcccaggttccaggaacattgttcttctaggcactcgagtaccagctgggaggtaatgggcaaattatctaccaaagcagcattatattaactctagtataaaataacctaacgatttaacatgatgtaaataatgaaatgttaaattattatcaagaaaaatgctgtaatttttctcagaggtttattttttctctagaaatcctctattagaaaatcacccactagctacagtggtacttcgtggcttaatgcagtagttcaaaaaatgctgaattttaatccgccccactttggtctcatctatttataattagagcagctgacctgaggtccaataaagaaaatcctaggataagtcttacgcttttggaaaactcagattccttaaaatgcttcccttaacaaggttggcctcttcttgtctagagtgcataaaggcaccattatctggtttattcatggactggtcactgttttcccccaggaaagatgtggaacttctttgggcttcaagtcgtcttgtctataaatgccacagtgtgacctcaaaaagtttacttgcactctacccttgggaaatccaatactttcttagtatcttctgaataatccttaaaaattcacctttaagatgggataaagaaaatgtagtacatatatgccacggaatactatgcaggcataaaagaatgaaatcatgtccttggcagcaccgtggaaacaactgaaagccatttatccaaagtgcattaatgcagaaacagaaagccaaacactgcatgttctcacttgtaagtgggatctaaaccctggatacatatggacatgaagatgggaacaacagacagcagggaataaaacagcagggagggaaggaggtgggtaatggttgaaaaagtacccattgggtactatgttcactatttgggtgataggttcaactgaagcccaaacctcaggactgtgcaatatatccatgtaacaaacctgcacatggaccctctgaatctaaaattcaaaaaaaaaaaaaatttaaaaattcacctttaaaacaaacaagaaacctaaaactggcaatgaacatataatgcaatgtaaaggaaatggaaagaactggtggcgtaaaggatggatgttttctcctagtgccttatcatcactgctctgcgcctggctattctgggcttcttgctacctgtggaacacgccaaaaacatccctttaccttcctcacaagctctcttctttgtaggtacatttgtaatgtagttctttataatgcttttcctctgggaaaagtttttgtcatttcaagtctacttctatcacaaaacaatgtacaattgatgacttgaagaaaggaactgtgactttatttttgcatctttagaacctagaatgaaatctgcctcaaaagaagcaaagcatattatcatcttgatgtgaattagattctgaacttagccaagaatccaagaatttcaaagtaaagagtatctgacaaaaaaaatgccttagtgctgcttttctcaccagaagttacaacaatattatcagtagtagcaacactggatataatttcttgagaacttaatgtgttcctggcacacttcttagaaattttacaaatatatatatttttgagacaaagcctccatcacagctcattgcagcctccactacccaggctcaagtgatcctcccacctcagcctcctgagtagctgaaactatcggcatgcgccacccaaaccagctaatttttgtattttttgtagagatggggtcttgctaagttgtccaggctggtcttgaactcctggattgaagtgatcctccctccttggcctcccaaagtactagcattacaggcatgagccaccgtgcccagtctcatatattacccttaatcctcacagtaaccttatgtttctttaaacactgcattttaccacatttgacaaaaatcacatctactgattctaggaaactttattagtttataagaccaaaaaagggaggagaatgttgaaaactaaagtatgatacaattctttcttccctcttagaatttttattttattcttaccaaaagagttcttttaaagtcattcagacattacagtaacaacaatattaacaaaacaaactctacttgagtggaaagcaaggacaactacattaaaataatgcttccaattattaccaactgtaaaatgccactgattttaagatacactccagttccagaaatgttaacatgtaaaaaaataggcatcttagaagttttgaaacatgaaatttctctgaaaggataagttacttgctctgtggatcacacagataataatcaaggccttgggatttgaacacacatcaactggacttcagagctttttctaatcatgtcatgccatatcctgttctatttgaaagttctttcctttacctagttatctatgggggcattaaatgataattaagaatcaacagtaagtaaacagaagaaaaaaataagaacacatactggatcaagttatttttatttataggagaaaaaaggtacataatcttaacagggcatctcctccaaagtagtttctaatgtagcagagataacatgtccacaagtctattcacaggatcaacatgagtggtatgacaaagagagaaagtgtaggaaaggtaaagaaaggaagaagccttcaaggacatttaaggtggaccttgagggttaggtaggatttcaactggaagaagaaggtatcaggataaggtattctgggtagaaggaataacaccaagaaaaatggagagtagagtggagggaagtgccattcatgttaaaaatagtgagtaatttaaaaatttggataaagtagtttaaataagtagcaaagaataaatgagagccacacttctacaccagctagaaggaactgcaataaccatagagcaggagaatgatgaccttgcagcaggtgaggaggaacaaatgagattatcaaaaaagcagaagctacagaagacaaaggatcaaacttccaagtcttgagataggtcaggaaggaggctggactccagaataaagagacaaggtagaattttagatacttccgggttggaggggccaagtgtttactgtttaatgtcattcatatgaaaggaacgaatgagatggcaaagggagagagagaaaagaaagaaggaaataagcaaaatatccccctgtgaggaaagaagagacagcaaaggggaacaaaaaggaagagtgatggaaggagctgggcaattagaactgtggacccttacagaagctgtgcccagaagctgatgcacagtagatgtcaggctatttactgtcaaatgaatcaaaagaagtctgatgaggagatgatcaggttagggaaggcaaatcaacctacatattccaaaaagagataatttttttttgtataacatatgaaatataatttttaaagaatacaaaacttttaagagtactcaccaaacatccatacgtcactagctgaggtaaaacgtcgaaaattgattgactctggagccatccatttaataggcaattttcctttggaagctagaagattaattttagaaaataaattttccttgttatctgcttaagaatctaacagagctagctgagattttcagtatcaaaggaaaaagctttaactatttgaacccttgaggcttccatttatttgggagaactacttttcatttccttggtgtttcgaggtcacttaggggtgaggaatggttagatggtagataaataaaataccaatgtccttccctctatagagaggcaaagaacagggagggagagcaaacctcggtttaccaggggtttaggtgcaggtattaggtgcagctctggtatataagatttcacaatttacagaagagatccttatctgtaggttagaatgctcgctatacacatgtcctgctaataataaataatatatagtcgatcctcactggtggtagttatgttatataaagttgttgcaaacacagaacccctgctctcaggagaaatatgtacacatatattcgtatctcacatagattacaatcttcactcataaaacaactcattctgataggttccatttcctttagaaaaggaggctcagatgtgttaagtgacttgcccaaggctgccccactaacaggtgccagagttgggattcaaacctctccaaccaccagagcctgagctgctggctctgccctgtgccgtcccctcccagccctgaccctgtcttccctcctctggctgcgacaggagggagagactgcggccttgctgaacctcagctgcatatgtgggtattagggaatactcaatttttttgttgctttgtgcatgtcctcaaatgactatgaaagcaccttgagtattgattttgggaattacaaacatgttagccactaggtgaatgcatcagcgcagactacacaaataatcaggcatgtgaagagcaggaagtggcaatgggataagaaggacttctctagggaagcctgaaatcagctcccttttcaggcctaaacgttttctttgtgccacaaaggcaaaccactcaaaaccttagtaaacatttcctcaactgctgagttctcaagatgaacaatcccgagtcctttttttcaaggaatgctcattctaaaaggcagacagaagtatactcaaatttggtacaaggtgtaacacagatagtgaatacatgccaagtgtcctgaaagtagagaggaactaatgactgagaggatgaccagggaaggctgcagggagaggatataagaggagaaggggttggtcaaggaagcagggcacaggaacagcaccctgattcagaagagcatggagcatgagcggctgggctctgccagcatgtcaagggtctggactttcttctgtaagcaatgagttgcctctgaagactatcagaattcctagaaagaggagcattttgaagaatctctaaccttttggagtttgtacttatttctatagcctaatggaatgtacacttattaacctttctgagaagatatctgtgtgaatttgtcaactgcctgtttaaaatgttgttcaaatgatatgaaaatttggacatcatactacttggaatttagctctttattggaattctaggacttgggacagttaagattgaagctggatataaaatgtatttagaaataatgaaaagttgacttcgtctttttaaagttaaatgactaaacaattaaaatgaataaacaattgattttcttttcatatatcaaaggatcatttaaaaatagtgacaggtagctgggcacagtggctcatgcctgtaatcccagcactttgggaggccaaggtgggaagatcgcttgagcccatgagttcaagaccaatctaggcaacaaagtgagatctcatctctacaaaaaaatcaaaaaattagctgggcatggtggtgtgtgcctgtggtcccagctactcaggaggctgaggcaggaggatgacttgagcccaggaggttgaggctgcagtgacttgtgctcatgccactgcactccagcctggacgacagaacgagaccctgtcttaaaaaatgttttaatttaaaaaattaggccaggcgcagtggctgacgcctgtaatcccagcactttgggaggctgaggtgggcggatcatgaggtcaggagattgagaccatcctggctaacacacacagtgaaactccatctctactaaaaatacaaaaaattagccgggcgtggtggtgggcacctgtagtcccagctactcaggaggctgcggcaggagaatggcgtgaacttgggaggtggagcttgcagtgagcccagatagcgccactgcactccagcctgggcgacagagtgagactctgtctcaaaaaaaaaataataataataaataaaaattaaaaatgaatttaaaaaataaaatagtgacaggcaataatatacagaagacatatggaaagagaatagttataagattaaaataacagactagctttgcttgtaaaaatctgggctcattttgttgccatataaaaatcaaataccctaagaaagaaactggcctttgtaaaatggtagtcataattagtagtattaatagcacaatatggatttatctaaaccttagctaaagttctaggaatatgaaaacattattcagtaaaatattagttcagtaacaatttgaagaaccaattcaatgtgattccaagattggcaaaattaaacacaactgacatgagctagatttcagttaaaaaaactaatggaggctggacatgatggttcatgcctgaaatcccagcactttgtgaggcggaggcaggagaatagcttcagcccaggagtttgatcaaagaccagcctaggcaacacggcaaaactccatctctacaaaaaattagccaggcatggtggcgcacgcccgtagtaccagcaatttgggaggctaaggtgggtggaatgcttgagctcaggaggtcgagactgtaatgagccatgtttgcgccactgcactccagcctgagtgacaatgtgagaccttgtctcaaaacaagcaaacaaacaaaaatcccaccaaactaatagatccaaggtgctggagttagcagcctgcatatttttcagtcagatccccttcactgaggcaatcaatacaaccagccgcatctggtgtaagatgatggtgtgtctactgattgaaagacattggagctgatttgaatttctggctattacaaatacaactgcaatgaacatttgagtatggttttgtgtacaagttttcgtttcttcagaagaaatgtccagacgtgcaactcctgggtcatataacacttgtatgcttaatttttaaagaatttgccaaactttcttccagaatgcctctaccattttacattcccagcagcaatttagtttctctgcatctttgccagcatattctttattttaacaactgacaggtatgtactgtaatcccattgtgttcttaatttgcattttcctaatggacacagatgtggaacatctgcatcttcacatgcttatgtgcaatccatatatcctcttcaatgaaatgtctcttcctatttttttgcccatttctaagtgcattctttgtgtcatttttactaagttttaagagttccttttatattctagataatagctttgtcagatacgtgtggctggcacgaatcttctactctgtagcttctcttttcatccttttaacagggtctttggcagaacaaaaatttataatttttatcaggttcagtttatcaactttttccttttatgaatccttgtttctggtgtcaagtctaaggatccctggcctagccctagatgctaaatatttactcgtgtttttttctaaaaatttattattttgtaatgcagtctataatccattctgagttaatctgaaatggaattcagaggtttaaactgaggtctattttttgcctaaggatgtccaactgctccagcaccattgctgagaaggctgtcgcttcctccatttagttgattttatatctctgtcaaagatcaggtgagcatattagaacatactgtttttagaaatacgttaaagattccaagcctatttcttaggtactactctgatttcttacctttgtagtaagtactatcttccatatatcgggataatccaaagtctcctaattttacacaatcatttgaggacaccagaacattccgagcagcaatgtccctgataaagaagaatttgagacaataagacttaaaataagaaaaacaaacatacaagctcatatataaagacataccaataggcactttgaaagacagcttatatacaatgcgagcagattatatgatatttattataggatatatataataaatctcatatatacacacacacaaaatttacttcatatatattctttttgccagatatttacccattaatacaatgattattctgaatgatggcaaagtacattctaaaataatgaaaatccttattactgttcataaaaccatactaccaacggcattaactgacagtgatatacaactggggcctataacactgccattactaaagagatatcattaaataaaagttgccttctgaaaacttgtaaatgattttgctgatgcagcttatttttttagatgcttagtttttcttttctttttttttttttttgagacagagtctcgctctgttgcccaggctggagggcagtggcacgatctcggcttactgcaagctccgcctcctgggttcacaccattctcctgcctcagcctcccgagtagctgggactacaggcgcccgccaccatgcccagctaattttttgtatttttagtagagatggtgtttcaccatgttagccaggatgttctcgatctcctgatcttgtgatctgcccgcttcggcctcccaaagtgctgggactacagctatgagccaccgcgcccggcctatttcttttttttttttttggatgaagtttgtattaatgccggataacaaaaacaccaattctaatatgatacttggcaaacaaattttaagggtctttacttgcattcaaacagagactcaggctataaacagaaattccacagaatgccaacagatgtcactcataaggttgtgttgtcctggagagttccaggacaatatttgttttagagaccacttccacatgttcactgctctgctgccaagtacaggttctctatagtgtttgtgtagggaataagtgacctgaaagtatcacaatgttttaaactccacgtgtgtaaaaatcctgtaaatgtgtattaacaagccatggcatctcactctgataggacataatgcagcatgacttgctattaactgtgtacaatagattccaatggtatacagaatacaattttgtagaattggtacaaaactgtaccaaaggggaccctggatccaaaagggtccaaagacggtccaaatgggtccctgtttcttgatcactacttttcagaagggaacttaacagctttatgactgtatcttacctgtgtacaaatcttttgctctctagatatgcaagagctgtactaagctgataggcatacaggatcaaagatgctagatccaaactgtatttccttacttgcaaaaatgacctcagcttttggaacaatgaccaaaagaaaaaaaaaaaaaaaagaattagtggcagtgaatcgaaatcaaaagcaaaaaagctacattcaacaataatgctgttttcaatgcatttttaataatattagaatggcttcaagtctcttctaataaagcataataaatgaaacatttaaactctggattcagattattttttatttgaaatcctatcatgaaattaaaatatttttgactaacgacaaatttcttaaaaaatatagaaagataagcttcaatggaatgaacaaaagcacagtacaaattattgctaaataataataacaactggaagaaaaaagatctagttactatccaaacaaggctaatacacagtcagttatctccacttcaaaccttactgtggctctgcgaaggtatgaggataatgtaatgcggagaaagcagggacaagaaggaatctcccctcttatttccttccccatgaagttttggatgcagaagcacagaacagtcatgttgggtatttatcacaatgtacttacttgttcatgctaccactgacaccattaatagaggtaaatgctgacatggcaaagaaaggcagacacaattaataccctaattctaaataattgatgagagaaatatttagccatattttttgagccggaagaattagcaaactctccaaaagcaaaagcagaaaagtaccgtgaacaagaaattatacataagcactccatttgatttggtggaggaggaagagatgttcagctgatgaaatcacacaatgctcccccggcccagtgtttgattcagcaggcctgggatggggcacaagaacttgtttaatgagtttccaagtgttggtgatgcactgatttgtttctgtattctggagaaagtgagagagctattcactcaattactcacatttttaaaagaaagtacggccatgcacgatggctcacacctgtaatcccagcactttggaaggccaaggcaggcagatcactggaggtcaggggttcgagaccagcctggccaacatggtgaaaccctgtctccattaaaaatgcgaaaattagctgggcctggcagcacgtgcctgtagtcccagatactcaggaggctgaggcaagagtagtgcttgaacctgggaggcggaggttgtaatgggctgagatcgcgccattgcactccagcttgggcgacagagcgagactctgtctcaaaaaaaaaaaaaagaaaaaagaaaaaagaaactgtgatttaaataagttggtttaaaaggtattactagccaggtaatcagaacactttgcgaggccgaggcaggcggatcacttgagccaaggagctcaagaccagcctaggcaacatagtgaaaccccgtctctataaagaattaaaaaattagtcaggcatggtggcatgcacctgtagtcccagcaactcgggaagttgaggtgggagatcgcttgagcccaggaggtcgaggctgcagtgagctgtggttatgctactacactccagcctgggcaacagagggagactttgtctctcaaaaaatgagatgctacaaagtgaattcccaaaaagataaaggaaatgtttagacttacctaaatttagcattaatttacccaaactccattaagattgcttcatcctcagatcactgggctagttttttaggcaatggcaccagagagaaaaaataaaaccaaacatttggccatctgcggctaccaatcctgataaagtacttggctggggaagatattgctgccagtactgcataaggggatgctttgggaatttaatgatgaagatatttatacccatattctctgaaccaaaaccataatgacatacatcctaaatcagaactctcctgaaaatccaagatataaactgtttatattttcctttcttaagcaaaagatatcaaacgctgagtccagaaggtaagatttggggatcacagtacctctccaagtgtgcacagctccatgattatccagacaggattctctgtgatgactccaatcagcttcacaatatgaggatggtcaaactgacgcattgttactaggaaaaaagttctccatagttattctttcttttttttttttttttttagacggagtctcattctgtcaccaggctggagtgcagtggtacaatctcgactcattgcaacctccacctcctgggttcaagtgattctcctgcctcagcctcccgagtagctgggactacaggcgcccaccaccacgcccggctaattttttgtatttttagtagagatgggatttcaccatgttggccaggatggtctcgatctcttgacctcatgatctacccgccttggcctcccaaagtgctgggattacaggcgtgagccaccgcacccggcctagttattcttttgaaaactctttcagcttctctgaagatgaattcaattaagacataaggctggcaataggggaactttaaaactcaattccacaggtcagttcagctcacaaatgggcataaattggcacaaaaaggtatgtcctactattgaggtgtaaggtaacctctaagaaaaatccttctttccttctgcatatgtggcaggggggaagaggaagaaagaaggaaggggaggaggaggagaagaaagggggggggaagaggaggaggaggaggaagaggagggggaagaggagggggaagaggaggaggaagaggaggaggaagaggagggggacgaggagggggaagaagaggagggggaacgggaggaggaggaaggggagggggaagaggaggaggagaaggaaggggaggctgaagaggaagaggaggaaggggagaggaagggggaggaggaagaggagggggaggaaggggagaaggaaggggaggaggaggagggaggaggagggggaggaagggaggagggggaggaaggaagtaggaggagggggaggaaggaaggaggaggaaggaaggaggaagagggggaggaagggaggaggaggaagtgaaggagaagaaagacgacgacaaccatttcttttttcctatggacatatgtgaccttggggtagcttcctaggttttcctctagaaatctggtaagtaggagtgtgtaattcatttactaagcaaccatctttacagtaaaaatcactcctgactggtgaattgctgggggaggaggtgaaatgggattaaaaatacctggtggaaagctatagctagaagctgccctgagtgtggagactatggtaactgggtgtgttccttgcaaggccctggaagccacaacccatggggcactcacaaaggatttctatcttagacataaatggttcctgcatccaccactgtggtcctgtcctcttaaatttaactggttgctttcagggccctataaaagactttctactgggcatggtggctcacgcctgtaatcccagcactttgggaggccgaggtgggccgatcacctgaggtcaggagtttgagaccagcctggccaacatggtgaaaccccatctttactaaaaatacagaattagctgggcgtggtggtgtgtgcctgtagtcccagctactcaggaggctgaggcagcagactcacttgagcctgggaggcagatgctgcagtgagccgggattgcgtcactgcactccatccagcctgggcgacagactgagactctgtctcaaaaaaaaaaaaaaaaaaaaagtttccaggacagccgtgaggactttcacatgagagaaatgccagctgctgccttttttggcatactttgtttatggtcctgtactactactctcaggagagtctgatgctaaatgtggcctatggcagtaacatgagtttgaccgcctaattgagccaagatgaccaagagggcactgcatatagacatacatatctgtgtgtgaacatgtatgttaaggtgtatgcatttataatttctagtatcagggctaagaaggttacttgtacagtatactaggattagtaagacacaggacagacttcacagaactataggatctcaaaactggaagtgattttaaaggtgacctggtccagtgggtccaaaaacacctgatttcacagactataaaaatggggaaaaataattctgatgccaagcaaggaaattagaataacagaagtaattttaaaaatacgatcaacatgtaatactgccaacatgttacagaatagctggtatcgcccattgtgagaaaaaactgtgaaagactttgaaatgggcaaaacaatattagtgggtgttctgtctagctcacttatgtgttttacaagttttccctcatattccaagaacaggacctggtagtttttttcaacaaacatcaccaacaaaaacccatataatgtaaacacccagcacataatccaaaacatataattaaatctcaccttgtcacattcagttcattgcttataccatgatatttttggataaacactcaggcacccagcatattcacaaccgtactttcaatttactgtaagtaactatttattataacttttggttttatgttattctcacatataattatcaagcctttcatatttcctcagaagtaattattagaaacacaaaacagcacaaggctaagagagtcttgtggccactaggaaactctacccaaactgaactaaaaatcaacacatagaatagtttcccttgttatttacccatctggggcagaaagctaaggcccaggggctgccatctgcttttgtaaataaagttttactggaacatattcttgctcattcttttctgtcctgtctgtggatgtacaatgacagagctgaatacttgggacaggggctgcatagtctgcagaacctaaaatatgtactatatggccctttaaagaaaaagtttaacaattcctgatcgaggccatattttttctcttatatatagcctggtaaagccctacagaagtttagatacactacatctatcacatttccctgaaataactgctgagtaacctctcagagaagaaaacaattagtccgacttgactactcctataaaactatataactgatttttgtaatgacaattccaaagtcctacaaaatcacaacatagtaactgttcagaattttaggaaaagataaccaatttttaaaattttcatttttgaaaatataaaatgcacaagaataccagcaaaggtaaggcagatatggtgttgggtgatgatgactgatgtggtctgttttcttggcctaggtgctatgcagaaatgaactagtcaagacagaagtcattggccaggccttctcttgtacttaagtcaaagtttcaggaataggattaaggatgtactaagacttaattaatgtagtcaccacatggcttactctatgaattattaatttattggactgttgggtggtatttattacaatggaaaacagaaggcattcatttgatgcacatataatgaaggacaccagaatgacaaacatctaccaggtgttctctaggtgtcaagtactgtgcaggacactgagtatggagtggtgagcgaaacaaacatggtccttatccccagggagcttaaggcctagaggaagagaggaagagacaggcaataatcacttgtaaacaatgtagctttaattaggaatcattaggaagaaaaagaactagtcttgtgtgacaaaaaatagtaaggggagactttaaatatggtggtcagaaaaaggttctctattggaggtaatgtttaagctggggcctgaagcatgagaagaggcaaaccataggaaaggaggaagaggaacatcaccgcttgagggcaggtaaggaagagcttgatgtggacaagatccttgctctttaagagcttacatttgggaaagaagacctattcatgcagagctcactcaaggaagcttcttcagaggaggcacaaaccaagagtcagaggaatggaggtggagaaaattatttctaagggctgggcacagtggctcacgcctgtaatcccagctccctgggaggctgatgcaggcagagcctagaactttagaatagcctgggaaacagcaaaaacctgtctctccacaaaacaaaaacaaaaacaaaaaaaccaaccaaccaaacaaaaatacaaaaaattagctggatgtggtggcgcccatctgtagtaccaggtatttgcagccccgagatgggaggatcccttgagtccaggaggtgacacagcgagacccgagacagacactgcctcaaaaaaaaaaagataagtgtttctagctaaagtcacctgggaagccgtcagaagagtcctttcctgaggtctcttcttgcgtgaagttttcttttcttttgttttttggagacagggtctcattcagtcacttaggctggagtgcaatggcacgatcttagctcactgctacatgggcctcccaggctcaagtgatcctcccatctcagcttcctaagtagcagggactacaggcatgcgccaccatgcccagctaatttttttaatttttaaattttttcatagagacggggtttcaccatgttgcccaggctggtctcaagcaatcctctcacctcggcctcccaaagtactgggattacacgtgtgagccaccacacctggcctccttttgggtgatttgttctttttctttctttcttttttttttttgaggcagagattgctctattgcccaggctgaagtgcagtgttgctatctcggcttactgcaacctccctctctggggttcaagctattctcctgcctcagtctcctgagtagctgggactacaggtgcgtgccactatgcacggctaattttttgtatttttagtagaagactgtttcaccatgttggccagactggtctcaaactcctgacctcaggtgatctgcctgccttggcctcccaaagtgctaggattacaagcgtgagctaccgtgcccagcctgggtgatttgttctgattttgtagcaggacaaggggaatggtcatagagccctattccttcactagtctatgagctccatcagggcagggactgtgtgtgtcatgctcacctctgcattcctggggtctgggcagcatcaacattaggatcacttatatatctgcaccaattccagtgcaaagatgtgtaatggcctaagtaccaaagtataaagtaaatgcacatcaatctacctttacacataaaacatgatggtttacctggaaaaatctgtagataggtgcttgtacaaatttagacattaatttgcaaggcaaaataataaacatagttgtctcctaaaagtcaaaacactatttttcttatttcttcagagacagtttggatttcacagatagaaagtcaaatggagttccacagaaatttctagacacttacaggcttcttgaagaaatttctctctcacgctgtccgaagtacagtttttacatgttttaattgcaaccgccaaagctggattctcctgtgttagggaaattatagaatcacacacacatgcaaaaaggtttgctatattaattgattcatgaaaacctgtctgttttgcaactatgtgggttatggaccagacagaatcagaacggcaaaatctcaagaatgagagggatacttaaaaacactcagtataaaatcccctgagaaaaatggtcatgcacgtgaaacattacagcaaatcatttattcattcatctacaaacatgtgttagagatacaccatgtggctggtactattctaagtgcttgggatacactgatgaacagcagaggcagcagtccctgtacctgtcacacttacactccagtgaggaacacagataataaataaagaattaattacatagtatgttagaaggtaaccgtgttacagaaaagggagagagcagatcaggatatggagacagggatggaggctgctgtatgagggggacctcactgagcagatgagacaagagcaaaaaaactaaaggagggaggagagggagctggctaagaaacagcagggaacagtgtatagcgtgctcaaggaacatgagcaagccagtgaggctggcacagagggtggaaggtaggagggtgaagatgacagagtcagagaggaacggaggggccagaccacacagggccttcaaggccaatagaaagatgcgacttttactcaagtgaaatggagagccaaggtagggtttggacattggagtaccatggcctgacccaaaattttgaaggagcattctgctgtggtactgagaaatggctgcagagaggcaaggttagagacacagggagttctgcgggtggctaccacagtaccccaggtgacaggtgacaggtgatggtggcttggacaaacatggtagcagtggaggtggagagaagggctgagattctggttatactctgaagctagggcaaaggtggctcatgatgcaggtgtgagagagtcaagttcaggtttttgaccagaaaaactgacaagatggaaggggaagatcagaagctcggcctgggatgtaataagcttgagatgtcagtaagatagccaagtcacacaggtgaagtgaccagcaggatactgtgactggcgttcaagaaagaaatctgaactggacatagaaatccagaagtagcctagcccatgtgactggacgaaatcaccaagggagatgagagaggtccaaggactgtgctttgaagctctccaacatgaagaggtcagggacaagagtggaaaatgtcaaaggagactgagaaggggtgaccaggaaggcaggagacaaaccaagaaaatgtgttgctctgaaagccaaaaagtcattatgcacacttactattgtctttcacattatatcattttatatattataattatacataacacagagataatattgtcatttacataactactgtctattctccatcactaaaatgtaagtttcaagacagcaagtaacttgcctgttttgtcaaaaaatccccattagtatagcactgatgcatactatatgctcagtaaagatctgcagaattaattaatgctattaatatatttcttttaaatgaagatgttcattaataagttagatgtgtcatattttaaaaataccttaaattgtgttttgcttaacaagttagctgtcgcatactttcaaaataccttaaatacctttatttattttagacttcacactagttgtatactatgtgtttccaggaaataaaacattttcaaacaagagaaatctgaatggtaagagaactgtatcatcgactcagggactgcattccctttcttcacctccagaggaggcatgcccatgtgccagatgcctcaaggaaggggttcaggtggtaatggtgacgtggtccttggaggacagagtagttggctcacacagaatgtgaacaagagcacagaataccctatctactaaatgtttgagtttacaaccttagaatcattaaccgtatctgtgctaaaatataaccactttgctttgaatgagtcagtcttgtcttccttaattagactgtgtacttctttaggaccatgaccatgaattctttttctagctaaatatgaggctggctgcaagtaacaggtatacgagaaaactgtatggctggtatactgtaaaactgaccgaaaatgtccattttatagacgatcagagcaacaaaatctttgataagaccttaaaaccatcattaatcctgtcaactaatcaaatactcagtaaacatggtgctttattaagacagtctaaggaaatgcaaacaaaatactgctctttaaagacctagggtttcaaatgaatgctaagtgtaagattccatagctggcaaatatacaaaatgccaacatgagcagattatgaggctcagccttcggtttggcgaataggacatgcggctagtggcccctaaagtggacagcagaggtctagggaatgctgaactgttagaagggccagttacagagatcggactgctggagaatgggtcagttcaaagtaagtaagaccagaacgtgtgcaaagggttttttctaaaaactaaaaagttactaattggtaattactcaaaatagatttttaaaatcttcgtaaaatacaggcaatatttagggaaaagagaagtttttcattgttcaatgaaaataccaccttgtggccactatgcctagacaagggatgcaagattaggctctgaattaataacagctagtagacgtttaaaatatcttaacaaataaatgtagaaaaaagctattctaggatgaattaagagaaaattagatttaataacggattttaaggctgcgaataataatgagagaatgtgccagtgatcagcaggtgcttgaaggaaagaaaaaacaagcctgataatcttgcctaataaagaaaaaaatgtgtgccaatcagataaacttcatgtttactgactctcagaatgaaggtcaaaattcttacctcaaggttcacatggccccacacatgtcccctggtggctctcctagtctccaaaaggtttccttttgccttccctttgtttcctatccctctactccgcggccacaccgtcctcctggtggtgtactgtcctgccccgcctcatggcctttgcactggctgttccttctgcctagaacaggcttccccatgagaatgctcaagctccactccctgtcttacttcaaagctctgctaacacgtcttgtcagaagttctttctgagcatcccatgtggaacagcatcttgacctcccattttccatgcattgtttttctcagaccctcttgggatttagcgtacgtcttttttgcctgtcaacttgtgccttgggtagaattaagttatatccccccaccacctagaaacagtagctgtcacagagcagaaaatgattacaaaattgctcaaagaattaactgaaccttaaataaagtatccaatggttggtccttgcccatgaaatttatgccacgttacattttgaccaatcatcaagaatgcttgataaaatattatttgattttacagaatactaaagaacatgttctagaaaaaggatttataatagaaacttaagagaaatgaacagactgctttgcactataaaattagactcccacattaaaaacaaaacaaacatatacaatatacacaagaaagaaattcaacaggccgggcatggtggctcacatctgtaatcccagcacactgggaggccggggcaggtgggtccctggaggtcaggagtttagaccagcctagcaacatggtgaaaccctgtctctactaaaaatacaaaaactagccgggtgtgatggtgtgtgcctgtaatcccagctagttgggaggctgaggcaggagaatcgcctgaacccgggaggcagaggttgcagtgattggagatcacatcactgcactccagcctgagcaacagagcaaggctccatctcaaaaaaaaaaaaaaagaaaaagatatttaacaaaatgtgaatccttggggactggaattcattcaacaaacatttagtaaacattagattatgggccgggcgcagcggctcacacctgtaatcccagcacttcaggaggccgagatgggcggatcacctgaagtcaggggttcaagaccagcctgaacaacgtgaagaaaccccatctctactaaaaatacaaaattagccgggtgtggtggcacctgcctgtaatcccagctacttgggaggctgaggcaggagaatcgcttgaacccgggaggttgtggtgaactgagattgcaccattgcactccagcatgggcaacaagagggaaactctgtctcaaaaaaaaaaaaaaaaggcggggcgcggtggctcacgcctgtaatcccagcactttgggaggcagaggcaggtggatcacgaggtcaggagatcgacaccatcctggctaacccgttgaaatcccatctctactaaaaatacaaaaaattagccgggcgtggtggtgggcgcttgtagtcccagctactcgggaggctgaggcaggagaatggcgtgaacccgggaggcggagcttgcagtgagctgacatggcgccactgcactctggcctgggcaacagagcgatactccgtctcaaaaaaaaaaaaagaaaaaagtaaatttagattatggctattttaaaaaattatcttgtattttcacaactaaaatggattacgtattttaaaagtgaatgaaataaagtccactaaccctgctattacctgtgtttaagtcatggtactctgggaactttagaatgcttacctatcaggaattttggagattataggaagctcagagataatttagttacattccagtaatgtagtcaccttatctcccccaatctcaaactgaggcagagccagatctaaatttgtctgtttgtttctttttcactaaatttgcatccattgctccttctactctactttgcctcaaagggcagagttaagagactgtggaatatagacaatacacccatagttaaaaaaaattgaaaaaggagtaaaaaacagcaaaaaatatacaacaaattatacaatttgatataagcacaagagtaaaggcttccaaaagtgaactaatttggttagtttactggtggcaattatctgttatctttgattaaaaaaaacccttttataacttttgggttataaaagtaatgctcagagcatcactagtacacgtgtaaaggacattaaaaatgcataaacatggagttactgaagaaaaaaatggtcatttgcagtttccaagcaggggtataaaataagagtcaattttctctgttattgtaactttattagagccatctctgttcacctgctactattctagttcaaagacagtttcttgagcaagcatgtcatgtgccacaaagtaacattttggtcaatgatggaccacatatactatagtggtctcataagattataaagaagctgaaaaattcctactgcctagtgacatgacagaaatcaaatttcttatgtgatcatggtgatgctggtgtaaacaaatttaccgtactgccagtcatataaaagtatagtacatacaattatgtatagtgattaatacatgataatgataataaacgactatgttacaggttttgtgtatttactatactttgtttttctttttttctaatatactacacttttaattgttatcttagagtgtactcctacttatttattttttagaggcagagtctcactctgttgtccaggctggagtgcagtggtgtgaacaagacttattgcagccttgacctcctgggctcaaatgatctttcctcagcctcccaagtagctgagactacaggtgtgcaccaccaggccaggttaatttttaaaattttgtttgagacagggtcttactaagttgcccaggctggtattgaactcctgggttcgagtgatcttcctgcctcagtctccaaagtgctgagattacagtcataagccacagcaccagccccttctacttataaaacaaaacaaaacaaaacaaaaactagttaactgtaaaacagcctcaagcagggcctttcgcaggtatccagaaggaggcattgttgccctaggagatgacatctccatgcacattactgcctctgaggaccttccagtgggacaaggtgtggaggtcgaagacagtgatgtggatgatctcaacactgtgtaggcctagcctaatgtatgtgtttgtgtcttagttaagaaaaaagtttaaaaaattaaaaaaatttaaatagaaaaaagcttaaaaggttcatgatgtaaaaaggttacaataagctaaggttaatttagtattaagaaaagtttttaagataaatttaacgtagccaaagcgtacagtgtttatagcctatagtagtgtagtcataatccaggccttcacatttactcacccagagtaactcctagtcctgcaaactccattcatggtaagtgccctatatgagtgtaccgttattttatactttatactgtatttttacagtactttttctatatttagatatgcaaataccatgtgctacaactgcccacagtattcaatacagtaacatgccatacacgtttgtagcctaggagcaacaggctatattatatagcctagatgtgtagtaggctagaccatctaagtttgcgtaagtataccgtgtaacgtttgcacgatcatgaaatcgcctaacgatgcatttgtcagaaagtatccccatctttacacacggcacatgattgtactattagtctaaagtgtcatttaaaaaatcaccaatctaatttaaaaagacatgcaataacaaatgttggtgaagatgtggagatctgcagtcttatacgctgctgctagtaatataaaatggtacagctgtgttggaaatcattttggcagttcatcaaaaagttaaacattccagcctgggcaacatcatgggaccctgtctctaaaaaaaataaaataattagctgggaatgatggcacacacttgtagtcccagctacttggtaggctgaggtgggaggaccacttgagcctgggaggttgaggctgcagagagccatgattgtaccactgtactcccttggtgacagagtaagaccctgtcctaaaaaaaaaaaaaaaaaaaaaaaagaaagaaagaaagaaaaagttggctggctcagtggctcatgcctgcaatcccagcactttgggaggtcaagacaggaggatcacctgagtccagaagtttgagactagcttggaaaatgtagagagacgctgtctctacaaaaaaaattaaattagctatgtgtggtggcacttgcctgtagtcctagttacgagggaggataacttgagttcagaaagtcgaggccacggtgagccatgattgcgtcactgcactccagcctgactgacagagcaagactctctctctcacccacacacacacacacacacaaacaatagttaccatatgatgaagcaattccactaataggcatatacaaaagagaactaaaaacataaatccagggccgggcacgatggctcacacctgtaatcccagcactttgggaggccgaggcaggcggatcacaaggtcaagagatcgagaccatcctggccaacatggtgaaaccccgtctctactaaaaaaacaaaaattagctgggcgtggtggagcgcgcctgtagtcccagctgctcaggaggctgaggcagaagaatcacttgaacctggaaggcggaggttgcagtgagctgagaagacaccactgcactccagcctggcgacagagcaagactccgtctcaccaaaaaacaaaacaaaacaaaacatatatatatatatccacagaaaaactcatatatgaatgttcacagaaacattttaatagtcaaaaagtggaaacaacccaaatattcatcaactgatgaaaggataaacaaaaggtggtctatatctatacaaaagagtattatttggcaataaaaaggaatgaagtactaacacataccgcaacatggatgaaccttaaaaatattatgctaagcagaagctgataataaaaaatccatatattatatgtttcatttatacaaaatgtccagaatatacaaatctatagatacagaaagtggatgagtggctgccaaaggctggggaagggtggaatgggaagtaactgctgctaatgggtataaagtttctttttgaggtgaagaaaacgttccaattgacagtggtgatagctgcacaactttgtgaatacactgaaaagcactgaattgtacacttcaaaagagtgaacttcatagtaagcaaatgatacttcattaagctattattaaagcaatcatttttaaaatttattcatcttttttggagggtaaactggggcaaattaacatttctttctcaaaaatgcaggtaaataggtatactggctgtttctgactctcatctgatttgctaattccatccaaagaacagtcacctataaaaactgttactgatgacaaaggctgaaagattaaaatgaataaaagacaggcccagccttgtaggagctaatgttgccattttttggtttctgaatacgccaagtataagctgacatttatgaagagctttataaaagacacccgtaaatattaatacctagaagaactaaggactcatgaagacaaacaaaagcaatttaaacttaaatagtcaaaattagtctagttgtttggtagtcttaaaagacttactggactcatataaatgccttgatgtacatctccaaattggccttctccaatacatcgtccaagttctattctttctctttgaatctcataatccctggctgtaaaacataattcacacatcaatacttaagtaaaatattccaaatgtagaaataacacttgacgtatttcttgatcatccataagtaaaatttcatctgtggcacatcaatctatgaaaatgctttaaacacagtggaattctcttaaacaatattttaacaggaattcatgtaattagttatggtattagaagaactactgaaacaatgagttctactaaaggtagatatttttcatgttgttcctaggagtttttaaatttccgatttattttatatctatttgatagttttctaaataattgccccaactattaaattatatgcttaactattaagaactattagtttaggtattaatatatgaaggctataaaagcacagttattaaagcaattattttacaaataactacagtttgtaaatatggaagcaacataaaattatgtcataagtaaactttatgttttgaaagtttaagagttttccactttatgataatcctatctctacattactcatggagctaaaagagtttaaagaggtagtttcttaaaactaatttcaaagttagatgactcagaatcaaggttggatgtatcaacattataaatcataaatatacttttgagaccatgtgcctcaaattaatatactgttattgtaatatacaaaatcgattattcagtaggtttttgaggcacatggaaagaaaatgcccattaagaatgtaatagattcaattataacccatttactacttggtattttgatttatttcaggtaagaaactcatctccataggttattgcatatatattccagtagtgtaatcaccaatgaaatacaccaagagccaaatatttttacatgttctccctggtttatcaaattataaacaacacagaacattcaacccaaaatttagacagttattttcctctttaaaatcactttagctagtagttccattgatttaacagtataagtaaaccaatgacaaatagtttaaaaataagttaaccaaaaactgaaacatcccatatcactccacaggttgcaattgcaagcaaatgcagttaatttaaaggaatcctgttaccttcatctattccatagctttctgtattgcaattaagagagaaaaaaattgaagaccttgcttagaaataactaacagcaattaggttaacaacacaaacttgaagagaatatttcaacaatacttaatttttaaaatattttaagcacaaatatgaattttaaagaactaaatacaagtaaaaactaaatatcttcaagttaactcaatgttagttaaacaatgcttttaagttcctatctcatcaagttcctgtaacttatttttgtcaggtatggatgaaagccatgttggacatttactgctcaactataaataataaatatacaaataaaaactggattatctgcaggaatgtacaagtgtctatatggctaattaaaaaagtaaacaagtgttttggtgttttttttttctttttttgtttttctgagacagggtctcactctgttgcccaggccaaagtgcagttgtgcaatcagggctcactgcagcctcgacctcacaggctcaaacaatcctcacacctcagcctcctgagtagctgaaacaacaggtgcatgctaccacgcctgcctaatttattttgtttttggtagagacaggatcttgttatgtcacctaggttggtaacgtactcttagactcaaacaattctcctgcctctgtctcccaaagtgctgagattacagatgtgcgccaccatgccaaaaagttaaacctaagtttaaacatttttccaaactgatactggcaatcaaaatgtacacacaagtttcagctctggcctctttcgagtaactctctagtcaagaagctcctgaaaggggacatgggcccacagggcacaatgcacacttgaaaggcaacactgggttgtttctcttcattccggtaatgcttcctcaatgtatacagaaaatccaaacaagaatatttacaagaatatttatactatagaataaggcacctataacatttattttacaaatatatatagctctactgaaatcaggacattcagattttgagttaatttctaagacttctgaagactctttaaaaggcaggtttaatttttttttttatactcaagtcagtactgtctggaacattaaaaaaataagaaaatgaaattaagaaataaatttctttttgcaaatgaaatttcaagagtttatctaattcaagatctggagactatacactccaacatgagacctggggcttcaagattttccttaatcaacaagctgcacatcacagagagaagcagaatcttgacatttccaggctgtatgaaggtcctttaagagttctgtttctctccccacacctcccatccctgaggtgtacaaactgacgatggttatgagctatttgtattggttagtcaatggcaacaaagaataaacaatttaaagggggaaaatgcaaatttttgaatatatgtgtgtgaaagtatgggtatacgtgtgtgtatgtatgtgtattatacatatatggatatatatattgtgtgtgtatatacacacacattcacatatatacttaaccaataatactaattttctacagacagaaaataccctaatcaataaaggttctattatgatagagtcagaaaacaagattacaaaaatcctgtaactaaaaattattacagatatttgagttttaggcttctgaccttagagtgggcatatgtaagtaatatagaatggtaaaggttgaaaagaatatttctgttcagcatccaaggaagtattaaaaatggctctaaaaagacagtaagtatcaataacttttaaatgcaaggaggcatctgtcaagtctgagcaagaacaaaatcagaagtttacttacttgagggcatggtgtaagtatcttcttcatctataatctcagcataatcatctgtttctgcaggaaaagaaacagatatgttgaaagaggttaaacatctgacctcctggtatttcatataattaaagtaggcaaagcgatctgcttaaatcctctactacgctgaaatattcttaaaacactattactcaaattttgctcacacatgagtcatttatggaaataaaagtgacatcattgtccaatacgttataatacacagacttgtttatcggagagcaaacagggctaacacagaaagcccttgtaaaaaacagaacgacatgaaacaactatgtatatgcttcaaattaaccaatctaccaaccgcaaagctcttcctcaactacaccaaatacatgtttaaaactacagttgtctactgggctttctccaaataagactggtatctataaaacacggtatctgattttattaacaattagacttgacagcataatctgaacggaacctttagaaaataaatggtacctaatttttgagattaactgtgctaattcattccatttgctcagggttgagaaatgcaacaggaatttgtttcctaacttttaaactcagatattttaggcattaatgtcaaaagggcagatctacaaagaaaaaaaggagaataagcagcatattacaatgaggttttttgagatcacgtcaagaagttccaatgtatctacctactctttttgggtaatacaccaacttaaaagtccaccactatattaatgggaaatttaaaaatacccatctgaagaaaacagtcactcatgtggtaacacctatactgaaaaaatcacttcagccttgtcttttttctctttctagaaaaacgaaaatcttcagctgctccatgtataaggattttaactgctgggccattcttgtgagtcagtaaagcagggacaggactttgtgatgcatcatttccaaggagctctattttgatactttgacctagcatccttgtttaacaccaatgaaacgaaaagctacaagttctttcttctgtgacgccttattactgcattcagatattaaaggtacagaattcaaagcaaatagagaatatatatggtttacagtcactgggatatcaatcattccacatctatggtaatgactgagatcaaatctacaagtggaagaattcacttcttattatgtaatcatcattaaaagtgattacagtaaaaaaaaaagttggggaagcagattataacaccaataaatcaattctctttaagacagttattatctgtaaactattcctaagtcctatatgacaggcagataatctatattattcttatacgtttataagaatacttaaaagattaaaaaagttttaatagactccaaatcatacattcttttatttctgtattctccctcttaatctgttttcagcaaatactaagaacagtaaattggcatctgtaggcctatagctctgcttctgtgtaagatggcttatcaaaacaccctgtgaaagaaaatttggggacggaaggaagctgctaacacacttgcaacaaaaaagactaagcaggggaggaatctactctaacagctaaggcaacagaagccacacaaatggccatttgcaatcatttctcttttgattccatagtttaacacgctcaactttgtgatactctcctcagaaaatgaatgcaactaaagctgtctttccacacaacagccctagcaccctcactgcttcctttcatataaagcacgtgcctttaggagtaaagcacatgaattggccctgctgcagcaggattttgggagagccactcaaactctgcacctctgcttcccttccccagctgccctgttatccaaactgctgaaaagtctctacaaccctgcacgtagctcatggtgttacgaagcagatgttttgcacttgtcaccacagcttcatatggctgcaaagttcattaaaagcctgttcagaagcccaagtctatcaggtgacaggtgtctactgccttaatgaagaagggcataaagctgctgctaacaccagtggcagtgacctccaactgagggctttaccatgcaccaaagcttatgctggcctagagccaattctggttttagccacctattcagagacctctcctcagactaatttgcccccatcccactgttcttaatcatgttccctgactcattttcctcattacctataacaacctgatataattttgtttcctgtgaactgtatgcccacctctctagaatggaacagccaccagagtggaaccttcacgtatcttgctcaacactgtgtcctcagcagctaaaacagtgtctagcacagagaaggtccctcaagaaacacatgctaaaccaaaagaatgaatgcactgcaacaatcagtaaaggaacgctatacccctaagaaactgaggcaaaggatttaatctgtgtgaggcagcacagaagtgaatggtagagctgcaatacacgtgacaaaatacacaagcccatttggggaaaactgcttgagctttggaaagtcacttcacctggcaatgcttcagctgtgccctcgtgggtaaaataacatcatctgccttgtagcactgttatgaggattacaggagacatgacagaaagttgagatgtgccctacacataacagatcatcaagcaacagtaactcctctgattgttttgcttcttctgagggctctctgaaagggacctggcagttgaggatttaggattcctgtgtgctgatactctcagccaatctttttggtttgacagcagtccttcaaggactgtctcattttataaaatcctcagtagagataccaacctctaaaataattgtgaaggagtaaaataaataggctaatatatatcaggctagcacacattgtggaaaatatcatgttgcatacatttcaattaattcatacaatcacaagagaaaacctgtaaatttctttcttttttttttttagctggatgaattgtacataaaatctctggggatgtatcaaagctgtctaggaattacttatatttgggttgcaggtgtgtgtactatgatgcaatgtgaatagagaattcatggagtaaaatcaacaatgttgcaggtaaatgatctgcaaaagtttataaccctctatatatgagtttcatatgtatggtaatatctggtgtatatttctaagaattcctttttttttgaagacaggttcttgctctgtcgcctagggtggagtacagtggtgcaatcttgactcactgcagccttcacctcctgggctcaagtgatcctcccaactcagcctcccaaatagctggaactacaggcacgcgccgccatgcctgctaatttcttgtaccttttgtagagatgaggttttgccatgttgcccacgctggtctcaaactcctggactcaagtgtaatcccagaatgctgagaatacaggcaggagccactgcacccagccttcccaagaattcttgacattgatttggctgtattttgcttttctttcctggtttttaggattgttaagatagtattacactgatatgataggtatttttacatattcaagggccctaaaaattggagtacagtctgaaacttcctgggccctccacatgttagtgtaacatagtttaaggaaaacagaaaaattaccccccaagggttaattcaaaagataaggaaaatacaaagaaaaaaggaaacaagttcaaaggcctgggcacaaatgaagctaggtctgcattctatatttaataatgacattgactactaatcatattattgggagcttaccatatactagatgctgttgtaaataattacatatattgtcatttaatcctcagcaaaattatttgaagttgtactatgatcaccatccctatttcacaggcaagaaacggtagcatacaaaaacaggtgggccatatttggtccatgggccttactgaccaagaccaagtgactacccttaaggctcagcttattcacctgtaaaatgggttaagtacacttgccctggctaattcatagtattgagaaattcataggtgggaaaatacatacaagtgtttgcagacatttatctaaattttgatgcttacagagtaatcctcacaacaaccacttgagacctttcccagatgaagacccaagagatgaagcaatttgcttgtaatccctcagctagtcagctgctgactggatggggcagtggaaaaagggcaaggctggagcctaagacctgaccacttgcctctagcagccttagagtctctcttaatcctctgattatcactttcctcacctgcaaaacagtgaggacaatacccagtgatattctgaatgactgctgtgagaattaggaatcaagtcagtaaagtgtcacatgcagaaagctctagatgaattgcagctgctaattgattattatcacagaattaatctaaaaatgaagctcaaatctctgacctcaaatcctgtgaaaaacacgcacttttaagaccttttactgaaactgcttagctcgttatactcgttatcaatatctctatcctattacaaaaatgaacataggtgaaatcttcagtaaaagcattctttcatttaatcaggaggaaaaaaatacaattccttcttaattttagtttataaaatcttactcctttagtataaaggaggataaagtttcatgcaagcagtatatgaagtagatgggaaatgtaagacatagaatgtgatttaaaatttttaaatttctaccttaagtgctatcaactatttgaaaaaccaattatcattattgctgatatttccctaattccgttagtttctgtgagtctttaaaatcatttttcattctttcctttctactatctcattcccaaactaagaattatcacacagataccacacttgggaaacagagtgtatggaccgctaccatttacagctttcaagtgttactaattttgcttttgacattttttaagaactctcaaagttttaataatgaaatctaggaaatttactaggaatacatacaactcaaacttaccactaaaatgtgattaagaaattgatagttatcctttccatgccaaagccctaagcaatttttaaaatattttgcataccattttgtacttggttctgttggatcaaaagcacattttgcctttcattaaatactaaactatatttattttcataaataattatctcatagcagtaacacaaatgtgaaaataaatattaccgtccccactaatttcatctgcagatccgggtggcatgcaaagaaagggaagtagggaacagagggagggagacataggaaggagaagagggaagagaggggaaaacactattaaaatgacaagtaaaccaaagtgtaagaaaaataaaaaacaattaccccccagggtttaattcaaaagataaagaaagactgtagtggtagtatgtttacttgaatttgagggcataatgctaagtttaaagctgtcaatgtattacatgaagttacacagctaaagtattacagagtgtaaactggattctgccacactaagcaaagttaatttgactgcctcttacaattaaattttaaaaatggtttctaccttcctcaaagggaacttgtgtcccctcagataaaaatgcaaacaaactagtcattaatctgtatgtttagttacaagaagagaataagccctcagcaagcccattccaataagccagtgggatttaaatattataaggtagacataggccaggcccactactataaactgtggggagtgcagtacttgaagctctgctgacaacgaaggttcccatttaagtttgcacagaataaattttgttttgaatagtctggagaaattactgtttcaattattataaataatctttgctttcctagaaaatgctccaaatggcatagctgcctctactatgcagcagccctaaatatctgtccccaaagcatgaaaagcagacaactagggagtcactttggccattctccttcattcagttgcatgctatattaggaaatccatgatgcaaaaagtgtgatcctgctgacctctgtgggaaaacactcaaacaacacaaatgaaactgagaagcgacttcttgccctgtcatgcatttaaaaaccagcaaacaggcaaacaaaaaatcttgtattcaagagagtaacccaaaaacagtgacataaaaccttgcccccaccccaatccccttattgcttctgaacaatgaacagcacatacactaatattcaataaagctatgatctgttcaggataatctataagcatcaggttagagttagtttctctggagtgctctggttaataggagagcctgtgcaaatatgagtgcagtacccgtagaaggaggatcatgggaacagaagaccaaagggagaaagcgcctagctttcttaactttatgttggcagtgactgactcctttataaagaggcaagaggggaaagagaaaaatagaaacaaattatttcaatacaaaagacaacttttgttacatttaaaggcttatctataaaaacagatacaaaattgcaatgcttttattttgactattggcatgccttatttcttactatgattgacttgagttttaaaaaacatactaatatttttaaatttaatttcctgtagattagcacttgatacagaaacaagacgtaagaatctcccagctctgtagagccagccagttgaatattcagatatttttccaaatgacaacagtcacaggaaaaaacaaagaccaataaataattcaagactcttgtgaacatttaacattcaaccatagcagaaaaatagcagatcttcatttgtgaaagagttttacgaacaactttccccaaatcattagcaaagacacactcacagctcttgagttatatactttacataaattaccttaacataaaaactggcgatgaggatctttgaaaacacaggttgcaaaacctctactagcattacggattcatttgctcactcattcatgtactcaaagctcattttagagtcaaaaagctggatcgataaaacacatctcagctctccagaagcatatagcaaaatgagaaaataagcagcaactgcagtatggtaatggcaatagtggacaagtgtgaaagtgaagtcaaagccagggatgcagggatgtagccctttaagatgcagcagtcattaacaaatgacagacacaggtaacatcaacatttaactgcatactcacggggtatcataaagaaagatcagaagtatggacccaagaacaagggtcaggactgtttgcccatcaagatggtaacaatcttattgacattgtcaatatattagcaacagaaatgagaacagaaatgtacacttcagtaatatttttcaaacggtatgctttgatcctattaacattttttttttttttttttgagacaaagtctcgctcttctcccccaagctggagtgcaatggcacgatcttggctcactgcaacctctgcctccgggttcaagcgattctcctgcttcagcctcccgcgtagctgggattacaggcgcctgctaccaagcccagctaatttttgtattttttttttttttagtagagtcagggtttcaccatgttggctaggttggtctcaaattcctgacctcaggtgatctgcgcacactggcctcccaaagtgttgtgattacaggcataagccaccgcgcccggccgatcccagtaacatttactgacaatttcatcttattgcttgacttaaaagctacctttacacacactaaatttctggactttgtatatgatggccctagaggaaagcataaactggtctctcagttaagaagatgggcctgccagcctgtgtaacatagcaagaccctgtctctacaaaaaaattcaaaaattagccaggtgtggagtcacgtacccgtgggcccagctattgaggaggctgagttgggaggactgctggagccaggaggtagagcctggaccacagaagcagagcctctgaactccagcctggcgacagagggagaccctgtctcgccaagatgggcctgacaactggatgcactgtgtgatgcaggatgaattctggactggaggctggggaagggaaagatcaggaagcaacagcgatacggaacattactggtatgaaataatttagactgcggataagagcatttcttcagtattaaatttcctgattttgataattatactctgatcacataagatgatatctttggtcttaaacacacactgaaatgtttataagcagcaccatgtctgtaacttgttttcacatggttcaaggaaaaaactaacaacaacaacaacaacaaaaaacccatagagtgataaagcaagtgagccaaaatataaatatagtgaaatggaggaaagaacatatgagacatcacgttactattcttacaactattctccaagcgtaaagttacagaaaaataaaagatatatggaacactagctctggggccagacagtttggattcaaatactggctcaattattcattctgaccttggatacactgctcaacttctgttgcttagttttcttattgtaaaatggggttataacagaagctacctccattaaggaggttgggaaaggattccatgggattctctgggcacccagaacagagtgaccactccacaagtgctagctcttcttacttttctactgttcatttctaaactggactgaatattctttatactaacttaaaaagtgaattttttaaaaaagtacaactctttttgagtaataccaagaatattatcacacatcataaaaacaaaaacaaaaaggattaggacttttattgtattcaagataatcattttaattattgaacacctgccataaactaggcataccatgtaggtgctggagttagaacagtgaacaaaatagaaacccaaactttcaaattattgagcttacgttctagtaagggagaaggaagataaaataagtaaattttatggcatgtcaacatgtaagtgctagggaaaaaccagcagaaggaatattttcaagtggggctaccattttaaatatggtgattatggagggagtcatctgcaaagacttccaggaggagagggaaagggccatgcacacatcaggggaggccaggcagcacacacacaggccttggctctgcagaggtcagtgtgaacacgtgctgaggagcagcagggaggtcaggtgaggtggatgaagagttgggagtgggaagggggaggtggcactgagatgcactcagtgaggtcccagagtgtctaagacctcttagctcctggtaagggcactggcttttattctaaatgatgtcaagagtcattcagaatattgtttccttttaaaggaaaagagagagttcctacattgtttcacaaattctaggaatgtgaagataatgggtaaggccactagtcaagaaaaaaatgcctttcaacaattgctccgggcccgggtgcaggataggggtgaggagggcatgactgaagccccatactcctgcctctctgggactgataaattttgcagacctcacatacctcaggctgctctgagcagcttttcctttctcaccagtccaactttctatgtgattacgctggttcagatttacctcagtctcaactagcttactgcaatcctacctattcccttttagaaggctcccaggaagcctttgaaaaatgacagacgatgtcactcttctcattctctgctctcttttgtactgagttacttgttctctttggcttttgcggtacagggattactccatactgtgagggagaacttgaactttgtatgtgtggcaatgtgtgatcaattggcaagtcaccagcaaaagctgcagttttggagtggctgacagtggtcacagtgaatggttataactgcagagggctacttacttctctacacatttagataagaaaagcagtttgaacacttggaggctaaggaaacactcaccaccaacgggtaagactcctatggaagatggcagaatgggctgattggtgttgggtcacccatcagcatcacaggagtgtctctccagcatggaacactgtggaacattgtgtagcgtggtcctattatcagaggcatccgacccagaacaactccatcttgaataggggctcggtaaaataagactgagacctactgggctgcgttcccaagaggtcaggaattctaagtcacaggatgagacaggaggttgatagaagatacaagtcataataaagaccttgctgataaaacagcttgtggtaaagatgctggccaaaacccaccaaaaccaagatggtgacaaaagtgacctccagtcatcttcactgcttactatatgctaattataatgcattagcatgctaaaagacactcccaccaatgccaggacagtttacaaatgccatggcaaggtcaggaagttactctgtatggtctaaaaaggggaggaaccctcagttctgggaattgcccacctctttcccagaaaactcactaataatccaccccttgtttagaatataatcaagaaataactgtaagtatccttagtccagcagcccacactgctgctctgcctatggagtagccattcttttattcctttgctttcattttaccctatggatttgcctcaacttctttcttcagccagatccaagaaccctctcttggggtctggatcagaactcctttcaggtaacaccatggtatttccctctttcgggggaaccaggattcaatgtaaaagtgggaaccaggcatggtggctcatgcctgtaatcccagcactaggggaggcagaggtgggcagatcacctgagctctggagttgggagaccagcctgggaaacatggcaaaatactctctttacaaaaatacaaaagctagtcaggcgtggtggtgtgtgcttgtagtcatagctacttgggagggtgaggtgtgagaactgtttgagcccgggagatggaggttgcagtgagccaagatcacgccactgcactccagtctggacaacggagtgagaccctgccttaaaaaaaaacaaaaacaaaaagtggggtccttgattttttttaagacggggttttgctatgttgcccatgctggtctctaactcctgggctcaagaaatctgcctgcctcggcctccctgaagtgctgggactataggtgtgagccaccataccaggcccttgatttttatgctgggccttccagctatgcctgcttttcaaatatttaaatactaggccctgaaaactgcaaatgctttatttgcccagttcattaaagggctccaacttgaagtcagtaatctaattaaaaaacaagctaagttgaaaaggacacctatcaaaataaatcagtctccaaaatacaactttctgacatttagctgcttattttgaaatcctctgtcagagaaatttacacctataaaggaaattaccatttttaagggtatcttcgcccctgcacctaaaccactaaaatattatcttcacattcctggaatctgtgatataaagaacaatggacaatcaatagtttattattattattattctcattgagagagtcttgctgtgtccatccaggctggagtgcagtggcgtgatcttgcttactataacctccggctcccaggttcaagtgattctcgtgcctaagcctccccagtggctgggattacaggcatccgccaccacacctggttaatttttatatttttaatagagacaggtttcaccatgttggccaggctggtctggaatttctgacctcaggtgatccgcccgcctcggcctctcaaagagctggcattaaaggtgtgagccaccatacctggccaatagttacattattttaatgccaatttttggtaaacaatttaagaactgtctgttcttttttcctttacaaatccacttgtaattgctgctaatcagagtacctatataggacaacttcaatctatgacttggtcttctaaatatattcccagtgtaaaccctaaaggaaaaaacttaggcaaaattaatataagtacagagtttatttgcaggagcaatttggatttgttaatagattggatatgggagaagaaaacaaagaatagcatcaaaaataaccccaaggataatctgaccagccagaaggaaagtagtgccatttagtgagtggagaaggggagagaagcaggcttggcgtgaatatcagttccttttgagtatattaagtctgaaatgcttatgagacatcagattccacatggcgagaacatagtggccacgggtctggagttcaagaaagaagtctgaaaaactaagataacaatctgagagtcagcagcataattaagtcatgaaacacaatgagatccccaagggtgtgactgtggctgacacaaagtgtcagaagaactgagtcctgggatcctcaggcgcgaagtgctgaataatgagtgaagtaggaagaatatggtattctggaagcaaaagcagggcaatttcaataaggagcaacactgaatcgcaataactcacataaagagttcttctatcataagcggaccagtgatgtcagaagggggctactaaggcggggaaaccacagtgggtgatgtgctaatgaaaccagagctaacctgattaagcctgccaaacttaacctgccttgtttgctgtattaggccattattgtattgctatcaagaaataccggagactgggtaatttataaagaaaagacgttttaattggttcacagttctgccagcttcatggaaagcatggtgctgacatctttttggcttctggggaggcctcaggaagcttacaatcatggcagaaggtgaagagggagcaggcacatcacacagcaaaagcaagagcaaggggtggggtggggaaaagccacatacttcaaaggaccaggttctaatgtgaactaagagccagagctcactcatcaccaaaggaacggcccacgccattcataagggatctgcctcatgattcaagcaccatccaccaggccccacctccaaaactggggattacatttcaacatgagatttgggcagggacaaatatccaaatgatatcagttgcttttagtcgcttagatctaaaaactcccactagcaagtcaaatagccagacaatccataactaaactcccattagcttcctgtaggtcactgcagtaatgggtgctttaagttgtttttcaggaagtagggggcagctcttgtcccgctcaagcagcttgaggccaccaatccttcaaatgggcttatgccaatgcaggagagatgaccatatgacatcagagagctgaaaactcttccctcagatcagggtaatgctaccattttctgaacacgcgttctatgaagagtcaggaagcctgactatgtgtgggcagatcacttattaactcacttttccttatacccaatcactttttcccatgccttcaactgccctgctcctctatcccataaatatccctaaaacttcatctttggagaggcatatttgacatttgttctctcatctcctcacacggcagccttgggaatgagatctttcccctttggcaaaacctgttgccacaatgattggcttgctgcacgttgggaaaaaaaactaacagtagtagagcagggaaaattcctgaccaggtaacaagtgatagagggtagactggtaacaaattagacttaattgggctgggcctggtggctcatgcctgtaatcccagcactttgggaggctgaggcacatggaccacttgaggccaggagtttgagaccagctaacatggagaaatactgtctctatcgaaaatacaaaaattagccaggcatctgtagttccagctactcaggaggctaaggcacaagaactgcttgaacccgggaagcggagattgcagtaagccgagatcgcaccactgcactccagcctgggtgacagagaggggctctgtctcaaaaaaagtagtagatctaactgggtgaggacaagtcatctattgtgagatcaaggcaggcagcacttatggctggcaaatgctggaggtttaaggaaaggttcaaagtggctgtgagatggaattgaaagcaagaccaaagcaatgtggttgtgctattcgctttacggttcagttgtgctacagcagacatgggacagaacgagctggctttaacttggccaagtgagttaaaaccaaacaaacgagtagggcagagatgatggggatgtaggccagggaaggatacaattattgatcaggggttttaggcttgttaagaaaccagagaagacaaaaaaatgtgatgtagacagcagaatggggatgggatcaaggacaagctagaaaaattggaggtggcagtcagagagggttttcttaaaattgaaattataggagagttatagttgtagataaagtgtaggtctcacaggaaagagaaatagcagacagcaccactggaagaatggagagaagaggtgctggggctgggcacagtgggtcacacctgtaatcccagcactttgggaggccaaggagggcagatcacttgaggtcaggagtttgagaccagcctggtcaacatggtgaaaccccgtcgctactaaaaataaaaaaaattagctgagtgtggtggcgcacacctgtaatcccagctactcgggaggctgaggcaggagaatagcttgaaactgggaggcagaggttgcagtgagccgaaatcccaccactgcactccagcctgggcgatggaaaaaaaaaaaaaagaaaaaaaaaaaaagaagacatgctggaggaattgcctaccatgaatattgaaatcctcccaaactacgatgggggatgctggagcactgacagtgaactgggtgctcagaactttgaggaacataggacagccttgttctgatatgtgagattcaaagctcatgtttttgagggagagtagtctggaaggggcaatgagaatcagggcacccttacctcatctccagtcctagtgctaccatggttctcagacaccatcagtagggttacagaggcaccaaggggtatcagtgccctccagagttttagttagaggaaggtgacaaagaggaatatatagagaagtcccagaagacagaggtgtagtgttttagaagttgggggaaactgagcaataaagacaaaacagagggtatgcagagggtatgccagcaacaagggagtctggggcttctggaggaacaggtatgaatagggataaagagcataatgagattagtccaactggatcagcattttcctttttatttctagttacataagtaaggcgatattttcctttgaccatacctctcaattctattcttctccttgggcatgagggtgtggtgctgacaaagctgaacactaccgaactctgtgttccagcaaacaggtttcccagtaatcatccaacctggggtggtcatgggggaacctcctattccaacaatgtgaaaaacacacaaattcatactgatattttaaaaagaaaatctcaaagaatgacatctgactagcaaggtataatttactattttaaaaactggtaaataaaggaaaagaaaaaggcagttcctgtcttcccaggagaagcctgctcccgagggtaatgaagcagctggtgagggaacgctgtctctagaagcattccagctaaacaaagggagaagaaatgacaggattcacagggtgccattttgtggcctctgatgaaatctaagcattaatgtcaacagctgctaaaactattaggtgaaatgctcatgggaacgttctcatgtatggatcagagagtgatgggacctaaacccattgattagtcttaacatcacaaagaacaaccagatgtacatcacctaagaagtattcttgttgtggggagggggggaatcaagcccaaactggatcaaacttctttaggttctaacaagcagctgatgggaaataaacgggccagaaaagaataggttaaacaagacagcatcacagagatgtaatcagcctaatccagaatatgagaataggacaagggacacaatttcttcaacagagtaattgcaactagtaacaatcaaccaacaaggtctagctgacacatacaggagatactcaagcaaattcacaaagtacttcttgtctgattcttgtttagacgaaaccacatatgaaaatgggacaatcagggatatttgaacactgactggatagctgataatgttttgtaaaaaaagtctcatcttttaggaatagttacaggtgaaatatgccttcgatttgctttagaataaccaatagggattatgtgtgtatgtaagtggacagaggcagaggtgaaataaaattggccagaagtttttagttgctgaatctgggtgatgatgatacgaaaaatcatgatacaattctattctctcttttctgtatatgcttgaaattttccataaaaagttttaaaaactcaaaattcaaaagcatagtaggtacttaatatttattcatttccatggtctcctctttgtaaaggcatcaaaaatattttgtcttgactcatgcagtttgattttaatccacaattattgtatagctataagctacaaacggggtgggggaagacttgaggtcaaactctagaatttatattttaaactttcaagcattccctttaaaattattttctgcaaagaaaaaaataactgggccttttgatgttagcaatatttattttatatttggtaagatgatgatacttgggctttttgtgttttaataatatatttttttaaaaagattgagaagtttattaattattgttaataagtttcgccagaggatcaagatggttcataagccaagtatacccaatactgccaactgtgaagcatttattttataaagacaaaaatacatttttgtttctaatactctcatatagtcttttcccctttatagcgtgggggctgcttgggagaagatgggaatactctcttctggaaacaaaatttataagactgagctggatttctgtgggctgggaagagtttataaaaacaaaaatccactttaaatttttgttgtactcattattgctcagcttttcatttggcctttttaaaaatttgaaagtgcctcaggctaccccttgccagggaggtctgtgagtttctgtctgcactgtctgcactgcctgcagctgagacgagttcagctcaagggtgaaggagtggttccgggtcctttttcaggatacttctttacaacatacgatgctgatatttcaaaacctatatgacctccaagtattcttttcaactgctttagaacccagagaagaaacggtatgactacgaagaacaccccgatctcaacagtggcaaagggagttcgaatgatgtaatggtgggagagggagggctatcggaaagaaggcagcacagctgggctattttgattgttcacttccttattcatgcacaacacgatcagccagtctatccatatgaagtcagtgacaactgtacgcttctcagtggtttggagtctctcctaataccagactgactaccagaataatttccagtgagccaggtactaggaacagatcaataacattcaatacctactactttgtgcacataaaaattattagtagcattaatttgattaaattatgtcacaaagcatataatttacaaaaatgaatttatcttttaaaatttggttgtttttttttttggggggggggacagggtcctctctttgtcacccagaatggagtacagtggggtgatctcagctcactgcaacctccaaatcccagggtcaagagatcctcctacctcagccttctgagtagctgggactatgggcacacgcctccacgcctggctacagtttttgtagagacagggtttcaccatgttgcccaggctggtctcaaactcttgggctcaagtaatctgcctgccttggccttccaaagtgctaggactacaggcgtgaggcactgtgcctggcctaaatttagttttactttttaattttttcagtgtcccgtagatttggtagggaaaaaaatgaactacttatataataggtgacaatgctctcaaattagggcaaggtttttttttttcttttctttccccttttaattcctaaaagctagcatttaaatcaagctttcagcaacagatagagactaccttggaaacccacagcattatcaaaattgaaactagagtgtaaaactagacagaagaacctttttcaaacttgaatacagggcacacttctgagagttggaactgagtcagcactatcctattcctaataaatgaggggaaaaaaccttaatggaatcacacgcaaactctttcaaagtattatttccttccacacatttatattatcaagctttagaaatgagtcaacataggctaggtgcagtggctcacacctgtaatcccagcactttcggaggcagaggcaggcaggtcgcttgagcccaggagtttgagaccagcctgggcaacatagggagaccccgtctctacaaaaaaaatacaaaaatttgctgggcatggtggcgcacacctgtagtcccagctacttgggaagctaaggcaggaggatcacttgagcccaggaggttgagctgcagtgagctgagatcaagccactgcaatccagcctgggtgacagagggagaccatgtctccagaaaaaagaaagaaatgagtcaatatggtctaatgtaaagagaacaaaccttctagtccaagatcaagatttccatcaggctattacttactagctatgtgaacttggccaaaccacttcagctccgagtgtctttatttctttatgtgtaaagtgaaaatattacgaagactctcatgaggtttaaacaaaatgatgcctgtggatgggccaggcatgatctctaagacacatgcatatgtaaataactacctgtatttataagtggcatagtcatgaataggtaacaaatctagtgtatcagagaccacacagaaagagataaaatgcagtaattattatagactataccaccttatattttatagaactttacagtttacaaaccacctttgcatatacaagtgagctgttttagaatttgtaatgaagcagcttaatacaaaatacaaataacatttatttcattaaatgttttaatagttcagaataatttccagtcactaacctgaaaaacctaaaagtaatcttgaataaaggaaattatgttgcatgataaacaactgaaccaaaataatgttagaaaattaaaaatttatttaaattgcaacaaatactgaaaaagtatcacaaagggccaggcgtggtggctcacgactaattttaattccagcactttggaaggccgaggtgggtggatcacctgaggtcaagacttcgagatcagcctggccaacgttgtgaaaccccatctctactaaaaatacaaaaactagctaggcgtggtggtgcacaactgtagtcccacctactcgggaggcagaggcagaggcaggaggcttgaacctgggaggcggaggttgcagtgagccaagatcacaccactgcattccagcctgggtgacaaagtggggggaaaaaaactatcacaaagtagtataattgccctttagcatgaagggcttagagacaatcaaaccaagcatttgaaaaagatcactgcattggtgtacatgacagagatacaaatgagaaaacttgtattatctctagtgccacatgtgtagtccaaacatgtaacaagagccatgtgcataatgcaatggtattactatcatgtgttatcttgtacttctggtcataattaaggttttactgcttgatcaagggcttcgttattttagaaaagaaaaagaaaaaaaaacccaaacacaataatccaccaaacaaaacccccaagtttataccttcaaaatatttaaaatacagctttactcattgatttggaaatacctgatttctagggtaattttaacccacacaaccattggttaagcactccctccccacagaggccacacctcctctttcagcatacttacaggtcccttatgatagactgcagcacctgactttcagatatgttccaagttgtacccgagctccacaacaagcacaagtttccttataacttaataattaggcttaaaaaaaagacttctacaggttctcagaacaatacaggcagggacacatgttgttctgttagatatttttataaatctctgttaatcttacacttatttttgtagagaaatactgtgtgaatttcaaagatacactgttcatatattcaacatcaactgtcactgcaatcttactgaaggtgatccaataactacctttattttgcaacaaaatatgaaaaagtacctggtatcttctctccggaatgtaaggatattgctttatttgccaacaagagagacccacaaagagcgacaaactgtcctaaagttatctagatcctcgctttttctgttggttatcctctctacccctgcccaacatctcctaggaaggaatctagaaccatttataatgattcctaggaaaaaatcaagaacaatttacagtgacaagcttacaggtaatcccttgagagccccagtgacactggtcggtccaaatattcctgcctttctgctgtcggttcccgctacccagaatgcattcctctaagacccagcacacctccataccttactcaggaattcatggatttatttaaaaacaattacaaaacttatatcccagacaataaagagataaacagaacatgtctttacatgcaatgggttcatggttttgtggacaagatggtttctaaaacacaatgacatttattttaggactatgcataagagagaaatgtacagtgcactatagagctctgaggaggaagagtccagatcttcttaaagtactcaggaaagctttctatgaggtactgacatatgaacccagacttgggtcaggtaagaactctttggttgtgaagaaaaatgggagagccagacaaatcccatgaagactctccatcttcattgacacttgggagtgtaacagttcatcagtacaggggagcaaactctctcaaattgctcatgacaggcaatagagcctagagggtaataatgacctgagttccgatcctagtgccatcattttcaagctgtgtgacactgaataagtttgtttacctttctgaatttaattcttcatatctgtgaaatggagagataataaataccttgcaaggccactgtgggattaaataatatttaacaattatgaagggctttacaatcccacacgagttaatacatgtgcaggtttactgtcatacagaaacacaattttaaataactttcctgttgctctcaattcatctgctttattttaattcactatctatggtttgactctttcaccaagaatgtaaactctataaagggagggacgtggctttgttttctagcagactccagtatctagaatagtgctcagcacgctgcaggcactcaagaactatctgttggccggattaatgtaaaacagaaatgtaaaactgaggtctcttcaatcccgcagggcttgttaggggttaaatgaagtatcgtatgacagaaaaacaagtaattgcagctggcatacagttgactgcagcctcaccccactatcctagacactgaacacgcttactgtggagaagcacatgcagaatttcacaaggatccaggagcagtagggcctctaccttggtgtgtcagcactacatcccacatagtacggtgtttccaggttggcaggtaagaaataaccctgggatttagtaagattaccgtttttctaggtatcggcttaacaaagatgtccctagaaatgtgaattaccagctctggggctaagtgcaatgtactggttcctggccagctaggcttatcagtttttaggttttatggttttgtggaagatagaaacatatcacaccattgaatgtcaggatgacagaaggaaaaaaggatgggaggaagaagggagggagggccggcaggcaagaaaagaaaagaaatataccacacttgtttctctggttccacctaagtaagcaagcagtaggggaatgactaaggacaaacaggactccgaacaattaatgccatgtcattaaatatccactggacaccacttattctttgcttggatttgtaaatcacctaagtgatagtcatatattgaagtatcactaactctgaaagtgaaactatttttatatgtaatgatgaaaagagcaagtctggatggaacagctcaagcagaacaacagagataaggaggatgggagagccacagccaccaacttttttttggctaaaaaacaatgtagatgaggaggtgagggaagactggagaagtgggtggtgggcagataatgaaaggtcttggagggctaagctgaggagcccaaacttcatctgatggatactaaatgattactaaaagtttctgaccagagaactgcctatttaaatcaacatggtagcaatctaagagcatggagaaggtactgaagtatgaactcctagttacggaatacctaggaagaaaaaatgaaagcacgatcacaagtaattcaggggggtgttaaagccagacattagagtttgaataatgactccagattttagcagctatgtaaccttggacaaattatttagcctctctggaacatagtctcctcagctttacaacaagaaaactatcttataggccctttgttgtaaggactaaatgagatgatacatgtacaagaacatagaacttaaacctgagcctggaacacagtactcataaaatgccagctaactttattcctcttaatggggttctgaaataagaagaaaacactgagatcataaagtgggggttggctggaagaagtaaaatccaagtttggtgatgaccagctgctaaaagacacatctgaggtttaaaccttgaatggagagtattgattaaaagagattagtaaaacaggaggaacaagatttgaaggcactgctggggcctattttattacatttcattactttgttacccaaagacagatgccaggaatagtccttattaacataatgggacatttcccttctctcttgatcaagcctggggagactgtggagacagtgtgtggcaagcaccaaaagggcagtccccggggctcatcccaaaagctgctttacagtttggcaagaagacggaccaaagggcctgcgagttattcaaagccctgctcaaatctcacctactctacagaacatcctgcagaacatcctttgatgcccagcagttgctccctcctccagactcctgtgactgtagcatgtgtggtggtctttctctctccaactagattacaaactccgtgagggcctggcaagtttgccaattctctgtacccactacagactgaacaaatgcaaatgctgagtgctgtttactgccccagtgtcactactggaaactagggctactccaagaagtcacgattaagcttataaggatgattaactgtttacctgagaacatgctggcaaccccgaagcttccataagaccagctctagcattccaaccttctctctacttagttaggaagtgagcaatgatttctcaagcagtagtactttgacagtataacacatcattcacctttattgagtatctctgccaagtgtacaaatacaagcaaaaatacttcttgagtaagggcttatgggacatttgtgcaccattaaaaaaacaaacaaacaaggaagccaggcccagtggctcacgcctataattcctggcactttgggaggccgaggcaggcggatcatctgaggtcaggagtttgagaccagcctggccaatatggcaaaaccctgtctctattaaaaatacaaaagtgagcagggtgtggtggtaggcacctgtaatcccagctactcgggaggctgaggcaggggaactccttgaacctgggaagcagaggttgcagtgagctgagatcgcgccactgcactccagcctgggcgacagagtgagactctgtctcaaaaaaaactgattcaaaataaacaggaattgggtcttttctaagtgagatgctaaagttaaaaggaaactattatttcagaaatgtaacatatatgtatgcacatatataagaacaaattacatatgtgtgtatatggttacgtatgtatatatgtgcatatacagatggtatatgtattttaagatatcaaatgggcccacagaagatgctttctcatcctccccctttcctttatttcccacatttttaaatgggaaaaaaggcatatctattttgaaacataccaaggaaagtacaacacacttaattgcaccagcaaatagttaagacaatgctcatgccagaatcttaactatattttttaaaaagcaatactcaaacaccatattgtgaaagacaaaaattgttttaaaatgtctcacatttcctgaacttcttaaaataaatatgcaaagtatattctactgaattgcaagataaattataatggcaacttcattctggataagattaacatgatattaaaacccaaaaataatttggaattctatacaacttgctgagtgatctggtattttatctatgtcccatcttaaaaaaaaaaaaaaaaaactatgagccatacttaaaactatttaatgatggtaaaattatgcaaatttggatagccagaatgcttattttcataagctattctagaacgaagcaattatactaaaaatagacatctatgatcgtcttaccccatgagagtgcttttcgaggtctgctacctagagccccttacctgacacagagacggcgtgtgtccgcatgccttgcttttcgctgttggccaacctgtgacagacaagagcaaagctgtaagccctgcaatttccccaggaccccgcaactcggcctcatcaagtggggaactgccttggatgaggaagacaaaattttagatacgtgatttctttaaaaattggattctactattaaaatagccaggctgctttaatgctttaaagatcacaaattaaaatacacaactgaaggaatgttgaactgttctgagaaagatactcttgacaataatttaaaacaatgcaatacaatttaatctggtatgaatgggttaaataaaaatataaaaatataaatttaaatgctacacactaaaggattgcccctaaagttatgagaaaaaaaacatacacctggaagtggattttgctctctaaaacataatatgaaatactacagtatgactggtctttctcaaatttatggcacataaaaaattatcaagcaatacattaatatgtactattacctacatacttaaaaaagtaatctcaatgtatcttgctacttgcttcatgacatggtttaacactagttttacatatttacccacaaaaaataaaattttggccaaaagtcttggtgccgtttaaaaaattggtaaaaaacttttggaaagcacaaaacacagggaaaaaaggagccacacagtctttagatgtcaaagttacctgatctttttataagagaaaaccttttccagatgaaatattgacatttaaaacagtataggttgaatatctcttatccacaatgcttggaacaagagtgtttccaatgtcagattttttggattttggaatgtctgcatatacaaaatgaggaatctaggggataggacccaagtctaaacgtgaaatctgtttatgtttcatatacaccttatacatgtaacccaaaagtaatttcatacaatattttaaataactttgttcatgaaacaaatatttgactgcaacctgttacacatgaggtcacatgaggtcaggtgtggaagtttccacttgctgcaacatgttggtcctcaaaaagtttccaattttggagcattttgaactttgaagttccagattagaaatgctcaacttgtacatcgtttcgaagcactacaactatttaatgtgaaactgtataatctctataataatcacagcaaacagccatagacttgtgttccttttacagaattctccaaatatttgaaattttatatctttagtataaaaatttaatcaaagttgttttctaacaactcattactttctcttccattgcgctacatgatttatcacaacttatctttgaactatatttattgggcagtcagaggacacacattttaaatcaataaattacatcatttccttccctgttgtgctgccaaaacactggggttttcccttgtctgcgccacaattatgtatgctgttgctaagcaactttctcacgatagcttggatttcagctcttatctgatcaacagcaataatggtgtcctgctgctataaggtttgtggaaattccactcttgtaaagtttgcttcatttatttagtttcctttatctgttaacacttgcaatgtactaccttcctcactcactttcatacctatgttcatgattcctctatgtgtgtgtgtgtctgtgttttaagaaatggggtggagtctcacgaagtcacccagactcgagtgtggttgctattcacaggcatgatcatagtacaccacagcctcaaacccccgggcttcagtgatcctcctgcctcagcctcagaaccacaggaacatgccacattgcccagctttgattttaatccaaaattatcccttaacttcccacaactaaaggtactctaaataaacatcagttcctgccctgatatgaccccaaatgaacctctatcagacactgctgatgctgtagagtgcactgtccaaagctagaggtgcactagccacatgcagaccttgcctgtgtgaggcccacagtactgcatatgaccctggctgtcagcaacttgccaggttggctggggagggtagacaagttaaaagcccatgtttaggactctggtaattaataactagaaactattacaggaaaacatgatggggatgctctcctggcttgggggtgggtcaatgaggtttctacaggaagtgatgtagaatgcgacctagaagatgagttaggcttagcaacgaaaagggggttggaagaagagtggatcatgcaaagacagaatattggcaaaggccttcaggcaaaagacaggatgtttgctcctggaattgaaaaaaaggtaaatgtacttgaagaatagtatgaggagtgacaaaaaccaaggttagagaagtgagcaggaaacaatcacacgggctcctgcaagctaggttaagaatattgcaaagtatcctaagagcaagagtaggtcatgtaagatatttaattaggaaagcttcctcaagctgtagcacagagcacggacaggctaaggagcaaaactggacagagactgatttagtagaagtacacagaaaagagttaatgtagcaggcctgtgactgaccttacatgattgtcccttgcctgctatctgggaacttggattttcgcagagttgccaccatcccctgacaggtatggtacactatgcctaaaatgtttgtacaaaaaatgtggtttatgctgaactcttgctttccttctgggagtctggtatttggatgcatgccaggcacagagtgcatgtaaaaagaaccctcaataaaaaccctaggcaccaagtctctaatgagctttctcagtaggcaacatttcacacaggtcgtcacaatccattgctggggaattcagagtgtcctgtggcctccattgggaagggacccttggaagcttgcatctggttttccctggacttcaccccatgcaccttcatcctttgctgattctgctttgtatccatttgctgtaatacatcatagctgagtcctgtgactcctagatcttggggaaccccaacacagaagtgtacttgggtagcccagatagctaaacacgggggagacacagtgggaaggcagtgaagcagatggatccatttagaacatggaactggaggaaatagtaagggactggctatggagaagaaggagagggacagaacaaagcccaggcctcaccctctctattccagtggcctcttaggctcactgttcttcttcagtgtcttggaaagtgtaaatatctctgaaagcacttaccacacagctataactgtgtgtttacctatgtatctgattgtttagattttaacattcatatcttagtccccagttcctagcaaattggctgagaatataaaattatataagttcttttggtattactattcgattcttttagttttgtagatcaacatgcccactataaaattaggaaataaacaagaaaattaacataaattatttctctttaattttcatacttgtaaaatagccagaatgccacatattttcaggttcttgtaaagattagcaataacatatgaagcaaatgtttaacaacaggctctcaacattatgattattctttagctcccccatagaacttaaaggaaaaattaaaaccttttgattaagcctaaatacttaataaaatttaaaactgacttgatttctttctagaattgtttcctagttccttgatcatgtatattgaatttaatttttttaggaaaatgaataataaagcatagaaatttccttaaactttccaacaaaacaaaataacagtacaaaaaaagcagtacttactttggtattgatggcaaagcccgttcaccttctgcggggaaaaagaaaagagatgcataaggctcttttcactccttttgaaaagatggtgcctagaatcagggaggaaggatgaggcctatactggtattccagcaatgaccctttaaagaaagttgctacactgtctaccttaggttctcatggttttattttcaatatttataacaaacataaactgagtattagatacaattgtttaaagggtactgcctaatcataataaagaactaagatgctaagttggtgaaagacttcgtttgcaggagactaaaagatgaagggtttcttatgattagtcaacactccttgtcaaaggaccaggcattctgcactttgataaaactactcactagtaacaacagaaaaacctgtgcaggaagcacagagaaacagaaggaaaacaattctacaggtgtgcatggctgccaacggaatgaatgtatgagagaaggcaagtcctggagctgtcatctaaaggagccgtgcacacagctggctggaaggtgagccaggcagctatctaccacagttcagggtgagctccctttttgctgagcaggacacagtgactggctcatgccggcctgaccacagtgaagctgaggacttcgttcaatggtgagggaaacgctttctttccctcagccttcatttcgcaaaccaggaaacatggagccctccctggtttaacctctttaatctgaattaatgtaacagccccctaattggtcctgtcttctaatccatctgagctaaattatttcagaataatcttcccaaattaccaattcatcaatcaagcaagttattatgcttaacattttagtgtctctcaaaaactttcaggatgagatttaaacaccccagcttaatttacaaagcactgcttcacttctctcagcacacaaacactgctctggctgtcatctttgtatcgtgtctgtggggtggtatgggaggctgaggaggcacccatctaccactcaccactctggtgcccttctaggcagctccttggtaacaccactcgtgtagtcacacttgctgtccacggttcctctccttacttttgcccttgaattcattctaatcagttcccccccacccccatacacggaaaatactttttgaacatctccaatgacatctgccttgctaagcccaattgttcatttacagttagcacttaacacagctaatcactctgtccttctgagagcttcccaccctgggcctcccgaaccttgtactatattctcttggttttcttctgccctctcatggcacctcttcgtcttctttattggttcttccttatctccctggcctgatgaagattagagaacccagtgctcacacctgtatctcttaacctcacttccttggtaacctcatacagtttcaaagcgtcaaataccacccacactttgcagctccaaatgcatacctctagcttggacctctcccctgacctgaacttgtctacatgacacctccctctggatgtctgaaggttgctgggacttgctgatattcaaaactgagtcctggtgggtgcacctgcatacttcccattgttcaggtggaaccagcagtcatcacagggccttgctgctccccaatccatacccagtgcagcaaatgcaaggctttactgtccaactctatccaaagtcctcttacttgtcactgtcattccagaacccctgacccaaacatcacttgcctacatcatggtaatagcctcctgattggtccctctactttatctgtacccaggccaacctaccatggtctattctcagcacagcagccagagtacttattctagaacataaaccagatcacattactcctctcttcacaccctccaatggcttcccaaatcacttgagtacaagccaaagcccttacaatgcctttacatcctgaccagccactggccctgggatcacccccttaggcattctagtgacctgggtctctgctgttccaggcatgcttcctagcactccccagccttcaatagggaatagccagatatccttgtaggttctgttttccaccccttcaggtgcgactctctcagtgggaccttccctgacaaccttacttaaaattgtatcccttactttcttccctgtcttatttttctcgatacagctcaacatcatttgatatattatatgctacagtatttattttctctattaatttactctgtttatcgcacgtatgtcctcacctacatgaaatttccatgcatgcacaaccctgtctgttttgtttgctgctacatcctctatcctagaactgtgcctggaaaatggaaggagctcaacaactacatgttgaaagcatgcagtgtttggtctggccaatctgccttttcagtattactcgtcactattccctgattctatactactgcacattgtattcccctgaacataccacacatgccttgaaatgtgctcttccttcattcaggtagaaacattcctcaatatttcaaagctcaattcaagttctatttccggcagagagcccttcctggaatacctcagtttgcattgagcggcatcctctatgtttctgctgcatccacagagcatttgccacatatacttctctacagactatttaacctgcctaaggttacggtaagacttaagctgcccaaaggcatccctaatatctagcagagtatctggcactcgggagactgtccgaccactgtttggtaaagaaagaaataaatcaacctaggaccccgtgttactctttctgaaaaactgtttaattcttctgatttgcagagatagttgtgaggcttaacactgcatatatacaactcactgcacatcataggaattcaagccaaactgcaagccatcacttgttgacattttgaacatctatttcaagcaaaataaccaagtcacaccaggaagaccaaatttagagtaactgaaaagtcctgatagttacgtttattatcccatgaacatgaccacctcccaccaccagcaccaccaccttactcacacccaaattgttaataatatagcctttcaaatgacacattagtgtgatttctgtttgtattctgttgaaatttctatttcctgaaagaaaaaggaatccattattatatttttgcctaacaggagactttctaagtagctgggcatgggtagaaaggcagctgtaaagaaggagataaacaacagaaggattctgagagaatatttttataaacagagtaatggaatacagaaaaatggcaacagacaccatcagtagaagcagcatttaagaaaaccctaaggactcactacctaaaatgtctaattctgggagttaatgtttttgttcaaatgtacttccattcttcttagaagtgttcattaactgaaattggtgacttaacttaccagactttttaatgcttataaatacacaagtttggagatacacacacacacacacatttacatgtaggtttttaatacattaatagagctatttttttaaacagctgcatagtattacatcatgtatgcatactccctcatttattaatttttgctcattttttgctattataaacactgcaatagtgaatatcctcctcaggtcagtggtttgtatgactgatttccaggaggcagacaaatgggcagagtactcctaaactgtcttctgaaaatgtaccaatttacaatgacacaatcatgagtcattctggcattctccagaagtcttgccagtggtggttatcaggtttctttaatcaatgtaataaacataaaatgaaatatatcactgtatccatatattcactggacatttgtgtgtacattcctcttttttatactaggttgtcttttactgaatgagctggaagaacacttgaaaaatgagaaattttaattatttattatatgtgtcataatattttcccctgtcatcatagctttaaaaatgttaccttgtactaaacgaaacgttttaattatgtaattgtgtcgcttcagcagcacataagtgttttaattatgtaattaaatgtaacagttctatttttatgtcttctggaatttatgccatgcttagaagcattcactccctcccttgaaatgcacagtattcaccatcattctatacacagaaaacctacttacaattatgtaattacaactctatattacactatacactttcctctgaaaaaatgttactacagaattttactaacactgcaaaattgattgtatactttctttcaggtaaggtgtaggttagataatgccctacagaaagggccaaggttatgcagactgtggtggaatgcagtccaggacaatttggcttgtggctcttactatgttctccccaggaaaatcaccttttatttttattttttaaaattaatttattttttttagatacagtcttgctatgtggcccaggatggtctcagattcctggcctcagggattctcctgtgtagctggaattacagacatgagccactatgacaaggtaacatcccttttaaaagcactttataaatccaaagtaactatggtagatcaaagaactaacaaaatgcatctgggcacacccaattcacatgtagaatgtactgatcacttattactgtcatgctatgttatgcatatacatgtatacatgtataagtagtttatgatctagagaagacagatgggcatatataattattatttaaagcatgtttccaggaaaacggtacattagagttgcagaaacatgtttaacatttgaactcttaaaaaatctcaattaaaaaatgtacatgtgctgtgttcacatgtatttttgactataatccactaaagatgtttgactttaatattattttaactaggcaatgtatcttcaccttagggatctatgatgaaatagttatataatacataaacatgctatgattgagaataagaaaattaccaagtttaataattcattttataaagacaatataaaattggaaacaaccaatgccctatctagcttttcatgacaagcattttcattaatgctcttttcatatgaacaaagagcttaaaaagcatcgcatttcatgtttgatatccaaatgtttctccctagagagcaaaaaacgctagctaatagtgaaatcaacacaggaagatgtttacgttttaaacatggaaggctcatttaatgcctgacatccgaatgttatttttaaatgtgtatgtcaaggaccttttggtaaactgaagataaaagatgaaaaattattcactaaaaaggaaatgggcaatctattacatttaacatttttcctaaattactatctttatgtaaagaaattatctgaaaacatttaaataatatttgtaaggcatatactcctgtttaaagtataaagtgcgacactggaagaagaaaacgtcaaaaataaaaataaaaaataaagcacaaagtgaaaaatcaagacctatagctgcaaaggctttaactgagagtaactgtagagatttctgaaagcaacttcattactctattttatacaaagaaaacttaggaaaaatatatgaataggcttattggtgtgatcaccgtgggaaaacacttttcctttagaaaagccatgtcctggaatcacacagatttatgtttacttagcgaaggctcatggcttcagctgctgttttcagggcacagcaccatcagttacctcttttgagatacataaataaagggtccaatgactcctctctataaaacacacaacactcacatgtacctcccatgcaaacaccatgccttcctcaaactgctttgtaaacagagcacttccctgctgggcaaggctggatcctctgcgtttctatctgcttcacttgacctttggccttttctctatcctcatcgctgtttaatacaattctgctgacttgaatgcactccacacagcacttcaggactttttttcctctataatcatcctagtcactgaggtgagtgctagaaggggtattggcaaaacccacattcagagtccccacttccacagcgtgagctgctttacagttactccttgggaggtgtctaacaaccctacaaaataggtatcattcttttacagatgaggtatctcaaagtctaggctgatacagtgtcaagatcagactcaactagtagcaacaacaggaacaacaatacaactaaaatctaggagcatcaagtgtgccaggcatagttccaagcctataaataagtcctttatcctcctaataccatagaagacagttactgttcttcgtgtttgaccagatgacagaactgaggctcagaaaagtaatttatagatggtgtcacagaggactcatgatttgaacttaagtcccataattcccaaactcagtctttccctgcttcacactatgtatgctattatcctgctgggaatattttcatttgattctttcagaaatccaaatcctcaaaagcattcctcattatatgcttgcaaaaactccacaccgcttttatagtgacgtttctaggatatttattcattctaatctttgattttttaacatcatgacttagactgtactttcttctttgaatgctctaagcttttgagatatataagaaaaagtagaaaggacactttatttatagtgagttataacggattcctttttttaaacccagaattttatttaaacccaaaattttaaaaatactaatgtatttaaaaatagtaatggcaatttagaaaatcctctaagtaggtagctcaaaacacagacaatgttttttttaggctctattcaaacccagctcttggcttgtggaaggtgtgaaacggatcaccatccctagaaaaataagtcctcagattatactgagctgaattattcatttggtcttcatttttacagttacctaaaagaggataacaggctgttaggggcaagcacagctaaatatttggtagaagcgcaattgggaatgctcagaaacagcacctcacctttctgaggtctgatgataaatgactgcgaggttccattcaccagccggcagtacccatctattaggtcagccatattctccgcaatggttagggatggtgccgtcactgtcagaggctaacggagaaaagatcaagaaaacagacttcattgttcttcccagtaagcaaaggacagctgtgctatgacatcagacatctctatacacttgaaaacagagaagagtgggaatgaaacaagatttgtcatgagatttgagaaaggaaatctgatatttaaggacattattcctagaatatgtgacaaatgcaaacccagatgaaaacagaaaaatcacttaaactggggctcactttctagaatcaaaagagatgaaaaaagtattttccttcagagtgtctggcccctctggcatactccagttaagggaagaatttagacaatcagtaagttaaagtatgacttctatcagaaactaatgtggagtaaattttttatcaaccatccatcataatttctaatgtaaaagaaaattaataaaatttcattatttttagcacatatagcatgttcgcccaagggcttagaaatcattctctttccaatataaaatttgatattgtttggtaatatttgcttaatctccagaatcaacaagagttcctagagccctcagatgtcaccaaactcacagaatcacagggcagaagagtgacgaggcatcagcctaagtgaggagtgctgcaaataaagctacccagagaactggccgttaacagaccaaagaatcctggtgtgctgatggaaacagatgagcttcaaaaaacatgctttacacaccagcacaaccgtgtgtgccaccagactgtccagatcctttcatacacgagtgtattttgtccatcttgcagaaaggaccacattaggtagtatttgccaaatggctctttctcatgccacttgttttaaatcactgttgcctgttgattaagaacacaggctttggatccagactgtttgggtatgaaccccatctcttgtcaattacttgatgtggccaacctctcatgcctcagtttcctcagctacagaatggggttaaccaaagtatatcaaagtatctacttccttggttgtgacaatgacacagcttctcttggcttctgcgtaaagaaccacaggtagcatgtgcccagtatcaggtactgctgctgttataattattataatcatataataataactattataatcacataataatttctacccagagaatatcatggacaacacagtgtggaaattaactcagtttacagtatatatagtcaatgcaccacataacaacattttggtcaatgatggtccgcatatacaatggtggttccataagatttatataatagagctaagaattcctattgctaggtatgccgtagccatcctgaagttgtaatgctcatgtttatggtgaagctggtgtaaaaaaaatctactgtgctgccagtcttataaaagtatagcacatacgattatgtacagcacataatactggataatgactatgttactggtttatgtatttactattttttttttaattagaatgtacttctacttatttaaaaaaaaaaagttaaatgtaaaacagcctcaggcagggcttctagaaagtattccagaaagtggcactgttctcataggagatgacagtttcatgtgtgttacggcccctgaagacctcccagtgggacaagatgtggaggtagaagatggtgatatggatactcttgaccctgtgtaggcctaggctagcgtgtatgtttgtgtcttactttttaacaaaaaagctgaaaaagtaaaaaacacagaaaatcattttaaaactagaaaaaagcttacagaataagtatgtaaaaaaagaaaattttttgtacagctgtacaatatatttaaaattaattgttattacaagagtcaaaaaagccgaaaaaaatcagtttataaaatataaaagttactgtaagctaatgtttactactgaaaaaggttttaaaaataaatttaagtatatggtgtgtacagtgtttatagtctacagcagtgcacagtaatgtcgtagatcttcacattcatccttcactcactgactcacccacagcagcttccaatcctgcaagctccactcatggtaagggctctatgcaggtgtaacattttttatcttctatactgtatttttactgtgccttttctatgtttacatatatttagagatacaaataccattgtgttacaattgcctaaagtattcagtatagtagcatgctacacaggtttgtagcttagggcaacaggctatattgtatagcctaggtgtacagtaggctacaaccatcttaggtttgtgtaagaacagtctgtgatgtttgcacaacaaagaaatcagggaattaggcatttctctgaacgtacctgttgttaagcaaaacatgactgtacatataattccaagaagttaatttccttggtacttgatgacaatctttttttttttttttttttttttttttgagacacggtcttgctctgtcacccaggctggagtgcagttgtgtcatctcagctcactgcaacctctgcctcctgggttcaagagattcttgtgcctcagcctcgcaagtagctgggattacaggtgtgcaccaccatgcctggcttatctttgtatttttaatagagacagggtttcaccatgtgaaccctggcctcaagtgatccgcctgccttggcctcccaaagtgctgggattacaggtgtgggccaccgcgcctggcctgatgataatctttaatcatcattatctttacaataacgttcttggatgatttttaaatctgtctcctgtcctattcttggggacatttaatcattattgtttctaatgtaaccctttctatatataagaaagttgtgattctgatgatccataaaaacttcatccttttcataaaaaagtcaacaattctaaaacatccctatttaaccattttcccttaatgatgaacgtaacagttccttacctcgggtgcacctgctatttttagttgtagcattccttttctgtccttgtcttcactgtttgaatactgaatggtttgcacttgagtgaagtcagcaagatgtgtgggctataaaaaggaaaggtaaaatctttagactacggataaaaaactcatttcacagagtctgtaaatgttctgtgaaatcctcgttgtcctgaagacatcctccctaagactggaggtctggggaaaaaaacagattctccatgctgccccaggggagcagccatgagactgtctcctgcacttcaaggtcaggtacaggtctgctctctgtgatgtgctgaggagacccatacatgagttggatgagtgagagtacagttaccactgagagagaacagaagataaaggagggagggaagttgaagcaacctttggcctgactcgtttgccagcctgggaggaatcttatggaattcttagtcaaagagaacattctactcccattcccaaagaaagaggggatctgggattaatccccatgcaccctgggctagagtaagttctgaaactaactggagatctgtagctagggagacagtaggtacccaaagggcccttcccaatacagaataacctcttaagccatgccaggagagtctatggtcattttcctaagtagcataaactttggcttcttctttttttttttctttttcttctattactgctgcacaaattaataaacactctccttcttaaaaagaaaaaaagatagagttgggagcaatggttcacatccataatcccagcactttgaggggctgaggtgggatgatcccttgaggccaggagttcaagcagcctgggcaacatagtgagaccctttctctaccaaaagaaaaaaaaaaataaccaggcatggtggtctgtgcctgtagacccagctactcaggaggctgagtctgcgccactgcactctagcttgggcaactcagtgagacccttcttcaaaaaaatacatataaaagatacatgaatcttccatccttctagcatctcatgaggatgatcattttgcatgtgaagattcctatacatttcttcaaaacaatttgcttggttaaggccactctgtcagctaatgccccttcccattgcatggcgaacagatgatgccactagaacggagttggaattgttcagaaagaggttcacactgggctgcccttcccagcaaagcatcttcctgcgccgtttgtagagacatgtgttttgcagggctcctgcctttccccgggaggccacaggcagccctccattctctggtcccaggcttctcatagcatgtcccacagcccctctgcatattcttcccacttatcctctgggacatcctgcccttttggggtttcttccacctcactggtctctctttcccagttctttttactggcttctcccctactcaatctacaaatgtgaaagggctgcagggctctgtgctgggtgggccctgttattccccctagttctgccatggcaaaacaaataccatacagtcctggggcgttaagtaccatctccagccctgtcatctccctggaactcagactcatgcatccagctccctatatcatactaccacatggatgtctgcaagagattactaacaacatagttaaaagggtactccctcaaaacatgttcttcctccaggcttcttgacttcaataaaaagcatcatatttggccgggtgtggtggctcatgcctgtaatccctgcactttggtaggatgaggcgggtggatcacgaggtcaggagattgagaccaccctggccaacatggtgaaaccccgtcactactaaaaatacaaaaattagctgggcatggtggcatgtgcctgtaattgcagctactcaggaggctgaggcaggagaatcacttgaaccagggagtcagaggttgcagtgagctgagatcatgccattacactctgcacagagcaaaactctgtctcaaaaaaaaaaaaaagaagagaaaaaaaagatcatattcaacaagattcctgagccaaaaaaaaaaggcattctcactgattcttctccctttccccattatccaacctctccacaagtcctggcaacttcagctccaaacatccagaattcatgtgtttacttcccatcttcacagttgtcactatagtccaggccaccatatgatattctgcttagagtcctgccatttttcctagtttcccttcatccatgctactatataatgtccctacctgaaagccagatcatatcactcctctgcttaaaaaggtacaatacaaagcatcataacttgcatgatttacatagcatgatttctatgagcaaactgtctacatgatttgacccctgcctgcctctctgacctaatttactgtcatgatcttgtcttgatgatatgtgctctagtttcgttggggtagaaccatttcagggggtgggttgtttttataaccaaggctgctagatgtcacatgaagcatgggtaattcctgcacaataaaaaattgtcctgcatcctcgacggctttcaaatgtcctggtgtgtatttatgtcactgaaaaatctgactctagaaacaaagtctgtttaaaaccacaaagtatgctctgcattgaactttccaggaatgcaacttacgcgtaatgcaagggaatcctatactatgctgtttttgaagttttattaagagttcctcaccattttggagaatgacaccaccaagggcaagacttgctatagttattttggtcagtgacaaaatgcacctgtatcagtttgcatctgtagctactgcatgcacgtacgtaacagaggatgtcggaggcgccttccaacagaccgagagctgaacatcattatgttggtggtgacacatgaaatgaggaatactatctcaattagtccttgttattgctatctcataattaaaaaaaaaattcgaaggcacagtaagacatctaggttatggaaattatattttttaaaattgtttttctgcctcactctggcattattccccaaggtcagtcacataacttttccctatcactttcctacaccacttgtatggagtggcttctgattgttctccctccaattaaaagtccttactaagtaggtgcgtctgactagagtgccttccaatgtattgtgctaaactttaagatattgatagagattttaaaaaattatttgagtaggggaataacatgctctgtaattttaatttcaggatagcaaaagataatttaaaacatctgttataaagagaacagggttaagaggggctggcactgcccacctactctaaatcaaacactcagatactctctcacgccaccctactatagccctttagcacaatcccattatttatattgcttattttcttctttatattctattttataactagaaggaaagccccatgaggatgggagtatcatgtccaccttgtccaccaccagattacaaggaagcagggccatgcctggcatgtaagtgaatgaagtatgagaagttattaggtgctagactgtgttccaagtatcagatatacagcagcaaacaaggataacatgaatccagacattaaacaaacattacacaagtaaaccattacaactgtgataaggactataacaaagcaatacacggtgctgtataaaaatatctaatttattggaaaggagaggagggaggaaataaagcctcagaaaaagtttcactgcgaaaaagagaacaagacttgagcaacacgagcttaagactaggtatattacattcagatacagtactgcaccagcagaatctagcctaccacctagcacaaggcagctgcacacaatatataagcaaactgactaaggtaacactcaagataggcatgtaagtggtcattacaagggcaaaaagagagggaaagagcacttgagaaggagaatctgagatgtgctgttcaactggtggcaggaagccacacacagctatggagcacccagtggtatgtggctcctccaggctgagatatgctggtagggtacaatgcatgccagatttcaaaaacttggaatgataaaaataagataaagtctcaagaattcttacactgactatatcttgaaatgatgatacattggatatactggatcaaataaaatatattaaaattaattgcacctatctttttatctttttaaatgtggttactataaaattttaaatcacctatgaggcttacatcgtattgctgttggacagcactggagaagtcaagtaaagtagatgaggactcagaattacccagtgggcttatctacaggaggatcactgtcatcattggcaaggcattgaggggtggacggtggtagtgtaatggtagtaggcaggaaaggcctggttgaagcaggttgaagagggagtgggaagaattaaagacaatgcagttagataatctgtcaagaagttttgcaataaatgacacgaaaacatgaggtaccagggagagagagggacacagggctaaaagaggggattttaggatgggagaaactatacatttttctatgctgacaggaacaatccagtatgttagaaatgtctgctgctacaggaaagagtgggcagaactgaagaattaccatgaacaggtaagatgggatagaagccattacatagcagagggttggtctcattcaggaacatgaagttcacccatgggaggcagaacaaatgaggaggaggagtgtggcaggcagaaatgtgagaagtgcagtgcaaggaatcttctgggggctctatcctgattgctccaatcttgctttcttctactttatataactaatacctcttatttcataggcacagaggtccttataaactcaaaaggaaaacatatattttcaaggaacatttataaaaatcatacgcttggccataaagaagatcttaacaactgtgaaacagttaacatttaaaaatcatattacctgctcataagccaatatgaaatttttggctcataatatgctcatagaaataaaaatgagataaaaccccagggctacttgaaacttaagtaatattcttctaaataatgctataatgaaaaagagaaataaaaataaaatttttgttcttgttttttttttttttttttttgagatggagtctcactctgtcgtccagcatggagtgcagtggtgtgatctcagctcactgcaatctccacctcccgggttcaagcgattctcctgcctcggtgtcctgaagtagctgggactataggcgccaccacgcctggctaatttttgtatttttagtagagacggggttttgccatgttggccaggctggtctcaaacttctgacctcaggtgatccacctgcctcagccttccaaagtgctgggattacaggcatgagccacggtgcctggccaaagataaaacttcaaatgagtatacagaaatacaatggaaagaagaataccacatacctagaaaggtaagacatattaaaagttgtgcaagaagaaaatggcctccaaagtaaacaagaatacattttaaagatgcacttaaaagggaagagcacaataaaaaagacaaaaataatgaagatactacaaaaacagaatgaagaaaaatactgaaatcaatgaaaatgaatagtactgctgcaatacatcactaaacttgtccttcaaaaaacaattagaatagacagacctttacaagtctgaaaaagagccaaatcaaaagagcttaggcatgaaacaggaatatagagacaaagttactggaaagattttaacagatctatgagaggcaactctatggcagcaagatgaaaatgtagagaaatggataatatgctaaattaccaaagccgacacaagtggaaaatgtggatagatcgattactattaggccaggcacagtggttcacgcctgtaatctcagcactttgggaggctggggtgggcagattacttgaacccaggagtttgagaccagcttgggcaacatggcaaaaccccctctctacaaaaaaatacaaaaattagccgagtgtaatggtgtgtacctgtagtcccagctacttgggagactgaggcaggagaactgcttgagcccagatggcagaggttgcagtaagccttgatcgtgccactgaattccagcctgggtgacagggtgagaccgtgtctcaaaaaagatctattacttttgaagtgattaaaaagataaacacctgccgtttaaaaaggcatcatgttgttacgtagatcagttctacctagtctttaaacaacatgcaattccaatttgaattaaaatatttcaggccattaaaaatcaccagagagagggaaggcactgagaatggatgaaggaaagacacagaagctgggctgaagggggaggaagctgggaaccctgcaagaggctaccacacaccaagactcattcctggcccacaattaccctgggggaatgggtgagtggaactggcaaggagcaacctgctctcactacaggcctcttaaatccgagcagggggcccctcaactactacggacacttgaggtggcagggagagctgcttagagaagtgctagggattgcagccagctgaggtggagcccagagggtttggtgcaggagcgtctgtagtggaacatggccagggaagccctgacttgctcccataagagactttagccctaggggaactgttggacctgaactctgcagggtgggcttacctatcagaagggggttagtctgacctgagcaccccttgggcttctggcttctcctggggtcccagcctgaacgagcctgcttgcagggtagccttgggtgccctggggcccacatcatagcccctgcagtggctgaccgcttctgaccagcagagagctcccacggggcagcctccattgccacacaccagcccacccgctccttcctcacactgcaggttcctctagcccacagcaattcccaacagagttttgctggcacctgtgtacgcaggcaggtattgccttccgtgcctcaccagtgcacatgtgcacgcaaccccaaaactcacccatgcctgacagccacctcagtcggagccttggcaggcacagagccaaccagccctgtccccactgccagcaccccatgcttatgtcaacattatcccaagagtgaaagcaggcacagagaatagcagattctcccctacccacagcaaacacctatgcttacagtgcacagggtgcacacacagacctgggcctgccagcaacccaaccctgtgctaccaccaccaccagcaccaatgctgcacagttgccaacaggcaaccccccacccaaaccgtgctgctactgccactgtagtgaatgctcaaatggagacaggcaccccagtacccactagcaacctgccgggctgatgagcgtgcatcccagtgtgctgccactgctgctggcacatggaaacaagggcggatcctatgccaccacactgtgaaatgctttggctgacaccacccattggagtgtagtgaccagtggtctgggagcacccctacccccaacactccacaagtgcagtggattcctaacctccaggagccagagaacaaagttgcagcccaataccagtctcccagaattagagcacacagtccaggagttgggggctgggcactggtcccctaaaatattccagaaatgcagccagtcagttgagtccaccttaccacaatcaaaccctcaaggtcatcaaataggataaacaaacaaacaagcaaaaatacaaaggtcagcaacttcaaaggttgaagaaacgttggcccaaaagatggaaagaaccactgcaagaaatctaacaactcaaaaagccagagtgccttctttcctctaaatgaccgcaccacctctccagcaagggttctgaactgggttgagatggctgaaatgacagaaatagaattcagaacatggataggaatgaagatcattgagatgtaggagtacactgaaacccaatccaaggaagctaagaatcacaataaaacaatacaggagctgagagaaaaaatagccagaatagaaaagaacataatcaacctgatggcgctgaaaagcacactacaaagatttcataatgcaaccgtaagtattaatagcctaacagaccaagttgaggaaagaatttcagagcttgaaagctgtctttctgaaataggagtcagaaaagaatagagaaaaaagaatgaaaaggaatgaagaaagcctctgtgaaatacgggattatgtaaagagaccaaatctatgtctcactggtgtccctgaaagagctggggagagtgtaagcaacttggaaaacatgtatcaggatatgatctatgaaaagttccccaacctagctagagaagtcaacattcaaatttaggaaaggcagagtaagatactacacgagaagatcattcccaagacacatcatcatgaaattcttcaaggtggaaatgaaagaaaaaatgttaaaggaaactagaagggccaggtcacctgcaaaggaaggcccatcagataaacagcagacctctcagtagaaactctacaagccaaaagagattgggggccaacattcaacattctggaagaaattccaacctgaaattttataattccagccaaactaagcttcataaataaaggagatataggatccttttcagacaagcaaatgctgaagaaatttgttaccatgagacctgccttacaagagctcctgaaaggagcactaaatatggaaaggaaagaccgttaccaaccatcacaaaaacacagaccagtgacactataaagcaaacacacaaacaagtttgcctaataacaagctaacaccatgatggcaggatcaaatccacacatatcaatactaaccttgaatgttaatgggctaaatgcccccattaaaagacacagagctggataaagaaccaagattcattggtatgctgtcttcaaaatacctatctcacatgcaatgacacacataggctcaaaataaaggaatggagaaaaatccatcattcaaatggaaaacagaaaaaaacaggggttacaatcttaatttcagacaaaacagactttaaaccaactcagttaaaaaagacaaagaagggcattacataatggtaaagggttcaatccaacgagaaggcctaactatcctaaatatataaaaaaaccaaacagcagcactcattattaataagccagattcttagagaccttcaaagagacttagactcctacacaataatagtgggagactttaacaccccactgacaatattacgtagatcactgagatggaaattaacaaacatattcatgatttgaattcaacattggatcaaatggacctgacagacatctatagaactctccaccccaaagcaacaaaatacacattcatctcatcaccatacggcacatactctaaaatcaattatataattgaacacaaaacaccgtttagcaaatgcaaaagaactgaaatcataataaccattccctcagagcacagcatggccaaattagaaatcatgactaagaaatttgcccaaaaccacacaattatatggaaattgaataaactgctcccgaatgacttttgggtaaataatgaaattaaggcagaaatcaagaagtgctttgaaatgaatgagaaccaagacacaatgtaccagaatctctgggacacaggtaaggcagtgtaaagaggtaaatttgtagtactcagcaaatgcaaaagaactgaaatcataataaacattctctcggagcacagcacggccaagttaaaaatcatgactgagaaatttgctcaaaaccacacaattacatggaaatcgaataaactgctcccaaatgacttttgtgtaaataatgaaattaaggcagaaatcaagaagtgctttgaaatgaatgagaaccaagacacaatgtaccagaatctctgggacacaggtaaggcagtgttaacaggtaaatttgtagcactaaatgcccacatcgaaaagttagatctcagtttaacaacttaagatcacaaaaaagaactagagaaccaaccccaaactagaagaagagcaaaccaaccccaaaactagaagaagaaaagaactaaccaaaaccaggatgaattgaaggagagtgagatggaaaaaccattcctgcctgttgctaaaccaaaaccaagagttgtttttttaaaaaaaaattaataaaatagaccactacccagattaataaagaagagagaagacctaagtaaacacaactagaaatgaaaagggggatgttaccaccaaccccacagaaatacaaataactatcagagaatcttaggaacacctctatgcacataaaccagaaaatctagaagttatggataaattcctgggcatataaaccctcccaagactgagccaggaagaaactgaagccctgaagtgaccaataatgagctctgaaattgaatccgtaataaatagcctaccaacccaataaagcccagcaccacatggattcacagccaaattctaccagacgtatacagatgagctggtaccattcttactaaaactattccaataaactgaaaaggagggactcctctctaactcattctatgaagccagaattattctgataccaaaacctggcagagacacaacaaaaatagaaaatgtcaggccaatattattgatgaacatagatgcaaaaatcctcaacaaaatattagcaaaccaaacccagcagtggcacatcaaaaagctaatccaccatgatcaagtaggctttattcctgggatgcaaggctgggtcaacatatgcaaatcaataaatgtgattcatcacataaacagaactaaaaacaaaaaccacaggatcatcttgacagatgcagaaaaggctttcaataaaattcaacatctcttcatgttaaaacacctcaatgaactaggcattgaaggaatgtacctcacaataatacataaaataataagacagtgtagcaattcctcaacacctacaaacagaagtaccatacaacccagcaatcccattactggctatatacccaaaggaatataaattgttcttttttttttttttttgagacggagtctcgctctgttgcccaggctggagtgcaatgacgaaatctcggctcactgcaagctccgcctcccgggttgatgccattctcctgcctcagcctcctgagtagctgggactacaggcgcatgccaccacgcccagctgattttttgtatttttagtagggacagggtttcaccgtgttagccaggatggtctccatctcctgacctcgtgatccgcccaccttggcctcccaaagtgctgggattacaggtgtgagccaccgcgcccggccaaattgttcttttataaagacacatatacatgtacgtctaatgcagcactattcacaatagccaagacatggaatcaacctaaatgcccatcgatggtagactggataaagaaaatgtggtacatgcacaccatggaatattatgcagccaaaaaaaaaaaagaatgagatcatgttctttgcaggaacatggatggagctggaggccattatctttagcaaaataacacaggaatagaaaactaaatactgcatcttttagctcccacttataagggaagctaaaagatgagaacacaaggacacacagagggcaacaacagacactggggcctaccagagggtggagggtaaaagtggggaggggattgggaaaaataactaatcagtactaggattaatacctgggtgacaaagtaatctgtatgataaactgtgtgacacgaggttacctagataacaaatctgcccatgtacccctgagcttaaaaagtttttttaaaaaaaaatcactgaaagattccaattcacctaatgaaattaatataactttaacaccatgtctaataaagttaacataaaaaagtctagattaatctcacaaatagttgcaaaaattctacaaatataactcaatattttaaaagaatattgtatattattaattggctcaatattatcataactattaatataatctactataatgataaaggagaaaaaggatcatatcaatagatgctaaaagggtctttgattaaatttaggagctactcataaaactctaagcaaaagataaaaatattaaagacatgttattaaaactcaacaataaaaacaatcccaaataatgacacacttttaattgataaattaaaatctaaaacaaaataggaatattgtctactgccctgttattaaacatgatctttgagcttcttgtgactgaaggaaaaaattgtatgtggggaaaggtaaaattattcttttgctgattacattattatacacttataaaatccaaaattctaataaaaaacctgttcaatcaataataaggttgcagactgtatgttaaacaataatcaagaatatcttctatgctcacaatataaattttaaattgtaagtggcaagaaaaaccccaaaaagtcattcaacataaggcccaaaactataaaatacttatgaattggtttaatatggaagacctatctgaaaaagattgagatcttattgaagggtataaaagaagtcctgaaacacaatatcaaaaaaaaagcactttcacaaaatttcacaaaaatttattctgttttcctctgtgaatatccagctgacacagcagcatttaatgagatttaatcagtgatggcagaagtcaggacagtggtcatccttaggatgtgggacaagggaggccggtctgtttaaagtcaacagccaacaagagatttggggaaaaaaatcataaaaaaggtaacaggaaaacacactgatttccttgatgtgtaaagggacttattaatttaaaaggacaattgtgttggtaaaataggcaaagtacatgatatgagcagttaattcacagaggtgagaagaaaaacagtcaagacatgaaaatatgtttaaagttactaggtccttgctttacatctaagtgagcaaaaaagttacaagaataactttgtatctattaaaatggaaaaattaaaagagctattaaaactgccatccaatgagtgcgaaaatagtactctcacacactgccagtgacaatatgaagtttcctagcttttctgaaaagcaatccaacagcttcttttaaaattacaactatttgaaacgaaccctgcagttccatccttggaaatctcttccacaaggagaaaaagcagtagtacatagattatatataaaggagtatttattatgtcattgtcttggggcagaaatctaaaagcaaagtaattgcccttcacagaatcccatctggcccccagggaggaaggggcaaagaaaggcggggcttgaaaaaatttctaccaggttcacagagtgaaataaccaagtaggacagtgtgcctgatgatgaccccttttctgaataacaaaacaggaatatgaggaaaaacacagaagattactaaatcacttacatgttaagtatgggcagggggtggggggttacagagaaggctgaagagaaaagaatggtagaggcaggagctgagcagagtgggaatggaaaccagagtacacttggaaaaaagcaggtcagacacggtttggcacatttatatatgtataggaaattatatgtacaggtcaaggtatgaataaattaagtaaaaagttcaaatcactacactatgttaagtggaaaagaaatgttactagtgcaaggcctgagaagaagcccctagaatcatgttccctgaacactcatctaaatgggagcatgcccttctcagtacacccaccctcacactgttctacttttcatctcggtacttattgttgtatgacacagatgtattccatatttattttgtgcactcaactataagctacataaagacaaaggacttctgttttgttccttattgtatctcaaacctctagactgcctggcaccaagcaggttctcaataatacttgttggaagaatgaggatcacacaggaaatggtcagcacttctgctaggaagataacaaaagaagtgaggtgtggggtagaagtgtgagtttccatctgatggacattttttcttcgaggtaaataaggttaataaggctttcaagagaattgtgaatgtataatttttttttttcctggaaataacctgaagaggctgtttcaaagggtaagatgccagtacaaatatacccaaatcattcagaacttaattttaaaaattagtatttaaaacttctccagataaacagtaacaaccccattcaggtctcactaacacatgttaggtttgtatgattcctttccttccaaaactaagtaattccgaggtatttcaacagcacctagactttctcttacttgtcccccactccactgaacaataaatgcagtgcaataggaaaatttaattgtaaaatgatcttttccaaaagaatgccccatttccttaatttgattcttctttgtgtaacgccaagttcccgaaaggtcagagcagacttacattgcagcccttgtccgttaggtaactgattccttcttctgggccgattgccagttccactgaaataatccagcttgacttttgaaggtgaaacaagtgagaacagaggtggcagaaggaaaaaagaaatactttagataaagagccgtggatatgttaaaggaccaaagcaggggctggtttggtttgctattaatctatctaaccaaataagataaaatatttataacttcattgacccaggatgtgttaagcctgcacaaagtgcactgtgcttattccagcatgcctgatgccaagggtttctctgggatgattatctaaataggtaaactagcccttagagaacaattaacaaatcacagggataaaattttaaaaacctaactatgaagctaggcatgctgtttttaaaaaggtgattttattctcacattaattattttctttttctatttttcacatggtaaaatgaaaaaatatcattttattgaaaaaaatgggacaagttagcattttttcatcagaaatttagatatacagcaagagacaagaaaaagtaaaatcaaactagcccactatttcccatattcccatacttacaccaagagcacacttgaagcattccttatcaaatctgtagactggagacaggatctcaaagaatttcagaatactttcttctctattaaggttggcaaattgtctaaatgtttgttggatcagttttcttagtgttttggcctgcatgacaaaattaccaaaacatcttgtaaaaatcagcaatgagtaaagaccacaacaataatggtaagatttctttcctaccaactacttactaacacctacattcaaattactgccaaaaagtatacttgtcaaataactataaatgtatttatcaaagctttattcttttaattgtggcaaaatgcatataacacaaaattcaccatcttaaccatttttaactgtaaagttcatatatagagttttatttcttaaacagaagtttgtactatatgtgcacatgactcagaaaacaccaggccaaaggtataaaggtacttgcacattccactgttaggagggaaaaaaacagtatatctttctgaaggaaagcacaaatcaaaaactttaaaaaaaccacaatgcttatccataaaataaaattccaggacattattctttagaaatgattagagatacatgcaaagattcaggaacaaaaagattcactgcagaactgtttacagtaatagagagcctggttacgtaaactatggtgtatctatcttctcaaccaacattctatgcagcctcaagaactgttttggagaactaatctactggcattaaaacccatattacattgttacatgaaaaaagatgacaaaacagtcagcatggagtacagatgcctttaaaaggcaagagcacacgtgtgggtcctggtgagcacacagcaatgtacccatgaaggagataaagcaacgatgcttttgcttttttcatgaagtaagatgataggtggtcttccagtcctttttcgcttatttgagttttctacttaaacacatggaaatctgcatagcagaggtaaatgctttccaagcagcaaacccccagtccttggtgtgtgaagcagtctgagaaggccatggataaagggaatgtgatgaggtctaatgaagaggggcaagagaatgtaggccatagttaacaagttggctttgactctgatgagatgccaagccctcaggagactttgagaagaggagtgactttatctgactttggttttttttttttttttttttttttttttttttttttttttttaaatagggtctcactctgtcgcccagactggagtgcggtggcgcaacctcggctcactgcaacctctgcctcccaggctcaagcgattctcctgccccagcctccctgagtagctgggattacaggtgtgcaccaccacacctggctaatttttgtatatttagtagagacagggtttcatcatgttggccaggctggtcttgaactcctgacctcaagagatccacccgcctcagcctccgaaagtgctgggattataggcatgagccaccgcacccggcctgaattatgttttaacagggatactctggccactgtgttgtgaacagtatgaaaggagcaggagagaccaagtcagggcaacccaaataatccaggcaggaggagacagatggcacaagtacagaaccagaaagagggtgagaagtagtcaagtagtcagaccctacctttctttcttcttcttttttttttttttttccagagtaactggactccaatggatttactttaaacatagaaccaacaggatatgctaataattaagagttgccattaaactgaaatggcagaaattgtgagaggagcagtttggtgggtaaaggtcagaaagaatgccagaagaataccagaaatccaagtggagctgtcaagcaggccagtaagggcccagtggagttcaaggggaggtcctggctggcccagcagacagggaagatggattaggtgacctgctaatctcagtgggtcagggacatggggagcagccaggggcccaggttgaggtgtggctgctaagtcaggtacaccgtaaactaggagggcatggcatactttggtggggtcatggaggtaatagcctgtctgtagtggcttgaaggtcctagtaggatccaaggattactggatctgggatactacagaaagtgagctggaaagacaggagctatggtcagagagaaggatacacacaattagggagggggttcgattactggaaatgaataagaccagagtgagaggttgaggtaaggcagaggacaagattcctgaagacaggaattcaatgagccaagatagtggaacatgggaggattacctaaggcatgtgacttttattttaaaaagctcgctctgctcttgcacacagagggttgggggagtgtgtaggagtgaaagcagaaagaccagtcaggtcactgtaacagatcaagcaagaaaacactagtggcatggaccccaaggtagtggtgaagaagagaaatgggcacttttgggacatttggatgatcatatgcaagacaactggaaagtaaagaatccaggaaaagtagagttttagatggaacaaacaggcaaacataagaggcaggcttggtgaaaaaaataaagtcatgttaaccctgtacatgtgtttgaccttgaagtcttccaacatgaaccatcaaggagacatttggatctaagtctggagctcaggagagggcagcactgttgctagaaatttcagagccaccagctgaagtatttaaatacatgggactagatggcacctgcaaataaaatgaagacaaaagagaaggccaaagctaagtaagctgaccaatagttggttttaaccagggctgaggttttgacaggtgagtatgacagagtggaataagagaattatagctgttttgaaaaggattaattacagcttcacagaacttaaactgaagagcaataaaatgggttcaaggttagcaaggcttgactataaaatgtatcacatggaaagtgaggtggtcagcctcagatgctctataaacaaaagtccgaaaagcatattcttggtttgactccaggctttctaaacattctctgcttatgatcacctatgtaggacagactctacaacagagcatgcagattggacatggagatttgagtactgcttgtagccacctacatgatgtttttctccttataaattaacaatatagtaccttgggactttgctgaatataaagcagtctctaagaagcaggcccgctacactctggacctagaacaaatccactaaggaaattctactctgtgcttggcacttggcatacactgcataatcagaacaggtatctattctcaataaattcagagtacagctggaaaaagagcattctgatcttcattcatggctacaggaggaacagtataattctgtgcatatagtgctattaggcgctgattcacacacacacacacacacacaaacacacacacactaccaaaaaatgataccagaaaagacatctgtaggcccttccgtggaaataaacaaagtcttcacaatgacccttgcaagggagatactatttttcatatattactgagcaaacagagactgaaacattaggtaacaacgagggggtacaagaattgtgattctaatccagaactacttgatttctttttacttgctatgagaccaattcaaacacctccttttctaagatgctctgcttgatagaagaaaccaggaagaaacaaccaccacatccctatgggtctcatactgctttgaatgtatttttagacatggcacttatataagatccacgttggtgataagggagcatgcactgccttgttaccccaaagaaaagagtatagcccgcagctgaaactcaatgatgtgcttttacaatgaataattacatgtctctgccataacaacttggattctggcaaactctcaaacagataatatggatgaataaaatctagttctatcctgtgataaattaggtttcactttctagtaagtaagtgggaagacagttcagatttctttagtttcaaacttctatcatagaacatgctgcctcaatgtacaaatgctctgagtgtaagaaatgtctcccatctacaagtattaatagaaaataagtccagcaaaagccctggaatataaaaaaatctctttaagtgtatgatacaataaattggaatatggtagcagttgcaaggaacagttgtcaactgaacacagggaccagaacacaatgacaaaacatttctattaacattaaccaaatgttggtatattcattcatgactctaagaggaatatttcaactcaggtaaatactgacatgcagtgatcaaaaattatgtaaaataggtacagaaaaaaagtcaattctctactttgtacctaattcccaaccagctgctggtttatatataaattattggcaatattataatatactgacacctgctcatttgttcaatgctttttaaaattaacctaaaacattctatgaagtaacggagatagaagtcgaggaaacagaatctgctcttgaggttaaaatgcatatatatatatacacacctgcctacctgacagttccactgcagtttctcacagacatctaaaacctgccactaagagcactgagatttcagccgtggtggcttattggccctacccgactggaccctaacatatacatctaacttggttgcaactctatcactctgaacttactctttcctataccccttccctttgacccccatagtctccaggcacttctagttcactacttacacagctgaatgcatcacgggcagtcccacccagttcagattctgcttcaatattgtctcttgactagtagcactagacagcacttaagtgtatgggacagaaatctgaggccaggccctgtattttcttcttcctcctcccacattagaccagtagctaagtcctgttagactttacgcccgtaacattcttcaaatgtaacccaacaactctctaccctctgcctcctttaaattcaagccctccttgtttctcttggcctcttatttctcagcatctgatgactaagaatcttaaaaagaagttgtgtgctgttcttctacaacagggattgaagccatcaaccctttgctaaataaagtgagtcaatttggtttgatcctcattttctcatcccaaactcttagacatggaatgtgtgtggtggtaaagaactcaactgctctccccgataatttaatctgctggaaaatttccaagtaactggggcaaatgtgtttgaaagtaataactatgcaatgttaagagacaatctggactccaattttactgtatttgtctcattcagctgaatgtgggaaaacatgctgctttttctgtaggcggtgttaccttgctcatcctacacattaacaagctgagacccaagaagtgagagcaacaaacaacacaacaaaccagtaagctcaagcagctggagtaaaggaaaacgatatcattcagagttagtttcctatggacacagaaacaactctctcattctccaccaactaaaactgttggcgcctttggcaggaatatacccaagttcttatggtctgtacttaaatgcgactgccaatgaggactgtgagttccaaacctatggtgttcagtgctggacagaaactagaaaatctctgctgtctgaaactccaaaatcagtttttacgaaaaggatatcttagaaagcattagttctttcctaattactcagtggggaacaaaattccacaaaatctgtgtagaatctctggatattaatcaatacacttgcagaacttgtttaagtaaacaagactgttctcattgcatttcaagtttgaacacctgcttgtgttaacctggattttggaaacaaggcatctacgcacactattttattttaaaccaatttacatatagtgataaatttactaagaatgtgatacttcttcaaaatgaagtggtattgctaggatgaaccataagaaactgctgctattcatccatgttgagctacaaaaataacttcctattagtcaacctaatgattatcagatgctgctagcaacaatagattcctaggacttcccagatgcaaaggttgtaaggcaatgccaaggaaaatctgcaataagagagtttttaaggaataacttctcaacccaaacaccaaatgctttaaatgcagatacattaacagcgcgtgaagagagcctcttcttactcctatctacaggacccacatcagatgataagctctgtaagcagaggccaggtttcactccccacccagcatccccaactcaggtcctggcatacagcagataacaggaattcactgctgaacatcgtaccaagatatgcatttctgtgcttggtgaaaatattaagcttaaaatagtcatctgctcatcctagaaatgaaaataatgactattttctccaagaataaaatcatgtgttcctggtagtattctaggaaaccacattattacttgagaatcagatactaaaaaaactgataactattgatctcttaacatttctagttctgaaattaggtttctactgtgcattatattgcaataaattaaaatttgcctattttgacttgctgcctaatttaagctcagagtagagttgtaatgccagtatggggagcacccttggtacccactggtaggacaacattcactgaactacagaagtgactccagtttcactagttgtccactaatgtcctttcactgctccggattccacactgcatttacacatcttgtctcctcagcctcctccagctgttaaacagcttctgggtcttatctttcatgaccttgatatttttcaagagtaatcatcagaattctgtagaatgtccctcaatttgggtttgacagttttactggtacagtgaatttttaaatgtgtctttaaaactactaacatcaacgagacggaaattaaaatacttgcaaattattcttagtaattgaggcacatatatcccagattccatttttggcataaaacatagctaatccaagtttcactaaagataataaaacaatctttcaacaattcaatgtgaatgttaattataaataatcttctacgaatataaatagaaagggaaaaaaaatcaggtaaaacaaaatgatttttggagaaacaaatgtagcctgtttatggaaaagccaatgttaactgacttagccattctatagagctatttcagaagaaacaagaaactggtgtgaatttctagctagctgaagtttcactggcaatagctttgaagaagggactgtctagacaccacctaatttgtattatagttgttacccccatgagcatatgttggtaccatattccatagaagtttcatggcaatcagtgcaatgtccaaagaatttatgtcaaatgtgaaaaaaccttgggctaaggttatgaattcctaagccaaatacacactattgggtacacaaaattacagtgattcccttattaaaaagggcatgtgagaaaccagttctaagaaccgtatttatgagccactccataaatctgatgaatccatagctaacagtagctaaaaattaattctatttacatcaaaatcagcagcaattgaattgctcaaaaagcacatctgttatttggttttctggactgggtgtgatggttcacatccgtaatcccagcactttgggaggcggaggcgggtggatggcttaagtcaggagtttgagaccagccagggcaacatggtaaaaccgtgtctctacagaaaaaaatacaaaaattagctgggcatggtggtccatgcctgtaatcccagctactcaggtggctaaggcaggagaattgcttgaacctgagtggccgaggctgcagtgagccaagatcgcgccaatgcactccagcctgggcgacggagtgagaccctgtctctaaaaaaaaggaaaagaagttttctcaagtccctctagtcatccttccctcccattcttacagaagccattccatccaggccttgatcattgcacatctcatcttccttaatcacctcccaagtcttcttggttctttttgctttcaatctgtgctccatgttgctgtcaaatttatattctagaatccaaaaagagatcatactgcacactctgcactctctgcatactctacacactctgcaatgagtccccaatccccctcaactcctacctcagcatttaagcccacaccaagtgactgcccacaatgatcccatattgactctactcaaccaaaaccccctttcctgtctgacctctgtttcctagacagcctagaaacagagagggctcgctgtttctagggtgtgagccctctctggctatcagggctcgctgtttctagggtgtgagccctctctggccaccaggagttatctgatacccaggtacagctcaagatggcaggaaaaaaagcacatgggcatcagcagcaaaggccagggcaatggaagcctaaacgatagcctggaaacatatcttaagatacctgcacaaatttcctgcagaggagggttttttttaggggggtggggatggagagcagtagggaaggcataaccaaggaaagaaactttctagcttttcaattctactatcttctaaagtcttatcctgtcttcacaccttttgttcacattgtactcagtgttcagaaagtgtctccccttattttactcatcatattgctgttattcattaagtaggatttaccaaatgttactacgtgccaggtacaatgtcaaacaaagggtgtagagtggagacagcaacagatattgtctttgccctcaacaatcttaaaatatagcggaggaaggcagataaaatacaaacaagtaacaaactacataattaaaaattgaggccaggcacagtggctcacgcctgtaatcccagcactttgggaggccaaggtgggtggatcacttgagctcaggcgttcgagaccagcccaaccaacacagtgaaaccccatctctactaaaaataaaaaaattagccaggtgtggtggcaggcacctgtagtcccagctatttgggagactgaggcagaagaattgcttgaaccgggaggaggaggttgcagcgagtcgagatcacgccactgcactccagcatgggcgatggagcaagactctgtctcaacaaaaaaaaaaaaaaagagaaagtagaattaaaaattaagatactaaacagggtcccaagattgaagggagtattttgccatttccactttgcgtggtgagaaaagagtaggagagggaacattgaagcagaggttcagaaggaccagtcatggaggagacagggccagtcctctaccgaacctctttgggcacctgtctcactctggctacactcacaccatggcacctgtgacctgtacctgtggttccgttttgaatatggggatcctttaaaaatctagaatgtattggactcctaaatgacaacagtcactcttttcctaattgtttatacacatacagatttaaggagactttgcaataattctgaggcttcataaaccagtgcttcacaactgaaaacccctgaccaatactactaatgtgacataaccatcaacagaacattgggtagagtactcttctatccaacagcaatgtaaattcactaaaactgtagcttacacttgtttgaatgtctccactatcctcctcactgcagcacccagcaggtttacacacagcagcatcccttccacttaagggtcttcccatgccttctcggctcccacaccaaaaacattccaggtcaaactgaatctcccattctcccaactgcaagagtatgggccacccacacctaataactctctcgaaggacacaattgtgtcattctctctcattccccttccactgtgccaaacttcatttaaaactctttgttctctttcaaatctgactcaacccactcatgccaatggtctgtgggctacttgtagactgggacagtgtctcgatctgtagtcctggcctcaaccacactaaatggagtatgctctgttccctaataattcactgtagtatttcactaatagatcaggaaacttgaatgaacactgaaaaagtcgagcagcatcactagaaagagagcctgaaataaagagtatatttttcctgtactattcttaaatgcacgtcttattgcatttctagaatgcattgtgttttaaagccaacacctttatatctatttttcccattagattatcaagaagctatgtgagagaggaagggatactgttactttctggactcagggaaacagtgactaatccttacagtcctattctggatgggtttgacagagagcaggacccagatatctgaatacagagcttttgtcacagattgcatctgataaattataccaacactccggcccaatgataatcaacatgacgtcgacagttctctctcttttggtctttctaagatttaatcctcttattaatctcgtgttagaaatggattttatccccattttacggatgtgtaaactgaaataccaaaagatgaaataacttatccaaagttagctacattttctcataatgagtatcttctcctgcttgggcttcagctgatgggatgtagaataagatctttgaaaaataaaaagtaagagcagtaacatccactgttgctatgtgacaggtactgtggtaagtaatatatttactaatctgttaaatattcacatcaaccctacaaaatactattttcttcattgtagaaataagaaaccaggcccaagaccctgaggctagaaaatggcagagctcatctgagccagactctgccttaaccctaaagtttgtatcccctgctgcgcttgaaaatcttgatgtgtgctctggattagctgggggaatcacacattcagagtcctcccacctcactccaaggtgctctccacgctggatatgggaaggataagaactgaggctctgccaaagctactaatgcggggaagcatccaaagggttgaaacaaaagacagaccttcaaaatgcactaacatgcacgcacacacatacacacacacacacacacacacacacaatattaatgattccaccaccacgattattttacatattgctccttttcttctgcatgtcaaaatattttagcctgtgaagacctagatgacaggaataactgtgcacataacttttttagttttatgcttagcagagtatcaaacacaattaagaagtaaaaccatgttttatgggagaaagctatactaaaaacctatttgccattaatgtgactagaataaatgtcagctttttaaattatatattttacatgtaaggaaggaaactacattttactttcccaaaagcaatttaccactggggaaaaggtcttggcataattttgttattttattatgataaaggagactctaattaccttgacagaatccagtaaactcttaggaaaaaatcgctttaaaccaacatcttttctgaaatataaaaagaagcgtattaacaaataacaccaccaaatcaattaatatgacaaacttgcaagaacataaaagcactgtaaattatttatccttccatatattatttaggaaggaaacaagtataataatgctttaatttaccagtatattcacaggaaggatgggacaaatcattttctagatatgtactggaaacatgaatacaagttggtttaaatagaaatccttttggttttttctttttttacctttattgttgaaaactcttctaaaatattccctctttgtaaattatagtgtattaaaaactgtcctttttcagatatttcttgaaggttataaacatcacttccaactgggtaatactgtatttgtagagaaaatagctagcctgattagtaaatgattcaggatatacccgagaagttacagaaataaatcccttaggtttatcctaaaagttgactatttttaaaaatagacttttttgattaagtgactcattcacttgtctcagtttcacattaggaaaaaacaaacagataaatttatgccctaggtaaaaaaggtgaatttatggaaatgctggaaatcgcagcaatgttctttaagtcaggcaacaaaattaaattgatcattattatcaagaacctcaacgctctggccaagaaaataggttggaaagaatagctgattcttttcctagtactttggttactaacttactcagatgttttggccactaggtgtcactcgtgtgctagcaatgtgaaataatgcctctgacgacattaaggaacgtcaggaaacacataaaaggatcaaggagaaaagggaaatacaggtatcttttcagaatcacatactatatcacatataataaactgaatataaagtatcaagaaacagggatgacttcttcatccgtaactgttaagttagctgacgttataaacaaaaccagagacatcatgtcagtttatttggttgatactatattcaaacattttaaatcccttattctataatctaactgctagtagttcctaagccaatgaattcctcctctggtaaattcgaaactggtctcagttctcattctttcttattctgatattatgttcattacatcctataattctctctcagcttctatgatatactactttctggttttacccatcagttaattcatttaactactggttttacatttctgtctctagccacttttgtttgtaacttcccttccttacctttacaaaaccatcattatctattttgacagttggatatgaaggggggaaaagaatccacacaagttcctccttttcattttgcctcctaaaaacacagggtctttgcattttaagaatttttatgccaatcactacggaaaagtagcaaaattagtacacaaaagacacactctggaatctacaaggcagtattcttgaggatttctgcctctatctacattttcaagccactattccttaacagcaagcatttattttcatatcagagtgtttgtttttttgagactgagtctcgctttgtcacccaggccagagtgcagtagccaatctcagctcactgcaccctctgcctcccaggcttcgagcgattctcgtgcctcagtatcccaagtagctgggtttacaggcctgcactaccacgcccagctattttttgtatttttagtagagatggggtctcaccatgttggccaggctggtctcgaactcctgacctcaagtgatctgcccgcttcagcctcccaaagcgctgggattacaggcatgagccactgcgcccagcctcagagagttcttaatttgaatcttggctctgccataggacagacttgctgttaacacctgcgaacctccggttacttgtaaagtggggatgtgaactcctactaccatgcagtggtgctgaggtttaagtaagactgtttatgaagttcctggaatgtgaagggggcagtttctgttctgccttagaagaaagcactgctgtctggacagcttctggtccacatgccctgtgtctcactgtttactgcagagggaggcatggcctgacctgaggtttgctggtggacaggagaagcggtgagaagtggtgagattgaggggctactgtggacaaagaggcaacagggatgagtgactggacatgaggtgtgagggaatgctgaagctacgcaccgagaacagaaaggtgggtgggcatcaacagttctgttttagacatgtgagggcctaaaacagacccatgggcaaggtgtacgtgcacgcccttctagtagggatttcaagaaggcaactggccatgtttcaagaaggcaacacacacgtcagtatttgggtgagggaaagaccagggcagggaatatcctctccgccactgtgtggctgtcaactgctattaatcaacccagctacacatctatttttctcagagccaggcataactaaagaacttaccatattcattgctgtcacaaataagaaagttaaagataaaccaaaagtgttgtatgattcaagaaaaatgaaaggaagcatatgttttttgaaaataaagacgaatactaggtattgcttttacttcaaaggtgaagacaactccattaaaaaaaaaagaaacctgaaggctaataattagcatatatacagtttaggttttcttaaacttcttttgactaataatgaatttgtaacgtttgtccatatgttagaacttttttgatacctggcagttgagaaaataaaaatgaggctcaagtacacaaggtcatggtaaaaattctgcaacgctgcctttaacacattttaatttaatctcgaaatcaaactacttcaggttttgtgatagaggactctgagcccacctaaggtactatgttcaaagtttttagggaaagcctattatagatatctaaatttaaagccttaggaaaccaaacagggacttgtaggctgtcccatttttaatatgaggtcgcctctctccatgatctgtgtgtttgggactggtttacaatgtgcactctaatcagcagtagttttgcctcaagtggcgtaaaaaccttctttgagcccaaactctacacaactgtcctgtatgcgaataaaacaacaaatacaacttacacatcatcaacaaaatataattactaacctttatcatacaataattccttactatattaactgtcaaaggatatgtcctaaatgcatttaaactcatgtaataaaaaactaactcacatgaagcttttagaatattgccaaaccccaattcccaaacccaagcatcagtttattagattcccacatcagttcagagaaacctcttgaacccatacacagatgacaagacactaatattaggttagaactgtgttgtccaatatacaaccgctagtgatatgtagctatttatacttacattagttgaattaaattaaaaattctgttcccaactgcaatgctcatcacatttcaagtgatgagcagtcccatgtggctagaggctaccaaactaggtggggcagtcacagaacagttccattgtcgcagaaagctgcaatgggtggggctgggccagagcaatgaatctaggacttcagccaccctcattctctagggcttggtgctgtgggcccaaaggctcctcagtaagcacagggatgggtgaaatgcatgagcactgggaataggtgcagagttaccacagggacaaccactcaaggttcttgccttgctcagaaagactggggaaagaaggtatagaggcatgaggagagagctctaccatgacaatgcagaaggcagcagatctcacaggagacagctgtatgttaagaagcctttcgttgggactgcttgtatatacatagcagagggcttctaagtattacctttcctacttctctctcaggactaacaaaaacggtttctatgatctattcactaagattcaaatcatttagatttgaagctacaaagaaaagagaggctgtattcatttactccctcactgagaccatatgacatactaggcactataacagatcatgggatagaaaaatcgctaatatgtttccttttcttaagtgagataattacataaacaactaactacaacacagtgtgaaaggtactataagataagagtttaaaaccaatacacttagccatcgagatttaaggtttttctggccaattttaaacagaactctcttaatgtttaactgacctctatcctttaagtgaaagatttagaacactgctgactgatatggtcttctttctcttttgctaaacctcagaatcccatttaacactccactgattcctgttgccatttagcatttttggaaaatccttagagagctctgccctcccacattcctgcatgatgactatgcacctcctcatattcctcctttcacaccacagtggccatccagaatgctgcaggaaaagaggctgtgtaggagggcctctccccacctgcaccagctgactgccatcagcattccccactcactgagatgaatcctctaggtgcccatctagtcccagcctgtggccttatcctgcacgtgtattcatatccacaaattcataacacagctggcttttagaagcctcagatgggaatcaactttctttacatattaaaaagaaactaagcttattataagcacatttttaagtcaaggataaatttatttctcttctggcaatatttctgagaagattcttgtctgttgaccctgtttaatattttgtgaacataatccctcaaatacttaaaacccaggcaaaaatgcagccaaaactaacttcaaatataacttaaataggcatttccatgtagtaactcttactctttctccaaaactgtcagaattgagtatatttaatttagaaatagtatggtggtactttcacctctaaattatactcaagcttcttaacagacaaatgttaaaattatctaactgcaacagagattgctgtttcttaatgacattctccccttcatcctggggatgaagttgtcttttggccaggtaaagtgctgccttccccagtctcttctgtagcaggtatggctatgcgactatgttttctcctatgtccctctaagggaaagtattaaacagcaggttcataaataatgtcattattatgtaatgttgtttcattatagtgttgatgagaaaaaaaattgattcccagctgggccactatatggagtgtgcatgttctccctgtgtctgtgtggggtttctatggttactccactttcctcccacatcccaaagatgtgcatgttaggggaactggtgtgtctgaattgtcccaggatgagtgagtatggggttgggggagtgagtactccctgtgacgagaatggcatcctgtccaaggctggctcctgacctgcatcctgagctgctgggatagggtccagccacccacgaccctgaactggaataactgggtaaataattatctggttttttttttaatcagactttttaaaatgtatgcttacatttattccaatgtttaatattagaagtgttttgggtctctacttagaagctggggatgtttttgtgacgagaaacattccacaagaacttaactcttgtttatatcaattagcccacggtaaaactggtttcactttatgtcgtttcacttatagtttccaggaacctattgatgttaagtgaagacttactgtatacacgtttgtgtccttgaaaagaaaaagagaatgcccatctcttcctccttcctggggactagaatacatacgtggtgatgagtgatgttcagcagcctcttaggctatgaggtggctatggattacaaaatggtaaaattaaagtaacctgtagccccaatgactgagaaacactgattgtctatcacttcttttatataagagaaataaacttctgtctcagtgaggcaaccatcaattcctgccaaatctaccagcacctccttctttgatatttattataagtagctaaaggatgcaattgactactgttgacaagaaaaatgaaaacaagtacagcgataactaagctcagctaattttaaaccacaaatttatccattctagaaatacctatggaatatcttacagatatcagatactatataatgtgtggggaatacattccccgcacaacagaatgcagctcacattctccatagtgaagagaaacaactatacaaaccactatagcaaaatatactaaatgcaaagatgattaaaaacaaatttctaaaaaaaggcaaaccacttaataaggaatcaagcagaaatgaaaagttagatggttcatttaaaataatttcacattatagttctctaatttggggaataattactggaaaataagagtcttccttctctaatgccatattagaaatcctaattttaacactgtattggtttgtcaatatcagcaatgtacttttaaaggctaacgaaaaacatttttcttaaaacatttgacctcctttggtagctgccttctctcctcctcacctcttatttacaaatgatgtaaataaaagtcttgtctgttttgcactccagttgttccctgttgtgtgagcccacaggaagtaacgtaccagggacaggggttgggggacttcagtgtcttatacttttcctttgcctacaaaaaaagtaccttggttcttcctagattggaaagacatgaaaagaaagactgatgaactctctagttggtttaaagaaaaaacccttaagcttctagatgtatttgtcacactctcagaaactatgccttagtggtagtagtagtactagtataactcaaaatagttatttatggctgggcgtggtgactcacacctgtaatcccagcactttgggaggccaacgcgggtggatcacttgaggtcaggcattcaagaccagcctggccaacatgatgaaaccccatcgctactaaaaataaaaaaattagctgggcgtggtggtgcacacctgtaatccctgatacttgggtggctgaggtaggagaatcacttgcacctgggaggtggaggttacactgggctgagatcatgccactgcactctagcctgggcaacagagagagactctgtctcaaacaaacaaacaaaaacaaaaaaagtcatttagaaatacagtaaagcagctgggcacggtggcttacacctgtaatcctagcactttagaaggccgatgcgggctgatcacttgaggtcaggagttcaaaatcagcctggccaacatggtaaaaccccatctctactaaaaatacaaaaaaaattagccgggcacagtggtgggcacctgcaatcccagctacttaggaggctgaggcaggagaattgcttgaatccaggaggaggaggttgctgcaagccgaggtcacgccactgcactccagcctgggcaacagagcaagactccatctcaaaaaaaaaagtacagtaaagctgaaagggcattgtgcattaggctgtaaacaactgagtttgactttaaaattcctgccggaatctaataaattatgtggaacatatcatgagttttcttattagaaaggaaaaagagaaccatgaaatgaactaataagaaacaagcagtattctgtattcatgtataattcctttctgtaccgaagaaatataaatttctaaatggctccaagttactagccaaaaccaataggaaaaagaaatgccaacacactccttgagagagctgctggggttcccagttgctcctgtggtagaacagccatggtgtgtgcatgcgagtccctgcacatcctctcagccaggccactcctaaagcactggcatcagcctttacaatggccaaatgcaatattgttaagtatctttattatataaaatgtaaccaggttaatagttacattttctctgttaagctattatcgggccagatatggtgactcatacctataatctcagcacattgggaggccaaagtgggaagattgcttgaccagcatctgttaagctacctttcaagaacaagggtgaaattttttaaaaagagacagatttaaaaacagaattttattatcaaaaactacatattaaaaacttctaggccgggcgcggtggctcacgcttgtaagcccagcactttgggaggccgaggcgggcggatcacaaggtcaggagatcgagaccatcctggctaacatggtgaaatcccgtctctactaaaaatacaaaaaattagctgggcatggtggcgggcacctgtagtcccagctactaaggaggctgaggcaggagaatggtgtgaacccaggaggcggagcttgcagtgagccgagatcgcgccactgcactccagcctgggcacagagtgagactccgtctcaaaaaaaaaaacaaaaaaaaaacttataagtaaaagtaaaagggaaactaatgttggaaacagattgagctacaatgaagaatgtttaggcaacagggtgataaacatgccggtttctaggacgcccccagcacacacacactaacacaaagcacgacaggcagaagggaaactgtttttgggtttctggaccgacggtacctgcaaggtggggatgatgaacccggcgcttgggcactgaggttggacctgacgaaggcggaagtggcatcatttcctggctcttgccagaagccgcagcagtgtaaacaaagccccctggaactcagcttgcccagtctagggccaccagcctctaatccaagccactttggtggcctgagtgagagtcagagtaacagcagattgagacaccccagtacctcaaggttattgtcaaatacagaacagaaaacagctatgcataaaaacttgaagaaataaacggcacaaacaccacagatgggcataccagaggttaccaagcatgaagaagattacatcacatgaaatggaatgtctagaaatgaaaaaatataagtggtagaatgaaaaaaacaatgaacaacgtatggcataaagatactacttaagagaattaaagaattataagacaaatccaaagaaatatctcccccaaaaaagagagaatccagagagacagagagatagaaaacacgaaaaatgtaagagacagcaaagatcagaaatatatctgttgattattaaagagatagtggcatatattttccagatgaaaaacatgaatctacagaattgagaagtatgtcttattccaactggatttataaaaagaaatcgaagcacaagacatgaataaaactagaaaagatgaaaagtaggaaaaggaccttaaaagaaagagcaaccataaagaaatgtcaacagacatttcttgtcataacagagtatctttacagtgttgagaaaaaaacaatgagcagaacaatatatttggaataaaaggaaaagcataccagaagggtggtctgagatacaaaaatggttattttaagcaaggtcttcctctgttgcccaggctggagtgcagtggcatgatcatagctcactgcagccacaacaagctgggctcaagcaatcctccagcctcagcctcccgactaggtgagaccacagctgcgtgccaccgcgcctggctaatttttataattatttgtagagatgaggtctcgctatgctatccgtgctggtcaagccatcttcctaccctggcctcccagtgtgctgggattataggttatgagccactgcacctggcccaatataggatgtttaagaaataaaatcatatacatgtagggaaagccaaaaataataactgtataaaataataataatgtctaatatttggagtttcaattttgaaaagatataactaaaataacaggaaaaaatgatgtgtaagttggaagaagatggggagagttaaggtgtttaaaggtccttgtattgtttaagagagggttagataagtttaaaatctggagttggttaatatagaaggttaaatgtaagggtaactaatgaaagagtagagatgtttataaatttcaacgtaattacagaagaaaatgtggaataagaataccaactaagaaatacacagcacatgcactcacacacagcttatttctaggacaccggaaataaataataaaagcgagtccaatatatcacgcatcctaagaaatacagatgtactaaacctgtcagttcaaagaaacacttagcaaactggatttaagaaatccagcactatgacatttttaaaagacacacctgaaagtataaggacacagagaagttgaaagtgaagaaatgaaaagtataaaccaggtcaaggctaacctaaagaaagcaaaacagatttcagaacaacaacaacaaattatcaggcatagagaagatcactacataatgatgcaaaattcaatttaccaagaaggtatattgttcgtatgtttaaataaaagcgcctcaaaatatcaaggaaaaattaatagacttataggaagaaattggcaaagtcattatcacagatgggtatgttaacaagcttgattaggaagtgcattttttgaatcacactaaaacatttataaaaactgatcacacaaagcaaatacaacaaaatgttaataactgtagcattcaggtaatagacacacagatgctcactgaacaagtctctcaacttatttgtatttttgaaactttttcatgataaaacactaggggaaaatgatcttattctagggtccacaaaagaagtctccataaaagttgagaagctcttatcacacagaccacgctatctgagcataatgtcattaagccaaaagttaatttaaaaagaaaatatttttaaaatccacacatttgaaaatgtaaaaacagaaatgaatacacaaaagtttcaaaacaaacatttaacaatcttaagttctggaatgcctttttaaaaatcggatcttaaaactcaaaaaccaaaatgaaaatacgattttactacattaaagaaagacaaacttctgtaatgatgagagccatatacacatagttgaaagaaaatgacgagctgggaaagaaaatacagaactaacattacaagatgtgttaacatgacaaagactgcttaaaattaataaagaaaaaatatattagaaaagcttatttaaaatatagttaatttacaaaaaaaacttaaaaatggccatatatgtgaagaggtttaatatcaccagtaatcaaactaatataaagcaagttatcatctgttgcctatcatataggcaaaaatgaacaaaaaatggcaccatgccttacattgttattaacctgaactgaatgtccactattatgtggctgtttaaatgtatgtagcattatatactcattgggtggactagtatactaatgtatatttttatttagtcacatggaaagatctattaaacataaagttgaataaaaaaagcaagatgcatataggattattccacttatattaaaactatgcattgaatgtgcacacaagtgttaaaacagagagctataaggatatttattaaaactatgatggtggttatcagtgagaggagttgaagaaattttcttatttgacactgtagtttcactttttctctaactagaatgtattattacctttgaaaataaataaattaaaaatcattttaaaagggctcaaaattaaatcaacagatgaacaataacattgttttctatttttttttcttaatgctctttaaagaaactctacagtttggtttttatcctgattgacaatcaatatctcccatggataataatcataattatagtccacatttattcagtgttgggtacaagaggtattaagctcttgacataaattatctcatctaactccttacgacaatctcatatataggtaggtatcaccattatccccattttacacgtttggaaacagacaccaagagcttactaataaaatttggcaaatagaatagtcaaggtgcgataaggacttgaacccagatattctgcttcaagaggtcactcaactaatctacttatatggagatagggtgctgaattcacacaagttgtataactgcaacgaatcactacagtggagcaaaagcacaggaatttagaaagaggggacagcaaaataagcacaatagcatcctagaactacaataaactaaagattcctctttcttttaactatcatatttacttactttaaatatcacacatataaattaactaagatgaaacagccatatcaaaacaatagatcattcaactttccatgcaatcctctaagaaggatctaatttacaaacttatgctgtgtctagctctcctgtttcaagtaataataatcacaagcccttatgtatagcaattctcatgttctccatttcactgacccctgacaaaaactgcgtaaggttttgaaagcctttaacactggttaaagccctaagttgtcctcttctattcacctcttctctgatcatctgaagttctgtaatttccagaaataagccaaatttacactaacttcagtgcaaaatttgactctcatttcaaacagatcttgaacttaaaattcttctctccaaacataccattcactaattcaccttgacagacaacctgcttttctttctttaactgttttggctgttaaaaatatgtcaatgtattattcatggaaatttctttcaagtatctctcttcctgtaactctgtatccttttgacagtatgtctggctctcttcattcctttgtatacctctggttctcacatagactctatctttcagttaccatttcattttcctatcttggcctcacatacagatagggtagaatacaattcacattattctttttccccagccactatactagagtaggcttccacagtgaccctgaaagatgatcacatgtgttcctggagtcctctctctgtaactcagccaggccactcaactagcactcctttcttgacttcacattaactatttgccatctattgtaccttcttagatcatctctaactacttgctgacctcaattctcccatcaggttttttttagataggccttttattttacaatagttttagatttacaaaagagttacaaagagagtatcctgtatagtccacacccaggtccccctactattaatatcttgcattactttggtacatttgtcacaaataataaaccagtatggatatattatgattaacaaactctatactttactcagatttcatcagttttcttcccctatcatttttctgttccaacatcatatggaggacaccacattacctgtaatcatcctgtttctttaggcaactcctggatatgtgagtttctctgacttccactgtttccttcatgaccttgacagttttgaggagtactggttaggtactttgtaaaatgtccctgaagagggatttgtttgatgttttttctcgtgattagactgtggttatgggtttttattatgaggaaggccacagaggtaaagtgcctttctcaacacattacattatggttgcacactatcaacatgactgatcactggtgatgttgactttgaccacctggctaaggtcatgcctgtcaggtttcttcactgtaaaattactttttccccacacttcctttccttattatactctttagaaacaagccactaaatgtagctcatacgttagaggtgggttttatgctccacctcctttgagagagggtatttacataaattatttggaatttttctatagaggaaatttgtcactgctcctttatttatttattcaagtatctatattactatggactcatgggtatttaatttatactttgggttacaatctaatactatgtaacttaatttgttgctcgaattgttccagcttttgtcactgggaactctttccactggctcattcatcctttgacacagccccatcgttttgctttttgagcacttccttctttctggcactacaagctgctctagggctcacccgtgtattattcctcctctccctcaaactgcatttttccaagcagctctggtgccttccactgaagaatggtactagaaaccaagatctaagcacagggtaccataagagactttttttaatgctactggtatttgtcatttcataacagtgaaataaaccaacatttatctttcctttttcattttaaaaaacatgaatgttcccatagaactaaaaatcaacatgctccgagtaacttgtcttctttctcctcaagcacactccttttctgtgactggtatccatagtggcccacgacagaaaaccaagagactccttgggttcctccctgtccctaattcaaatgtaatcagcctccagtcagactctacctctgctagcccgtgtctccatggccactgcttccttctgtctcacagcctcatcattctcacatggacaagaaaggtacaacagcttcctggctccttgctaccattttcaatcttctttaatgaaattctaatctcacaaatatggaattctaaattgcgaatctcatcatataattgtcctgcttgaaatgatgagtcagcgatgatcaaaggccaagtccagactctttgaagaatgtactagataggtaatgacctggtccctgtatacatacccctctctccctcataagaatggtattctatctacccccaaccaactcagtttcctaacctttgcctgatggtccatgtttctgtgcctttgcaaatgctgatttatcctcttgactggcttcctggctcccatgcaacaaaccccacatatctacactttgtgaatcactcattctttaagacttaggttaaataacatctccatgtgaaaacacctcacacatcaagtaccattctcctgtaaacacccagctgatacttccactttagtttctagcacattatgttataattttgcttacttgtctgagagtcttccttttagtggaatgcttcctgggggttaaaattttgttttatttccgaatctctggcacttagctacaaaggactcagtgttcagttatcttttgctgaattaattatgaaaaagatgaagtatagggtttctagcctcccacgacataaactccacgttgggttaatttaatacaatctaatataacagtctgatgcacacattaatttcattattggaaaaatttctagttattctagatttttctgatacatgagcagtaacttccgtatctctatttgtgcaaaacaatctgtagtaacttatacagagaacatgaataataatttataagcaatttataggcagctgtagaattcaatataaattagaaaaaaatatcatcttgcaatgattaaatctacacaaagtgtatgttaatgggccatatacaatgttagctttaagacatctatcaacaaatctaaatgtttattaacacaattaatgtcatcaaggattctgtccttttcctcttctggatataaaattttagaaatagcagtgtttcagaatcagtatttaattttaaaataaactaagaatttagttctgcatatttgcaggtatagattgtaagtacaatacttactctaatacttcatagttagacttcttttctagtgcattgccccgcatctcccagtatgatcgcctaaaatcagggaagacatacatttatatgtatatataaggaatgtttgtgttgttaagtgataaaaactgggggagaggcatctgaataataaacaaaaattaacagcaacaaatgcaattacttttgcaccaaaccaatagttcataatttactcaaattttattcagtatttcactgataatccttatgaagaaaaggaaaatacctggaaaatattcaaaaataattaaaaaattgataaataaaggccgcaatgtatagttatcatcttaccgtatttctagacaacccaacttcaaagcaatttcctggtccacttgatcagctatctctaacatataatcgctcttcacctacaacaaaaggaatgggaaaaacaacactgttttaaaagaaaaatattagatatatgcattcaataaatgtttcctgagtacctttcatatagtttacattatgtcggtaattacgcttgatgttaaagatataaataaatgtttcctgagtacctttcatatagtttacattgtgtcggtaattatgcttgatgttaaagatataaataaatgtttcttcagtacctttcatatagtttacattgtgtcggtaattatgcctgatgttaaagatataaacgtgagttataccaaaaaataattaaagaaataaaatggtctcctattaagaaaagctcatatatgaccacttaaatgggacattaagaaacaacgaatagggtctgaatcataataaccttcagatgctccacacctttcccatgctgtcaaaagtaaaaacaagaagggaaatttccatttctacaaaaatttgcagatgtattttctgacctcaaactacagttccagcagcatattttggactccagtgaaaaggcaaaggatttacgtacttcaaaatccatttaactgtgcagctcagatgttttcatctaaccatcaattttaagtgattaatctgcaaagtaatacaagcttaaagtctaaagtaaagagaagaatctaatggaattcttgaaatgccttctaaacaatgaatcaactcaattttaaaagccgataagagtgatatcaatacgtgcaagtaactgtcactgtgaacacattttcaaagacgaaatgtgtacaatttccttgtagattagcctgaaaagattaaaatctgcaattgattttgatgagagtacccattttgaacttcacatgaaatgttatccacccctcctccaagacgcatcccattctcttcagcagtacacctgtgttacaagaaaaccatgctcaattattatattatgaattttatcaacacaaaaatttgtggaaatttgtcttctttcttgttctgtactttcataataccctgcattttgcctcgttcctgaaagtctaaactatttactctgaccctttatataaaaagtgtcttgacttctaccctaaaaaaattttcaaacatcctgttcttcaatgactgcctcctagcctgctagcccatttgttcaaagagtcccacccccagttaactcatctctcactccacaccaatctttgtctacttcatactggatggttcctcattatgaccgtcccttgcaaagacaaccagctcccctgtctcccattatccctctgtctgaattgcttggtaaacccaagccacgttgaacctacccactcatcctcttcatgtttagatgagcagctggagaaatcatagtataaactccactttcaactcatgaagacaaatctcaaatggccagttaaaactatctggaaattgaacaatgcatgcctaggaagcgctacaattcactgatttcatacttcctccagtaagcctgccatatctctttgttacagagaagataaaacacatcagatgagcatactctctttaacctaccaggaatttataacctaatatgcactaaaaaagtatgaacatttactcattattttctcttaaagtaggagaaacattccctcaaccagcagtggacaactatgtgctattactgatctaaggactattcgtctcaaaacctttctttattttctgcattagcatctaaggctgggtgctcaataaatatttattgaatgaatgcataaacgaatgaacaaacagtcatcaaactggagggtgggtacataaatgttattttccatatatattttccctcctttacaaggaacaagagtttctactccttccacaaagcaggcactcaagactgaccaaccggaactgaattaattcattcagttaagtaaaaagctttaggtctagaactattcgtttaacttctacaaatagtagaagctcttgtttctacaaaacaaaaaataagtctcaatttaaaacctgttttgcatcataagtaggtttattatcgagcacaaaaataaaggcgcaagaattaaaccaagataggtatttagataggcagaaaaataccaccgttactctgatggaaacattcagtggcttttagttgtctgatgcagatttcagaggaactactgcagaccaccaattacatgatgaggaaaatgcaccattaccaaattcaattaatcttgaagattaattgccacaatttttaaacactattcacaggtagaaaaaataatcaaatgctatatttcatcatcaaaaccaaattcgcattgtaaaaatgaaaaagggggaaattataataatcttcatttaaaaaatctcatttatgagaatgagttcaaagttctgagagttgtttttcctatagctttaatctcgattatcagagctgcatgatcacacactgaaatctatttgtggcccgatgtgatcaaagtattctgcaaagagtatagatctgagatagaataaggcatcaccacagacccgtgtcctcccctcaagccccaaagcagcttcccctctgctgccagagagaaagcaaactctattcagtgtctcaatgctccctgtcatctaggctctagagagtgttctctcaagccactgggcacggccacatcctgaggctgggcttcaagactcagaattatgtacacactttgttcatatcccttataaaacacttcttgaccacctgtcttccactaactcccagcagaattgctatcatttgtgaaaccaaactgatcaagcatttaggtttctataaagtatatatacctagcaccatgtcaagcagatttacatgtaatatctcatttaatcatcagaacatcactgtgaggtgggtactattatcatccccattttatagcctcagaaaaagcctaaaagattgatcaaaatgatagcagtagataataatcctacttaaggagtatccaccagggaccagttactacgctaagcattttacgtatatttctgatctttacaataattcttcaaggtagagtttattagtcctattatatataaagatcagaaaacttaacttcgtgttgaacacgtattaaagtcaggattcaaaatccagatgtatcaaccccgaaaactccagctttagtttgtacctactacttgtcaactctttcacagtgcagtcattctctactagaatgaagattaacaaataggaaccacctctcatttacccttgcatccccagtatcaaccacaatagattcatatgcatctcctgaggtattggaacactggcactgtgttgtactctctttttctattgtggattatacccaggtccaggaaatttgcaagatccttccaaaaaaaaagacttctgaaagttggtttttaaaaattaatttgttggctaggcacagtggctcacgcctgtaatcccagcactttgggaggccgaggtgggtggatcacctgaggtcaggagttcgagaccagcctggccaacatggtgaaaccccgtctctactaaaaatacaaaaattagctgggcatggtggcaggcacctataatcccaggtactcgggaggctaaggcgggagaattgcttgaacccaggaggcggaggttgcagagagccaagatcgtgccattgcactccagcctgggggccaacagtgagacttcgtctcaaaaaaaaactacgacgggccaggcgcggtggcttatgtctgtaatcccagcactctgggaggccaaggcgggtagatcacgaggtcaggatatcgagaccaccctggctaacatagtgaaaccccatctctactaaaaaaaaaaaaaaaaaaattatccgggcgtggtggcaggcacctgtagtcccagctacttgggaggctgaggcaagagaatggcgtgaacgcgggaggcggagcttgcagtgagccgtgatcgtgtcactgcactccagcctgggcgacagagcgagactccatctcaaaaaagaaaaagaaaaaaaaactaggatggatttggacttctttctttgtgcaagtattgtatttgtatcaaggagttccttcatcatactctgcaatagaatgaatgaagcacaggttttaatataaaaactgttcacattttgtaacagaaaatattgatgctaaattactccataatgtattgcatatgtcaactcaatgatttggctaccacatgagattttgtgttttattgtggtctcttttgaatattctaacagctacacaaatttatcagttggactcaaatgaccttggtagcaaagaaagaggatggggcagagggcagacaaagaaaaaactgactaggtttacttactagctgggtgaccaaaagcaagtaattttactcttagagcctagctgactgagtttttgtcagatactgtgaagtattttgtatacagaaggaactcaatggcagctccaaattaatactaacttaatttttcctctttcatacctaagctataaaaatatacaaatgaacaattacgctaccttaatgagttatatacttttaaacagttcaatgtcatttaacatagtatttaacagttacacattcattgatttatcaaatgtttataaaatgactatcatgcgccaggatattatagtgaataaaacaaacatggaacttacacaaaggtaatggtaaattttcatttaaaaataattactttggatgttctattgaggatagaccataaagctatatgacaacaaatgtttccattatctctttttgttgtccatttataatggttaagtaaccccaaattttattaaaagtaaatgaaggggccaggcatggtggctcacacctgtaatcccagtactttgggaggccaaggcaggtggatcgcttgagctcaggagttcaagaccaggctggtcaacatggcaaaaacatctctctactataaatacaaaaattaggcagacatggtggtgtgcacctgtagtcccagctacacgggaggctgaagaaggagaatcgcttgaacccgggaggcagaggttgcagtgagccgagatcatgccactgctttccagcgtgggtgacagagagagactttatctcaaaaaaaaaaaaaaaaaggtagtaaatgaatctaactgcatagcaatcttttaaaagaacatttgatgttgagtgtgtgtgtgcccgtgtgtgtacttgggtgggagcacatgcacacatacatgtgtgtgcacacacacaatctgatttctcaaacttcaaaaatttgctttatttcttggatttttttcatgacatcttctaataaatctcatctaaaagttttgaatatcagggcattaggattaaaagtcaattctcaatattaaattcccgaagataataaactgagcacctaaaacccatgccctactgtgtggtggatacaacggtgaagaagacagacttcttatttgctctcactgaatgcacaccctgttggtaggtacaacagattaacgacagttaaatataacgtataaacaacagatcagtgcttgctagagttagggatgggacagcatgtgactaataaagcaacagggattttctttgtgtccataggatagttctgtatcttgattatgatgattacatacatttgcacctgtgataaaactgcacagaattacacacacacacacacttgaatgtgtgtaaacattagtgaaatctaaattaggtttgcagtctagttaacagtattctgccagtatcaatttccttattcctatattgtattatatcatgactgaagtggtaattactggactgtatacaattgtcaaaactcactaaactgcatacttaaattattttattgtatgtaaattatacctcaataaaacaaattttgtattttaaaatgtgtatatgttgtatgggaaatgtacgggtactatgcacaggtaaatggaaggctttacgtggaaagcaccatttaaattaagagctgaagactgagcagaagtaacctaattccaggaaagaaaaggcaagttatacaggaaaatgttaactcagcggcaggtctgggatgctcaaatcctgttcattcccacgaaaggcatatttttagggctggcccttagtctcttagaaactaaacccctgaaatgttctgtctgataagagtgcttctgcatacctgaagacggccacaatttgaccaccaactggtgaaaaaactggccaccaatttgaaccagataatttatgcacacactgttttgatggtaaacacctgttttctctctagggtctggaaagtgaataaatgaggtcagtcacgtaggcgttgtatgcctatgagactgacctccaacacacaccttaaacactcaagctcaggccagagtctctgcttggcaaacctttgcatatgatgtcacactcttttttttttttaatactttaagttttagggtacatgtgcacaatatgcaggtttgttacatatgtatacatctgccatgttggtgtgctgcacccattaacttgtcatttacattacgtatatatcctaatgctatccctcccccctccccccaccccacgacaggccccagtgtgtgatgttccctgccctgtgtccaagtgttctcattgttcaattcccacctacgagggagaacatgtggtgtttggttttctgtccttgtgatagtttgctgagaatgatggtttccagcttcatccatgtccctacaaaggacatgaactcatccttttttatggctgcatagtattccatggtgtatatgtgccacattttcttaatccagtctatcactgatggacatttgggttggttccaagtctctgctgttgtgaatagtgccacagtaaacacacgtgtgcatgagtgtcacaccctttattaaccatgagtgcttctccttcaattatcaaaaatatacaagagtgaaaaagggagaagaaatgtacacaattaaatcttcaaaccacagaaaataaaccttctaataagagagttagactacattacattttagcttctgtctggaaaagggcagctgataattcctatactgagaatgccaggcttaaactaagttttacctcttagacctgcaatttcaaaatgtatcttaacgacagctttaaggccaagaaaatatagagaaggaagtcaatttctaatgacacaattatctgaaaacttgtaaaactacaaaagaaaactggaataaaaataaaaggaaggtgaccaataagaaataagtatgccctggcacctcacatgttcctatagttaagtttagattctataccatagagttaagttacagttttagactcagtattttcttcaacttcctattgcaactccttttgtcaaggaaaccactgattatttaatgtcatttaaaagttaatgggtggacatactcattctaagtcttaaaacatctgtaggagtaaacaatgacaaactcgtatcaggctcaggcatctgaagagctgaacatttcaacagtgctaaaagatttctatacaagttcagcatcctcaatgcagattaatatgacttcttgactaaacatggacactggccttcaaactaacagccaccatcatttgcaaaaagttgccaatgaaatacttataactttaacaaatgaaagttgtgagagaaaaaataaacgttacacggtaaagaaaaaaatttgattccggggtaaaacaaactgttcctgcttcctcatgagtcattagctttattgtcaaactcatttttataaattcctgctctatatactgttataacagtgaatactgttataacaagattctaatttatttttagaatgtgctaattaatatatttcagaatattcacaaataggtcaaaatatttagtaagtcattgaaattttcacattggtagttacatttaggccatcttttaatgaagctatgtgcatccttaataattatgtctaactagtaatataacgctcaaacactcatcagtgttttcctcatgaccccacccaaaatggacttggatgaattttcagaatgagaaataataaaattaggggagtttattgtaatctatttccctccctctcttcttttcatgggatggggtggtggtagaaataatttaaacataattattttatttctgcactggctaaaccaaatatatatatgtatgtataaaatatatgtatttttagaaactgggtcttgctctgtcacccaggctggagtacagtggcacaaccatttctcactgcagcccaaactcaagcacaagtggtccttcagcctcagcttcccaaagggctgagattccaggcatgagccactgcatctggccccattaaaaatactgattcatttacatagaaattaaaagagaacactaaggagtgtgttcactatgtgccagacatttctaagagctttgatatgctgtttcactgaagactcacaacaatcccctctgcccattttctagacttaaaaaaaaaggggggggtcgccacgtgtggtggctcacgtcagtaatcccagcactttgggaggccgaggcgggtggatcacgaggtcaggagattgagaccatcctggccaacatgctgaaaccccatctctactaaaaatacaaaaaattagccaggtatggtggcgggcgactgtagtcccagctactcaggaggctgaggcaggagaatcgcctgaacccaggaggcggaggttgcagtgagccaagatcacgccaccacactccagcctggacaacagagcaagactctgtctcaaaaaaaacaaaaaaagaaaacctaagatcagttaagaaaatgaacagacaagccacagactcagagaaaatactagcaaaacataacatgacaaaggactagtatacaaggtacatgaaaagtcctacattttaaaatcatagagacagaaagtagaatggtggttgccaggggctgcaaggaggacaaatggggaaatattgtctatagactttcagttttataaaatgaaaagagttacagagaaggatggtggggatggttgtgcaatattatgaatgtatgtagcactgctgaactgcacacttaaaaatggttaagatggtaaattttatgatggtaagtgtgtgttctaccacaatttaaaaaaaattgggaagaaaaagcgtacgattttacaatacatattgtacaaaaaggtttaagcagattttcaaaaaaggagacctactaacattcaatatgcacatggaagaataaacaacataaacaatgattattagttggtacccagagaagtgaacataaaaaccaccacgattcaaccacatacccacctagtcaaaaggctaaaacaaaacaatgacaacatcaaatgttggatagaatgcagagcaaccagaactctcatacattactggaggaaatataaaatcacacaactgtaaaggatcaaagggtagatacaaatttcatttaacatgaaagtcccagcccatgttcacaaaaatgcttgccaaagaatgttcccagtcatctcaataatagtaaaaaacaaaacaaaacaaaacaaaacaaaacaaaacagtccagatgttcatcaacagaaaaatggataaatacactacgatatatttatataacagaatactactcaacaagaaaactactgaaatctcaaaaacatgagaaaagaaacttcacataaaaatacgcactacataatctgtttataagaaattctaaaacatgcaaaactaaactacggtgggaaaaacacaggagcaatggttgcttggggcaatgactgggggcaaggattgactgggaagggtcagtgggaaacttcctggggtgatggtcatattctacattccagaggcattcagattattctggtgtatgtatctgtgaaaactcaataaatgtatacttaatatttatatatttaactgtgtataaatcaaaacaaaaaccataattgaatactgaattctaggttaacgatacttatgttgaagtgtgctgacacttgaaacttactttgaaatgtatgaaaatttaagatggattaatggctaaagggatggagagataaaaacagttatgtgataaaggaagcataacaaacgttaatggtagaatctaagtggtgggtatgctggtgttcattataaaattctttcaacactgcagtacatctgaagtttcataatacaatgtcgtagaaaaaataaaattttgaggcacagagaaataatttccccacagttaaagttaagccattgatcagagtgatcacactcagccatgaagcttgttgacgccagtttaagtctccacatagtggcctttaccttcttatatactattagcagaacagtgagaatgacattttttgcaacctggatctgaactctgtcatccctttgcacttaactttctctggcttctcagtgtcttcacaatcaaggtcagatgactgaaaagggcatctcaagccatcccttactgtctcatctctcaccctgccctccagtcacactggctttttatcagctcctcgaatctccaagctcccttctacaaggggcctttgtatcaaatccaagtgtggaaaggcaattaagcatcataacaattcaatgacttaggattccaacagtattgctaaagggacctgctatataaaccaggaccagattctggatgcattataacaattattcttacattactggggtcacaagaaggtaaaggaaaatggggcagagggacgaaataagaacaaatacaagctaagatcctagtagaagccatgggctgtaagatacaggaacagaggacatgtatgctctcagctggctgaggactgaccacttctccttacttccgccaagtgagagagcttatcttgagattcatgtagtaaggcggtgtcttcaaaatctactcaaagggtctccatttggtagtaacttgtttccaagcaaacaaatacaaacctttagaggaaagaatccccaaactaggtaggccctcaagatttccacatgtgaagttcaacaaaacaagagttcagaactcacacacaaggaaaaaagtcactgtgaaagccaccaacaacaaacgtgaagagcccaaggacttcagatgctataattcacattcagaatagagacattcattacatatgaaatggtaaaagaaatattaataaaaggcagatagattagcaaataataagggccatacaaagtggcctggcaatttaaaaaactttttttaaatcataagcaaaaaaatcaacaaatgcaccaaacataaaactggtcacggttgaggagagctggtaatctgccagactagactgacctgaattatgtatcctttagaaagacaagaaattaaaaacatgaaaaacaagctaacacatatggagagactgaggagttctaacatagatctaacccaaaatcccagaagaaataacaaaaaactaagaaaaggtcatatcagaatagacaacaactaagagatttccagaaatgatgaaaacgacatgaccccctagaggtacatgtagcatgacacagatcaagcaagggcagaaaaaaaaaaagaaagaaagaaagaaaaaaagaaaatccacgactcgtttgtaatgaagctgtaaaaaccaaagagaaaaaaggatcttcaagccatccagacagaaaagacaggtcacctacacagaaagaaaaaatgagagctgagttctcaacagcaaataaacaattaaagacagtaggaaataaccatcaaaatactgacagaaaatgcctaccctgatttgtgtacccagcaatactatttttcaagcaggagaaaaaaagaacattagaaaaatggatctaaataacacaattaaaaatcttgaaataatggctatttattgagcctgtgccaaacaattacagaagacacattccactcaagcaaaactggaaccttaacaatatctaaatatgtgcaaggtgatgaaacaagtccatacggaacttaaacaattagtatcaaatgagccacagtctcttgactacaatgcaaaattattttcaaaatgagccaaaagagataaattattaaatccacggatgatcacttttccatttataccaacaaggtatactgaatgtcctgaccaaccacctagctgaaagcaactaaaaccgctgaacaaattatttttttaaaatcttcttgaatgcttacgtgagctgggaaacaaaacaaaacagaaaatactcaagctaatgacaggaatagagaagtctatgggagaacttaaggtcagcttttaccttaagggtagaactgaagaataaaaacatgttgtaaagcatgacaactggcaaacaaaagcaagcatgggaatgataaatacaaaattcaggataatggtacactgagtggagtgaaagggcagtgtgtacagtgaggtgggccacaggaacatgggacagggaagtatcaggatgttcttttcatctgagcagtagggtcatgggtattcattttatcatcaattatcacaccttataaaagaataaacatatatcagatattatagaatctacagaattaaaaattatcaatgtcatcaaattctgagccccataaaaatcactgatttagcctagaattcagtggaagtatgttatgtatatatgtatccatcttaaatgtttgcatcaaatattaaagactttaaaggttagagaatgcgtatcatcaaattctgaggccattataaagtgactaatttatctcacacttcagtgaaggttctcacacacaatacttacgtaacgtttcagctgcattctcagataaatatacgctggctatagaaagctgatgaggacaattactgatttatctgtgccccccctcccgcccacccccgacatgtgtgtttaaatagcagaaacctctggattccaaactgattttgcaactttggaattaaaccctttcccaagttgggtgctgcctgtgcaggacaatatatggatcacttataacagttctggaattgcgaagcatgtagcagggcagattctgcattgagactttaccaggagaagtcaaatatataattacttaccaaaccagcaataaaaactcatagtatattcaaaactttcttgccagatcaggctaaaatttaaaaatatgcatttttttcccacataaacgaaaattatacaggttttatacatggcctgttttaaacaacagcatttaatgctgttaataccttccacatccatgaacagttgtacctccctgttaatgagggatacataaatttgaaactcagtacaactaacctgttgaaagacatctgcaacgcctctaatttctttcttgttactgtaatatgcttataagcacccttgtacatgtatgcatacatgtgtaaatcttatttcttttgaataaattcataaaagtagaattattaggtccaatcatagggaactgccaacgtttcaactgttttttacttacggtaaagatggcagtcaacagggtcacccaacaaactggaggacgtgaacatactcaaggcttttggtatactggccaattcatgcattttgacaaatcatagtattttgtttttgttgagacagggccttgctctgtcgcccaggctggagtgcagtggcatgatcttggctcactgcaacctttgcctcctggattcaagctattctcctgccccagctcctcagtagctgggatacaggtgtgtaccaccatgctctgctaatctttttatttttagtagagacggagttttgccatgttggccaaggctggtctcgaactcctgacctcaggtgatccacccgcctcggcctcccaaagtgctgggatcacaggcgttagccaccgcacccagacaatcatagtattttctttcttcctcccttccctttttatgactttggtaccacctttaacttcctccaattaccattacttgagcctgaaatactagcacggaaaaacaacgacattgccaatcaccaatgggaaaggaatgtgaccatgactatactttcttttaaaatgtatgtacttgataaactattacaaaaggatacacaaaatgaaagtgattattagaatagagataatttaagtaatgttttagaattattttttgaactttctaaaagtgtgccatgccaagcatggtggctcatgcctatactcccagcactttgggaggccagggcggaaggactgcttcaggacaggaatttgagaccagcttgggtgggtaacatagcaagacccccatctctacaaaagactttttaaaaattagcgaggcatcatggcacgcacctgtagtcccaactactcaggaggctgaggcagggcgattgcttgagcccagaagttcaaggctgcagtgaggtataatcatgccactacactccagactgggcaacagagcaagaccctgtctctataaaaataaaataaaatttttaaaaatattaaaatgtaccatataatttaacagatttttaaaaattaaaaagacaagaagagaaactgtagaaatgaatgacagcaaagagtggggtggaggagctgaaaggctctacagagtgcacataggaaggaaaaggcaagctatgtaccatcccataatgtgcagctcacacttgtatggtgatatgcaaatggcaaatgctgaatcctctaagtctgttactgtctacagactgaaattcaaaatatcactgggcaattatatggcagacaattttatctcatataatgaacttaacagtcctatacaatagttattccatatctatattttagtatatgaaacaattaagcacaaagagactcagaggtacctaaaatcacagagctattatatacagaacaagcacacgactgtattcactgcatattcctttaagcgaaatttcattaacacttaactatacttagtgaatgccttgatcagaattttttttagaccactctgactggatggcagtatcagggatagactgaatttttaataggttcattacatttagctttctcttgggttttataaagaccgctgaactgaattctatagactaccataaaatatatcctattagtaaaagaaaatctgggatacattggtatgtgcagtactcactttatcatataggaaagtcttccaacaaagaaaaagtaggacaacctagtaacagtgtgaactaggaacaaaaaagttgcagacttttaggttagcctagaaattataaaaaggagtcacttaagcctgtattatgcattctggaaatcaatgttactaaagtacccatgtatttcctcggtgggtagaattttttttcaaagaagtaatacaagtagtgacacagatcacataccaagagaaaaatgctaaataaacatgagttatttaaactctcttgttatctccttcgccaaaatatgaagttcaacagattcctaaaggatgagatgtaataatacatgagaaccagtctgtaagatgaaaattatttttgcaatgagtaggcttccaataagctcagctggaatctaaaaacgccttcttaatctttccattttaccaacttaactccctttcatattcaactctgtattatcgtaaaccctcaaaacttgtcaccaatcccttacctcaaggttccccaaaccctgggccatggatcagtaccagttagtagcctattaggaaccaggccacacagcaggaggtgagctgtgggcaagcgagcattaccgcctgagctctgcctcctgtcagataagcagtggcataagattttcataggagcgcaaaccctgttgtgaggtgcacgtgtgagggatctaggttgcgcattccttatgagaacctaaggcctgatgatctgaggtcaaacagtttcatcccgaaatcattcccccacaccccaccctgccacaccctgtggccctggtctgtagaaaaactgtcctcctcaaaaccagtcgctggtgccaaaaaggtgttaggtaaagcagcaggccccaacctatctcctatgtgactacttcttcacagacaagatgaaaacagacacacccccgccaacagctggaaacttccttagcttcctactctctcagcttgaatcttttaaatggtaacatctatcattatctcacatagaaaaatatagaacaacttaccttcttacctccttcttttgaatctaatccaccattgctctttcatggcagtaagtgcctagacttacataataagcctttttcttccttattttcatattctgttttagttcaatctctgggtcctatcaaatccatccactaaatttgcttattataatatactttcacttttatttaatttcttgccagaatgattgaagagcctctaaacatgcttgcaaccttttaaaaattcaatctatccctgatactgccatctaatcagagtggtctcaaaaaaaaaaattctggttacggcatttgctaactaacgtttttaaatggctcccaatatctgcaggagaaaacctaaacccctgtttacataatgtttgtggtccctctctcaccaaaatgttatgaactattttagctaagactgcaccacattttctctctcccctccgtgttcttgtctagaaaacacaactcttccttttctacaaagttgaagactcctcaaatgatgcttttcagtggagccatctcaataccaaatctatactgggtcagcagactcttctatgcacagtcacgtcatttgtgcttactaacagcaaaggctcaaacacaaagcaactgatgacaggaatcctccactagacagaagaatttaaaggtgtggattatgcgatttatttctgcattcccggtccagaatagttagttaataaatatttttattaaagcaaaaaaaattaccaagtacatttaatgacaaaattatatgtacaaatgtctttctgatgtttattagcatttttggcattttaccttacatgtatttattgtctatctaatgccttacggggtaaaaagcaaagcagatcaattttatatgggtatagttggctctgcaacaatctctacctatgacaaattcattgctattcaggcataataattgtatttaaattaaagctcaagaaatgattgtagacctactgtctccatataatagaagttatcttttaagatttgctcaagtatacaaaagctcacaaagaacaaaaaaattaataatttcttattggttaaaagattcttattgccattcagcaacaaatttctattcctccaaacgtgagctttaatcaaatttgaaaataaaaatatgcaataaataggattcaaagaaacaaacaaaaaagtatatgaaagcagtctctaatacctgttgatagaagaaattcaaagttggcttatcttcagtaaactggtttagaaatccttttggcaaataacgaattctcaattcatatctaaaaataattcacaaaacagaacaattagaaatcagtcattttctcaatttacagtctacaattataatattgtgagtatagcattcctaattactctgaaagatgatttcaaataaaagctatcatcaattaatctttaaatgtaatttttaaacattttagcacaaaaaaagagcacatatcataaatgtgctacagctcagtgattcaaggaaacagagcatagtaagaggcccagaagtccttccaacccatgggtcattctccaccactgctcaggggaagaactgccctgacttctaacatcttccacgacttcccacgtctaaatttttatcagtggaactgcacagtatgtactcttacttgttcagaaagctaagctttaagaatggataaaacaaaccaacatcaccagaatgctctttatctttctcattctctctttatgtgtatgtgtggctctacccatatgaacacttttataaatgtcttctggtaaacgtatgtacacatttcggttgcatatatacctaggagcactggataacaaatacatccattagctttagtagatattatcaaacagcatgccaaagaggttgtaacaagtcaaactcccaccaacagcatgggggtgttccagttcctctatatctttgcctccacttggcattttctaacttttttgttttactcactctgattggcatactgtgatagtgcatggtgattttaattggcatttctttggtaagtaatgaaagtgaatactttcacatgctttttggtcattttgactatcctcttttgtgaagtgcttgttgagttttttattttttgtagagagagggtctcactatgctgcccaggctggtcttgaactcctggtctcaagggatccttccaccttggcctcccaaagtgctgggattataggcgtgagcctccacccctggccatgttcaagtttttgtccttgttttccgactaaatggtctagcttttctccttcaccacctattgatttgtaggtgttctttatatattctagatttgaggcctttgttagacatagtgaatatcctcttccattctgtggcttaatggtatttttttttaaccactcaataaaatttcaatgcaatcttttgaggaagcaaagtttggtacacatacgcaagttctgctaagacttataaatgtccatcttattaaaatacaaaattgccaaacaattcggtttcatttcacttttactctcagacagagttcaataacttactgtagatattctacattgggttattatgtaagtataacagatttcatttattttcaacttaggatttaccaggcacgtaactactttatgtgaactatttctctctctttttttgagacagggtctggctttgttgcccaggctgcagtgcagtggcacaatctcggctcactgcaacctccgcctccccgggctcaagcgatcctcccacctcagcctctcaagtagctggggctacagacacctgccaccatggctggctaacttttgtatttttagtagggctggggttttgccatgttgcccagtctggtctcgaactcctgagtcagttcaacaaatccgcctgccttggcctcccgaagtgctgagattacaggcgtgtgagccaccacatctggcctgggcactatttctcttaatcaatttaataatcagaggagaaaggtataattattcgcattctgcagactaaaaaaaaatgctcagcaaaaagttatcagttccagtcaacgattcaaacaggtccaaggaggcttttggtattaatgggactcccattttatttatttatttttttggttgggggaagctcccatattaaagataaggaaaaaggttcaacatgaaacaatgggcagcctggctccacatccattctcttaacatccagcattctgatgctgctggtgatcatcaactaacattttctgtccatttagtgtatgacaggaattgtgacgagcattttacacagatgatttctttttagagaagcataaggaacatgggctctagataaagatcacctatgcctgaatttgggccatgccacttattcactgtcagctatcacttctctgtgcctcaatttccttataaggatgttacaagaaataaatgagtcagtaaacacaaaacacccagaacagtcactggcatatcataataaatggtttctaaggtttattgttagtgataactcgataactgtttattccagcacagatcatgtctcaggtacagttggagtggttggaaattcaacagtgaataacaggcaaagtgctaactcccaaaaagtttgcatttttgtggcagaagtcagacagcaaatacacaaatatatgtgagatggcagtcaatgtcataaaaacaaatcaaaggggaataacaaatgattaagtattatttttataaagggtagtcaatgatggacactctgatatgatgatatctgaacaaagatctaaataaaggagatgaggaagggagttatacagttatatgcagagaaaaagtgttctagtcaggtggaacagactatgaaaaggccctgcagctggaggatgcttgggaaggcaagtgtagctggggcaggctgcatgagggcagtgagtagaaatgaagcttcacacagacccttaccaagtcatgatagtcgggttctttctcaatgagaaagcaagtcaatggcatgctgtgcacagagaaatgacatcacagggttttcatttttcatgattagggtatacaccatgcagaagagacaatggggaccaaaggaagaaggagggagactaggaggagacagcaagattctgggtgagaaataatagccaggttaatattcaccttatgttcacagattggcaagagaattttagggaattacataatcttccctagatcccacagctatttagaggtaggcatgggattcctctccagcaagaacatgcatgaatatttaaaggcacaatgatacgaagaaaaggcacctatgtcttaaaaacagaaaagaacttaactcaagcctgcttatgtgaagttagacaaggcctttagatcatgttaagaattttggtgggagctaaacaatgagaacacatccacataaagcaggaattaagacactggggactaacaagagtggtggatgggaggagggagaggatcagaaaaatacctggttgatgaaataatctgtaaaccaaacccctgtgacacgtagtttacctatgtaacaaatctgcccatgtacccttgaacctaaaacgaaagttaaaaagaactttgttccctgcttcaacacactacagtctagcatatttcacacaaaactctactgaaactttcctcagtccttaaactgcaatgcctgacaccatgttctcgtgccccactagagctgacatccccactctgctcttacacgaaactcgtcagtttctttacatgtctgtttgccattttaagagtctagttgcatcctgatacatatttccacttccctgctatacgcctctccatggattcccaacagcagctaaatactatgccccaaataaaatcattctttcgttcctactcttaggcaatatattcctattcatgccattgtcatccagcttcctcagtcttaccaccaaatatgagcactaagacacccaaaagtaaccaactgaggataaggagggagagggtatgtttttgaaaagctgagctagattaagaatatgatagtcctgatactgagaagggttagctagctagtccgtgtttagtgaagtaaacaaagcattaacttcacacaacacagatgccctcataaaaaaaatgtggtgtgaacagtctgttcttacaatagacttccaatttttttaaaaaagggaagaatggaaatagaaatttatcatttagcaaaaattacagtaataatcactgcaagacagaatcatcaatgaatgctaagatcagtgggtgaaagtgagaaacagaatgttgcagtatctatgtatcttcccagaagatatttcttaattataaaggggaaacagtaaccttgtagtggagaaacctggcttccattaccttaaccaaatgatccaagttagaaccacctgtaaattaagttgtgccatcattatggacttcctgatacaatgcaatgagaaaggtatgacatcttgactgcagccgttttgccaaaaacgcaaaaccttaatcataaaaacaataccaaactcaaattgaagaacacaatacaaataaccagtgagtattcttcaaaaatgtaaaggtcataatgacacagattaaggaactgtctcagattagagaagacttaaggagacatgaccgtaatgtggtattctgaattgatcctcaaccagaaaaggaacggtaagtggaataattgggaaatgtgaataagtcatatagatttgttactaggactgtatcaatgttaatctcctggttttactagctatattatttaagattttaatatttagggaaactggctgaagggtacacaggatttctgtgtactattttgcaacttttgatattatattgagaatttttaaattcccacatatacaagactgacccttttgtagctgtggtgacaaacacccgcccccgcccccccaacccatacacacacaaaaccagttttaaatcagcttggtcaataaatatgagttgtacagccacagacccacttgaaactaattttaaagcgcctgatatcttgcctcaatgaacacgcatctgcaagtcaactaactgactggcagcttcttctttaatttagccaaacaggaactaactctaaagaacatgcttctaaagatgaacagtctaacttgggtaaccatacatctaaaattgatgccaacccatttccacctctgaaagttggccagcttctcaacttcatacttccaaaaaccttgtatagaatcagtagtgtgttctgctcagggagactgtgactgatcagcacagctttcccttaacagcatcataaagccacttttttctgattcagataatgaatgatcacgatgtcagacttggacaatacataagtagtaaaaccttttttttttaagcaaaaaaatgattatgacaaaagtcaggatatcagttacctccggaagcaaagaatagagaatgaaattgggaatgggcacacctctaatttaatgggctacaattcatcaattcatacacaaagacaataaatatgttgctgataggaaacacataaacaaagaaagaggggcactaggtactggtaacagaaagaatagatgaagatattataatcatgaacttatatgtacttaacaacatagccttaaaatcataaagaatcacaagacagaattactaaaaaaaaaaagtaaatcgacaattacagttgaatactttctttgagatgagcatgtagcaaaacatatatgtgtataatatatacaattaaatacattaaatgtcacttttcaagcaaagtatgaacaatataatcttcaaataacatgacgataagcttgaaaaaatgtacacaaacacacccgccctctttataataacagaacataccttcttttcaaaaggaatgaaaacatcaactaagtactaaggcacaaagaatcatctcaacatagttaaaaaaagtcaacaccataaaattgttatgcttcctataatgcaacaaaataaaatcaataaccaataatcttttcttttataagcacatatggcagaaacctaaacaatacacttaatcaccccttggtttcttccaaaaatcttgaaacaaatatcaaaacactgattgataataaaacactatctaacaaagttgtgagacatagacacaactaaaatgaccatttatagtaaaatacatttatcagtaaacatgaatgaatgaaaacaagtgagctaagtgctcaatttagaaataagtggtaaacagaaataataaaatataacccacataatagcaatatattatagagtaagaattaacttagtaaagatgacacaaaggctttgcagagaagacatcagaaggcatcaaagacaatggacacagatgtcacggacaaaatccagatgaggggaaacctgtaggacaagcaacacagcttccttaacaaactgcaagcaaaggggagaaactggatataaagatgttatagattacaaagacttaaaagacaaagggcacacctaatttggatcctaattcaaataatttatctttaaaaattttgtcatgatatttaataaacaagttaaaatttgaatactaatgggatagtttatgaaattaagaataatttttggagatttttaacaacttttggttatattttagagcagtagttctgaaccttgggagattctgcccccttcctgtttcccctaggggacaactggcagtaactggacacatttttgcctgttacaactgaagagggtggggtggtgggctcctatcatttagtgggtagaagccatacaacatatacaaaagctccctacaacaaagaattatttggccaaaatgttaatcctgattaaaattaaaaacaacaaagaaaagcatgctgtcatgttatggacagaccattttgaagtctaaactatttccatcaatttataactttgtcaccaaaaaggagtggatgcactgctcataaaaaatctgaaaacaaaattttctaacatttcaaaatttctccactaaataaaaaaatctgatgttaaaatatgaaaatatatttcaaaatcaattatactgaaaggaatgatcatggaatatggaaatttattgaccaaatttcaacaaatgtttacataattggtgactggcaatgaaaaatcagtatcatcattaagcacacaaagatactggtaccccttctatttaattatgcatatctttgtcaagaatacttttagctatgacaaccattaaaagcaataacaaaataaaacctgaaataagacctttgaatcagaagtggggcatggtggctcatgcctgtaatctcagtactttaggagacaaaggcaggaggactgcttcagcccaggagcttgagatcagcctgggtaacatatcaagaccttgtctctactaaaataaaataaaatcagccaaccgtgatggcatgcgcctatgatcccagtacacaatgagaccttgtctgtacaaacaaattattttaaaaattagttgagtgtgatggcaaacacctctagtcctaggtaactgggaggctaagaaaggaggactacttgaacccaggagtttaaggctacagcgagctatgatcataccactgcactccagcctgtttaacaaggcaagaccttgtctcaaaacaactatttaaccaagattttctttaaaaaaataaaccatactaggccaggcacagtggctcacacctataatcccagcactttgggaggccaaggtgggcagatcatgaggtcaggagatcaagaccatcctggccaacatggtgaaaccctgtctctactaaaatacaaaaaattagccaggtgttgtggcgtaaggatgtagtcccagctactcagtgacactatctcagctcactgcaacctccacctcccaggttcaagcgattctccagcctcagcccctcaagtagctgggattacacgtgtgcaccaccatgcctggctaatttttgtacttttggtagcgacggggtttcaccatgttggccaggctggtcttgaactcacagtctcaagtgatccacctgcctcagcctcccaaagtgctgggattacaggtgtgagccaccacgcctggcccgctgcatgcttttaaattttctacttttatgtatactttatagcctacattatacaatcaatatgttgaccataagtgaataaatacaaaattgattaaacatttttgcctgactcaagctcctaacaaatactacctacttaactgggctctcccagcatcctagaaacaggtaagctcccacctgcccctggactgactggggaagcgctggggacaggctggggtgcacatgcacacttcaggagtgattttcaaactcagcctcagaccctaatggtcaacagaagttcccctggagcctgtggggattgggaagagctggtggctacccctgccacggctctgggccttccagtgacttctgaaggaatttaccattcccttatttacatgttccatatggtcttaacatgtgttcccaacaatctcgttaggttttttcactttttactttataaaaagtgtcatgctgtatgtcatattccaggacttttttaattgaggtaaaattaacataaaatattaaccattttaaggtgtgaaattcagtagtatttagcgtactcacaaagttgtgctaggacttactttgtcacatgatgttatacagctaagtttcattcatattgttacttgtacctgtagttcattcatttcaacttgtgtgacattctactgtgtgaataatccccaagtgacttgtcactgcttatgccatgaacattattgcagttatagcctagtatagaaactagagctagagtctctgaaagagagaacttgaaagggaactgcaggatggtagggcatgtaatcacttgacattcaagagaatgccaagctggtttcccaggtggtttcaccaatttattaaaacattctccctagcagtgcaggtaaaagactgtcaggtccacagcctctccagctacagagagtgtcagacagctgactttttgccaactggaggtagagtttcactaaggtatcgatttgcatttccctgatcaataatgaagttgacagtgccttctatgttaattggccaaacttattttctcttttatgataacatcttcatgtctcttgtgtatctattactgaagtgtctgcaattttttttttttctgtttttgagacggagtctcgctctgtcgcctaggctggagtggagtggcacgatctcggctcactgcaacctctacctcccaggttcaagcgattctcctgcttcagcttccccagtagctgggattacagacgtccgccatgacgcctggtaatttttgtatttttagtagaggcgggggtttcaccacgttagtcaggctggtctcgaactcttgacctcaggtgattcgcccaccttggcctccaaaagtgctgggattacaggcatgagccacagtgcccagtcagcaatttttatattgatcagaactcttaccaccaccctttgttgactgcatgtgttacaaatatcttctcccactttgcaacttgttcttgtactttcaaaatatatcttttgcggaatgtcctaatcttagtacagtagaatttgccagcctttctttttatagtgaacgttttggagctcttaagaaaatcttcctatcccagggccagagatacattcaactatacttcccactaaacttatttttttacagttttgcatgtgatgtttcactacttgtacatctcatagatttgtgtattgaggtagtatccaatgttgttgttgctcttcttcctacatggatagccatttatcaatccagctcttcctttctcccagtgacatgtcatgacaaagagctctctaaggtcatcctgcctgagacagttatgaccaaatacgtgtgctgcaagctagcttaccaagctgtttgaagagtgaagaccaagtgaacaagtctgtatttcaggtttattcaacagtatgaatagactctatagcagatagcacaaaagaacaagctatgtccaaaaacgtcatggaaatcaaaatttatacccaattatattgctgagtcctagcactttcatttgactagagatcttacttctcagaattaaagccagaactgcagctgccctcacatacccacctatgaacttagatgtctgcaggtgacagaaaaaaatttgtcatgttcagcttcttgtatttacatatctaatacaggagtagagaagaaacagctgagtgtttggattcaatttctagtataccacccatttaagccatatgatctccaggaaaagttattaagcctttccaaagtatggctttctcacaagcaaaatggcaaaaagagagtacctacatgataagactatcataatagaaattaattttgatgaactacatcaaatgtctgacacacagtaaacaacatgtgttaatatggtaatactgttattaacttaagctaatattgtttggttcctagctgaaaacaagtttctaaaccatcaaattactttgcttctgggcttcttttacacatgcattatcaatatattatttagtcagttttcattcaaatattgcttattgggtgcctattgtataccaggcatgactagaaccaggaatagaggagtgaagaaaacaaagtccctgagaaagataaacaacacatatataatatcagtcttcagaggtctgtaaaaaattaacagagtatatgagctgatgaaaaatcacaaggagcttcaggtaggcagtgggctctttaggtagccagtaggagaccacaggaaagcagtaacattcaagcacattcctggaatgaggaggtccaagccatgcctagaaaaggcagaacatactcagcagagtcacaccaagttcaaaggccccaataagaaagccagggagctagagttgagaaagtgaaaagttgtaaacgataaaggaaaaaagggaggtgagacaaagaaagcgttaattaagatgaagggccatattattcaacaattaaaaagtctggcaatagagaagaaaccatcacatcagatcccaacttgagtatttatggaaagaactctaaaatatattaaagaatttaatggaaggaaaactgaaatcaaaaggactgatgtcaccagagtggaggaggaagaggaagagcagaaggagataaggactgtgaggtcatcagaaactccagagtttgctctgagtgtgatgagaagctactggaagtttctgagcccaaatgatttataaatataattggatggcttacattctaagagatacatcagcaaatcccatcagctccctccttaaaaatacaatcctgtacaactgtttctcacaacttctattattattcccctactgcaccatcttttaggatttttgcctgggttattccactaatttgtttctcagtttccctgcctccatccaatcaaatgtatgatttaatgcccaaggcaggtgtagggagactagaaagagaagaaaacaggttactggagcaccctaacatttaaaggccaaacagttcagaaaggctatgaatggtcaatgaaggaaaaccaaagcagtttggtatccagaaagctaagtaaggaatatttattaaattcttggtgataatagcttgtattgtaattgccttctatatccctaatgatgctttaaaagatgtttaaaatttttttcatacgatattaacagggtataatccttttccccttggttactatttgtctgatatactttgttccctttctgcttatgttttatgtgtgcgttcttcaaattaaaaatcagttactatcttgtttcatggggccaatgcatatttagatctacccaattttttccatcttgcatccgagaccctccccttcagagatgattttcgtttttcctaaggtgtttttgtaagaggttcctttggtggcaaatcctctaaggaaaatgtctttatctcaccctgttcttgaatggcaatttaactgggcaaacaaaaacaggttgccagctactttcctcactactttgaacatattatcccactattttcttggcatctattattgttgttgaaaagtctgaatttttctctgggtgtcatcctgtcttgttctctggtacaacaatattttactattaatacaatctgccaatgcatcagtttagttttattgactctatttgggattttgttaatcctgtatttgaaggctcatgtcattcattgattataaaatattctcaaccattatctcttgggattatctcctcctcttctccattcttttttattctattcttcttgagtttctgttagaaatgggttgacatcattcttcatgttacatagacttgcattcacattttccatcttttcatctctccgtggtatgttctggaaaattttttctcttgtttactaatttttcagctatgtctaatctgctattttatcaatcctgtgatttctacaacttctatttggactatccaaattctcttggttatttttgatagtctccttttccttactgacacttaaattcctccccttttaaatatacagaaccatcagtattaaccctcataactcttgaaaatacctcatcagtttatctgtcacattttcttctgtcatcatctctacctactatgcatgtaactttcactaatcctttttttttttttttttttttttttgagacagagtcttactctgtcacccaggctgcagtgcaatggcatgatctcggctcactgcaacctccgcctcccaggttcaagcaattctcctgcctcagcctccaatgtagctgggagtacaggcacccgccaccacgcctggctaatttttgtatttttagtagagacagggtttcactcatgttggccagcctggtctcgaactcctgaactcaagtgatttgcctgcctcagcctctcaaagtgctgggattgcagatgtgggccaccacacctagccaactttcactaatcttaaaagcctagctacattttcagagtatttaagacaacattattcccatattgagataggcaatctaatttttaaaacctgtactatgaagccagacagctaagttcgaatcaaagctgtgtcacaaactatgtaactacaagtttatcaattttgttttcatgtgtaaaataagaacgatagtctctaactcctagggtttggggacagttaaatgaaatgtatatttaagttatctggtgtaagcagcatacagatggcagagtccctggctcagccacttatgacgacaaggcatcaatgtcatcatcatcatcatcattagtattattatgagcagtagtatcccgatcaccctttcatctagtagggtcaatctgtgagaaattctatataaccccacctaaatttttcttccttttgaggattcaagacccagtcagtaaagcagtgcctattcaattttacttgaaacaaagtaaataaattggcttaaaagaacaacaacaatctactaagagatttagattcaatgaccattttattgagcactaaggatttcattataacaaagtctgcatctgacatgtccatataaaccaagataatagacttgtgttaaataaaagtaccttgacacaggaggatcacctgagtaggggagttcaagaccagcccaagcaacacagcaagatgaccatctcaaaaaacaaaacaacacaaaaaccctgcaggtatttttatctaacttttacatatcctttgttttggaatgctcacttgcttaattgactaaatagttggaagtcaaatcttctctagccattgatgtgaaccaatgaaactatattctcaaggagtattttgttagcttggtaccagctacctgacaaatttgaaaatacagctatatttctttgatgaactctgtaactggcgtagggttttattcaacataagatttattcaggctgggcatggtggctcacacctgtaatcccaacactttgggaggccaaggtgggcagactgtttgagcccaggagtttgagatctgtctgggcaacatgctgaaaccccagctctgtaaacaatacaaaaattagctgggcgtggcggtctgtgcctacagtcccagctactcaagaagctgaagtgggagaatcgcttgagcccaagaggctgcagtgagccatgttcatgccaccgtactgcagcctgggtgacagggcgagactctgtctcaaaaaagaaaaaaaaaaaattattcaccttaacatgtttgtcttttaaaatgtctaccctaatcaatctagatccttcaaagttactgaccctttgaatgcactcttcagcctacaattatctttatttctgtagcattgcctataaaaattagaaccctagtgaaagaagcccatttttacaagttatacctctcacaaatgtattttagatgtacaatttcctagtaacatcttgagttgcttagtagtaaaaaaaaaaaaaaaaaattagtaggggagaccagaaaaagaacaattatagggaattcttttaatttgccctgaaataattttattttccttaacatttcaacaggagtcattaagagattacgtcctaattttaacgttgcatgtgaatatcaaatatacactcactctttgtaggtgcgctctagattacagggcataataaaacaagctatgtagcccattaataaggtatttaggagtgacagcaactcctgctacataaaaggatgacaagggatgaaaacattatatatatatacatacacacacacatatatatatgatttgagttttattgggagcaaaggttgaaacaaagtagcactgatgagaaattagctagcaaaagaccatcacagaaaacggaaatcagatggctcaaagtataattaataatacccaaaagctagactagaggtctagaagagatcattcgttaataattactaacgaattttatttataccagagttgtaatgacaagcagtgtgaaaattaaacatatacatttgttatcttgtgcatgtttttaaaaagcaaaagaaatcaagtgtgcatcacaccaaagcaggtttgtatcttacttccactcctctggtgggtgagcaagctcatacttctccctcacactggagacgcccatatccacgtgaagccagtgaacctcctctgaccgcaggtgactgaggcggaatccatagcaggccacatgctttactttgtgactgtccactatcttctgaatgatgccctaaaacataccccccacaagaatgactgttataaactgaaaaaaaaaaaaaaaaaaaaaaaaaccaaaacaaaacaaaaacaaaacaaaaaaaaaactatatgctaaaaagtaatgcaatgttcatttcttttagtcaattatcagaaatctttggtatgagaatatcaagttaaataaattacttaggaatctttgtttctgaaatagtattttcaagaacaaggagaagttttagaaaagaaaacataaagagattctctcctttctttattaacaaggcatgtaaacttaaaaacacatttctgcaattccactgtcatcaccccccaacctgtcaaagcacaccagctatctttcagttactactttctaaggtccagacccaaggaggggttatactttcaaaaacagggagatcatactgttcaagaccaggctgcaacattcataatcatttttttaaaaaaacatacattcaggaacacacagttaaggctacgtttctggtgacactggaaatacatgaaaagttctttgaattcgggcctaatcagtttattattacttgctctttaaaaattattatgaagcaatcttaaatactcccaaatctaatgcctctaacatgtgttcccttgagttcagagaaggtcacctttgaatgaggtcatcagggaatgttccctagagatggtgaaatttctcctggagcaatggacaggttaagtgttagaactgactcttgccctgtacctacctaggtatgagggccatgagagaatatgttgttaagtgggcagcatgtatggaagactcatttgggaacatgacagaaccatttgctgtcctttacacgagggtatgcaaattacaaccaactgtgaccttctcaatcttttaggtgataagacaagtttttttttaaatgatgctgatattaaaatgaaaaatgtctatgaaagaaaataatcactgctttttaaaattagcaattaattgaagctataatacaacttgttaagacatacaaaaaagttcctgcactcatcaagtattgctttattacagcacaatgctgctgatcatgataaaggatattatccccagccttctccataagcaaagataaatcgtaacatgtaccatatacaaaaactgtccaaaacccagtatatgcacactgaggatgtgtgctgctgtgctgtgctccccatactggtacctggcatgtggcagacctcccagggcactgagtgaatgaagtggtagagtcaatctctctttcagacaactcaatcccaggtacaaagttgtttaccaagcacaggaagtggcagagagagggacaaaggaaaggagtaaacatggtatcaagagagaaagcatcaacagaggaccaggctggaagagtcaaagacaggttcataaagatgatgaattctcatcaggacaggaaggatgtttgcagcctacagactcctatgtggaactgacagaggcataaaatgtccttcctggctttttgatccaagcccagaattcctgacagggccactgtaaatgacagtaccctacctacacaaggatatccagctgagggtgaaaagagtccacgttctagtctttaaaccttgtgctctggggtggggaacttgcctaaaggaaggagcaccttttaacaattctctcagaagtgacttctgcagcttcttgccaacacacaaatccatgaactataaaggatggaagctagcacctctgtgaaattcccacaaaagctcctggttccctgtccagctctgccagatcaacacccagtacgcaccaacaccagttatccttggtaaaccacaggtcagtaagtctccttgctccacagctcactgctactaccaattcaagaggcggctctctcttgttagagctgcgatcagtgtctacagtggtctctagccatctgcctcaggtcacttggtctactaaccttccataacctgatgttgaatataaggcagtaaggaacacaaatcatttctcataattgtcaccattcacatcctaagaaaaagcccagcttctccagttgccttctgtagtgaccccatgaaaaagtcacttcatctctgctgaactcacagcacacatataggagacctgcagcaaaccagtctcaaagaggcttagcccagaactgtggtatctgttagggaaaggcaggtttctgtcttggagtttcacgtaagagagagaatcttattccattcacttgatcatgctgcctgaagagactcagagtgacttcaaagtgtggatctgagtgacacagcctttgcatacagtagtacctcatgagcaaaccagctttcaactttcactctccatgaaacagtgaaaagcaataaacacacagatattaccttctgtttcattttttgctttctcattacgcatccatatcgtactctgtcctactgctcattctctagcacccttataaatttctctggatagtggcaaacattataaatatacaaagtgcttaaatatgtggtgctaaatgcatatactcagtaacttaagtaattttgagaactaaatatctggtctggataactcaacaaataattctgagaactacgtatttagtgaggaatgtaaactcaaccaaccctacagtgctgccatatggaagtgccccattttcatatcacacacacgtacatttagaataaaaatgactgtctctaaaaggataataggacatgggtttttaatatgccactaaaggtaccagaattaaatttaaatttctcatcgtgactttgaagacacatctatctggtcctatgaaatacaaaacaataattggctactctgaaacctgtctctcataacccaagtgtcagaaatacacaacttttctgattaaattctcatagtagacattcatggtaaaagaattcttttcaaggttaaaataaaagccagtgttcacatcatgcctgtatcttatcaggaacataacattaaatgtgcaaggtcattttactactgatgaataaagatttccttgttctgagggagaaaggaaggtgtaaataaaaatactgctatgaacatccttctagctgtcatcaaaggtatttatgaccactgcatagaaacagacaaaatttcctttaactgaaacattttgataagcacaaccaaacttcctggccatcaacaaaactataccaattatacttgatgcataatgttacagagtatcatttatctcacattaatgaataaaattaatcttatgatgatcaatttaatgaccaaaaaaacttccacaggtattttactgttgttatgatggtttaatttccctgattactcactagtgagatgaggctatacttttgttcatttctgaaagtttttattattttgcttggttccatttagccacttaccttttagacagtactttcaaacaaatgaccttcaccactgttcgaaataggtcatgtgactctttcctccatgttcattctttcataaactgttcattcatttattcatgaacatctgaagtgcctactacatgcatgatgctagtgacacaataacggttaagatgcaattctgaccctcagaagtcttaaagagtctcacaggagaaagacatgacaatgaacatgtgcaaatgagtattaagtggtttgtggggaggaggggacaaaaagggatattttatatttttagctatagtctcacacttaattttcagatttattactagaagagatatctgaagcaacacacattgttgacactgtttatctccttactgcttcctaagaattaccaaatataatcatcattactgattcttctatagtatagtgtttctttttctcattgtgtttctctttcagatactcttcagctttagaaaaccaagggattcctaccattcttcttggaggctttcatcattgggttatcaaaaagaaagatccagaaattcaaatcctgttctccaacacctagtacgtttcctcctcttggtccagtcataaactaggagtccttctaaaagtcttccaagacaaagaatgtacttttttatcttggtggtccacagtcactgtattagttccctattacctctgtaataaatcaccacaaacttgggagcttaaaacacaacaagtgcattatcttttagttttgtagatcacaagtatgaaatgggtctcactggcctaaaataaagacgtcagcagggatgtgctgttttctggaggctcttagcttgtcttttccagcttctacagggcactgcactccttggctcatggtcgtcttcttccctcaacgttgcatctgatccttctttcatattcacctcccactgaccacggttaagaaaaggcctgctgcagtgaaggactcatgatctccccaccttaaggtctgtagccttcatcacgcctacaagtccctctggccacgtaaggggacatctgcacaggttctggggattaggatgtaggcatctttaggagccaacattctacctatgggaaatcactacctcaatcactatctctcaggattttgaattcaaaattttttcttcctcgtgctctgttagcttaggttctcctctttaacatggcttttatgctttttcttaaagctttcctttctagctttcttcctagatgatactttccatcctgtaaaggaagagtttaattttctaagacctccatagtcctttctagaatcaaaactatttgaatccgtaacaatcaatgttcaattgattgttattaataatcaattgtttttaaatgtttttaaacatacattcacctgctcctctgtcagagagaacagcttacacttctaacacacacaaagtgtccagtgatgacacctaacaataaacactgaagaccgttggactgctctgaaaagtcctccaggcacctacctatggccaaactcagggaaaactccctgaagaattcccttcccctacagataccagttgtttatagcatagtttgttcttgcagaatcccaaatcactgtacattttcccattcctatcagaaggatgattttaaattgaacacaacgttacttcccattaccagtcttcccactaccagcttggtaacagtaattagtattaatccaacccaacacacctatattttaacaaactacatgaactgatttttttccatttactattacagattcagatttaccaaccattccctactgactcatgactagtactgaaacctgaggatatgctatttatttagaaaagttcaatgtaccagtcagaaaaattttaaggggttttgaatgggataagaatactgtccaagtactcaatggtggtgtaatcttaagcagcatcatacagtatttgcccagtacttgcctggtgtatgggcatgaaattatttgttctagtccttgtaatgtctttttaaaaaataagctaggtacagagatatcagtaaagtggggtatggctttgaataggtataatctttggctatcaaatcaatatctttgtggttatttgtcaattaaggctttctacttctgtggtcaatgttcctaacatatttctctcagaaatattccatttcaccttggatgccatatagtcattcaacaaaagtacctatacctactgagcacttggctgtttgcctgctagacactgttaaagacattggcaataataccatgaagtacaaagatccctgatgtcacagaacttaagaagttggggaagaaaacagctaataaatgagcaaacaaatcaagtacaagacgatgtcaataataatgatctgaagaaaataaaatagtgacagaaaaacagcaatggtgaggcataagggagcattcttagactggcatgccctggcaggcagagttagtaagggcagggtgagaacaagcaaggagccacatcccgtaggtccttgtaggccacaaaaggaatctggcttttagtctgggagaaatggggagctcttggggggatttaagcaaatcactgattcggtgattagtatgttagagaaacaggaagcagaaagaaaaagtgagtgactaggacagaggtgacagggcatgatgggacaggatgggggagatgggtgagactctcaaaggacgtgcatgttgactaaatgaaaccgggttctgagtggaggagtgaagtgctctggctttcatctctccaggatcattctggctgctgggttgtcaacagactaaggagagcaagtagggaaacaagatgtcagttaggataccatgccataatgtatggaagagacattttaaggcagctactgaagaagagctcaaagaaaggggtagcagtggaggcaatatgaaatgggtaggttctggatatatttttgaagataatgtggacaggattagctaatgtattcgatatggcttgagagcaaaagaggaataaaagacgattgcaaatggatctgagtaactaaaagatgaggtaaccctttgactggagcactggatggttattttgtagcaagaagtgtaaagacagagaagtgaggtacaaatgttggggaaagggaagatatagaaatgtgtggacttttccaagtactgcaggttgaagaaagtggacgaggtatgaaatggttgtctaggagagaacaagatggggggatagagcatgacagctgggtagcactaaggttgcaaatctagaatgtaaccaatcacaggatggcgacaggtggagaataggcagaaggttggattaaatcatggtggtagattcaagagactacggggacattaagagaggtacaagacagcatacaaggcagcaagtatgacaatggaccactgtctcttgcatcctgctacagtattttcttatgggctcaacttttttccacgctgcattatatcatctaattgttttttcaaagagagcccatgctattagctttctatgtcactacttctctgcagataccttcatttcacattatcttgattaataatttatctgatatagacttctaaagtacatgttattttccctgagccctttgaagatactgttccaatgtcttcttgcatccagcattgctgatgaaaagtctggtgtaaacgtcattctttctcctaagtagggaatttctctggtagaatttggaattttatgtcattatttttctgaattatcactgccatgtttctagatgactggtcttattcaacattgtacagcctgggtttctcttggctgttctagattgaccccacacttatctctagagctgcctgaagcacggtactgacacttggccaaagctatggccaagataagtgatgtttgtgatcatgggaccctgagctgtttggggggcagaatataccagcttgtcagtgcgattttgtaataataactggactgacaaggtgtacctgattttggcagtacctggggaggtccacaggttgaggctggctacgtagatggagagtgcttgtgtgaccctctcacagatccccaccacttcctcatactgaggtgcttcacacataagccagtaatggtttcacatctacagaaaaatcatgtccaaggccaagaagcctgtacccaagatctccagatcacttcaatgagtatcattttactactgttgctgtaatggattttgcctataaactgtgaaatcttgcaaatcttttcaacaatcaaacattaattaacatacaattagcacacataattgtaaaagcactaatacttattaactgaagcatgataaaggctctataatgaaatgttacaaaaatccagatattcttggtgaaaacaaatctttaaactcctcaaaaagttttgttttttctgaaccaagcagtctttctgagaatttgctttctacagaacaccactgtccagcagaaatataatgcaagccacataagtaattttaaaatttctagtagtcacagtaaaaaaataaaataaaaacaaacaggtaaattcaatttcagtaatatagttcagttaacctactatatcaaaagtattatcatttaacatgtaatcataacacattgatatattttattctgttttcttactctttgaaatgtggtatatatttttatactatagcacatgtcaattcagactagccacattcaagtgctcaacaactgcacatggctacgataatgggcaacgtagctataatgagtttaagactgaatcgagttattcagtacctgaataacaataagccgtatcatttcagaaaatagttgtgtggcatcccctttgatgctattcaatggtcagtttctttctgacaagtaattatacttggattctttactaatctaatccttaaatctaaatcctacaatccccacttcctgttctaaggtcatcaggccttcaaatgctgtcatgtttcttccatttttctctttcctgacaatactctgtatccataatgttcctttgtctgatacctcttatgttgttcagtccctttgttcagatgtacaaatccactcattaatttacaattatgatattgcattttcaaatgttatagcattaaagcattcaatggaagttggttatgaataatatccaatcttccattacagtgactcagtatcatgagaacctcatgctatcccaggaaagggctatggtgaattcaatgccaactgtgatttttctgcctcaatctgaaaatcactgactgataatttgccaattactgtgaaataaaacacgttgtttgtggccacatagatttgatcagattgatcttcacaagtttgctaaatgagttctgataacttatacatttgtatctgatgtaaatttttcttcacaatatgaatgtatgactaggaagtttttaacattggctaaaggctaacatgcctgcagtgacactgactctatggtagtaatccccttacatgcagaaagtttgatactaaaaccatggcacatctgttaaaatctttcctaggtgagtcttctgatgtaagtcttgaacatttttgctaaatgtcttgtcaaattcataatctttgaaaggtttccctcctgtatgaatgccctagagttcattagggctgatacaatggttttattggagagtttcctcattcactgtatctgaaatctacaaagactagaacatacactaaaagccttacataaagttacatctacaaggtttttttccagtatgaattatctgataaaccttatggcaggatgctcattgcaggcctttctaccaaatgacagtgttttataaagttaaaagtaaaacacagaagtagaaaaaaaacagaaaacgcaaaaaagctaaccagcttcataaagagtttgtaaaaaaaaagaggctatcatatttttaataattaatccatttgaatagtttgctaatattaaaatttagaggtaacaaaaaattatgtaaaatttatatacaagactttagccttaaatcttttttttcttttttttcttttgagacagtctcactttgttgcccaggctagagtgcagtggcacgatctcagctcactgcaacctctgcctcctgggttcaagtgtttctcctgtctcagcctcctgagtagctgggactataggcatgtgacaccacacctggctaattttgtattttttgtagagatggggtttcgccatgttggccaggctgctctcaaactcctgacctcaagtgacctgcccaccttggcctcccaaagtgctgggattacaggcatggaccaccatgcccgacctgttggccttaaatctaaattctaccaatccctttgctttggttaaaaataataagggcatgtaagttagagagtagcaaattaattaatttacttattgtaaaaaaaaaaaagaaagaaaagaaaagaaaaaagacgtatctaaacttccttgtcactggaaacttctccttaaagatgaatatagactaggtggagagggtaagaaagaggaggtatttaacacttcatcaaagcaaatactgaacatttaaatactgaactcagctttctgaaatcacagtgctaccttttcattccccaccttcagaaagatgtagttacctttgcctagcatgctcttctcccacaattctgtatcactatctttcctcaccttcccagacccaaaggaaatcctttccagtactaacttctacgtttaaaaggtattattcctccaagcttccacaacaacctcccgtgaagcacttctacactgtactataatcacattcatgatgtctctccctctacaggctctaagctgtaagatcaaggacttcacagggaccttttacatcttcagaacctagcacagtgcctgacacacagcatatgttcaagagttttaaaggaaattatcctatctgaagtcatgcaaataccttccaaattacactttctagaaaagtagtttatttcatgactgttagaggctattttagttgcattgttgcctagtactcatccaagagttaaaaaaaaaaaaaacctagaagggaaaaataagtcaatggtattttatgactaaaatatgattcagtcattatttttctaagaaactttacaacaattagaacgctggtcagtcacatattaactaataaatcttataattaaaaatagcatttctgtaatatgaaaagtccccgataagttaaataaaaattattacactatcttttttcatacatgccattacattttaacctaaataaacattaaagatgtctcatggaaaaacgtacttaccctgacatcagtagcatctccatgcctgataatactggcccaggtggttggctcactattgctttcaaaataatgaaagacctttaatactcgctccattgcaccaggagaacgttccataccagtacccaggtgagtcttagtactcgaatttggtgtgtgattcaagttggggtcaaggtaagcagctgccattattttgctagatgctaggtatctgtcatattctgttaaaagaacaaaataattttttgtgtataatacttgaaatctaccaattacaatgtgatatgttgtttatatcaaatgtcctatactctctcttgatatgttatatgcggaaggagtctgaggagaatagagacctaatccactaaaataatagctgtctctccccatacccagagtaggacctgatttacagaataaatatttgttaaaaaaaaattattaaaaggccaggactccaatttcagctgtgtcaaaaagtatctacaaacaatgtaatacccccacccccaccccttttttaatcatagcctttaaatttgttggaaaatctcatagcaaagccaaatttgttaatttgctccctgcttttgaaaacttttacctaagagaaaagttctttcttcatataatacaaattcaatgagtattcattatatatactaggcattggtgattaaaaacactataattaaaataaggtccctggcttaaccaattcattgttaacaggagaatcagacagacagcaactgaaaacaaaacgaaaaaagcatgcacaattaaaatttttaagtgcgataaaggacttctatttgagtttgaagaaatagcctgcacaagcctaaacacccatcgagaaacatgaaaatccagattaaaaatctttttaactcaaacaatgtttgaagggctcagagacaaagatattctgaggcaaccaagacaatgagtgacacagatgaagacaggaaatgatacttaacagctggctgctttttcccacagggcatttgccaattctgagcccttcagagcctgaagagacaagaaaaggctacgaatgggagagaaaccagcagagctttcggcagcaagggatcaaatcttggattctggtgagaaggaagggtggagactgtgtcaaacactctgcaggttgtctcctgaagacagttacggaatcctgaacccaagctgagaaggagcctctcaaaacagtgaaagggtttaggaaacaggaataagacttcaggaataaaccagaatagtgttaggacatccccaggcttgcagtgagaacagctgggtgcagaagcaaagggagctttgtaaacctggagtacaattcctgctcagatccatcgtggcaggccaggtatggctgctcatgcctgtaatcccagcactttggaaggctgaggcgggaagactgcttgagtccaggagtttgagaccagtctgggcaacatgacaagaccttgtctctactaaaaaatacaaaaattagcttgggcgtggtagcgtgttcctgtagtcccagctactcaggaggctaaggtgggaggatagcttgagcccaggaggttgaggctatagtgagctgtgactgcattgctgcacttcagcctggaccacagagtgagactgtctcaaaacaaacaaacgaacaaacacacacacacacaaaaccacagatccagccaggcatagatgctcatgcctataatcccaacactttgggaggctgaggcaggcagattgcttgagcccaaaggttcaagaccagcctagccaacttggcaaaacccatctctacaaaaaaattacaataaagagccaggagtcgtggcgcatgcttgtggtcccagctacttgggaggctgaggggggaggatcacttgagcccaagaggggaaggctacagtgagccgagatcgtgccactgctttccagccagggcgacagagccagaccctgtcaactccccactatctgtccagcaaagaaaagagccaaccctctgttggtatcaaacaaagcataaataatacctttttcatccaaatcattctccaattagttaaaaaaaaaaatggtataacagcacagtaaaaggaaaaaaattataaaccaagtcaaaagatgccaaaaacacaaaagaaaaacatatgtaccatgtatcacagtaaaaagctaataccctatatatatacagaaattcttttaaaatgaggggggaaatgatagaaaagaatgcaagagacaatccagacaattaattaaaaagatataccaagtgtaggcaaggatgtgaagaaactgaaaccttcctacattgctggaagagtataaaatggtgcaactactatgaaaatagtttggcagttcctcaaaaggttaaacatggagttaccacatgaaccaaccattccatttctaggtagacatatgcccaaaagaactgaaaatgtatgtccaaataaaaactcatggctgggcatagtggctcatgcctgtaatcccagcactttgggagactgaggcaggaggactgcttgaggtcaggagttcaagaccagcctgggcaacatggcgaaaccccatctctataaaaattaactgggcatggtggcatgtgcctgtactcccagctacttgggaggccgaggattgcttgagtccaggaggtcgaggctgcagtagctgtgatcatgccattgtactccagcttgggcgacagaaagagaccctgacataaaacaaaatgaaacaccctcacatgtgaatggtcacagcagcattatccacaataccgaaaagtgataataacccaaatatccacatccatcaatggataaacagattaacaaaatgtggtatgcccaacaatgaaatattgttcagcataaaaagaaacgaagcactgatacatgccgcaacatggaggaaccttgagaacattatactacaaggaaaccagacgtgaaagaccacaaattgtgattccacttatatgaaggaatatgcaaatctatacagaagaaagtagattactggctgccagtggctgggggtagggcagagttgggaaggactgctaatagataaggagtttcttttggggatgagagaaatggtctgaatttagatcatggtgatggttgaatatactaaaaaacactcaattgcacactttgaagttgttaaaatggtgaattttatgttatgggaattttacctctgtgaaaatataaatatataaacaactgtcaaataatttttttaaaaaggtcatagcagtaccctgtcatttggtaaggatgtggggaaacagaactctcatacactgctgatgggaatgtgaattttctatagtatgtataaaggggaatttgacaataacaaaactacatgtgtcttctgatccagcaattccacttctaggaatttatgccaaagatatactgttaccaactaaatgtctgtgtgctcccaaaattcataagttgataccatactccccccaatgtgatgctattacaaggtagggtcttttggagggaatctgaactagataaggtcataatggtgaggccctcatgaatgggattagtgcccttgtgaaagtccaagagcatgcttcctctctctgctctccagagatatgcctgaggatctaagtccacagtctgaaaactggaaaaaaagggccctcaccagaactccaccatgctatcactctgatctaggacttccagcctctagaccagtgagaaataagtttctgttgtttataagccacccagtttatgtattttgttacaatcgtcccaagtgaagagatatacttaacaacaacatgaaaatacatatgcataaggttattcactgcagccttacaaagtattaggaaacacctaaatgcccattcatgggagactaatagagtaaactatggtacattcctataatggagtactatgaatctgctgggggaaaaacaaaaggaaagaagaagagccctataattgactaagtatgaattccaggatttattaagttaaaaacccaaagtgcaaatcacggccacagtataccttttgaataaaagggggaaaataggaaaatataaatgtatctgctcatatgtgcaaaataaccccacaaagtagaaatgggagtccattgagactggttacacatgggagaggtgtgaccaagatggaaagtacaggaatggaggatgtggtgtggggtggcacttctgagtatacatgaatacacccttataacttttggtacgctatagaagatctgaagagcacgattaacaaatctgatctaattgacatagaaactgacactatacctaataggataatacataatctttgcaagcacacaagaaatattttctgaagttgcccatacactgagtgaaagagaaagattcaataaatatcaagggactaaaattattcagagtatattctgtgtctagcattaggctagacaacaattacaaaataactagaaaatgttccattgtcaggaaattaagcaatgtatttcaactaaccctttaagtcaaaaagaaactcaaagtattttgaattaaatggtacagtgaaaagaaatatcaaaactgtgaatgtagacagagctatacttagagtaaaatctatacatttggcagggcacagtgaatcacgcctgtaatcccagcacttttggaggctgagatgggaggacagcttgaggccaggagttcaagacctgcctgggcttgtgagacccctacaaaataatttaaaaaaatcagctgggcatggtggtgtgtgcctgtagtcccagctccttgggaggctgaggcaggaggactgcttaagccccagagctcaaggctgcagcaagttatgactgcaccactgcactccagcctgagcaacagagcacaaccctgtctcctttaaaaaaaaaaaaaaattacgtatttaaattcatgtattagaagcgaaggttgagtatctctaagaatacacatctgtgaaggggggatggttaatgcacagaaaaatagaatgcgtaagagctagtatttggtagcacaactaggcattatggtcaataaaaatgtacatttaaaaagaactaagagtataattagaatgtttgtaacaccaaaaaaagataaatgtttgaggtgatggataccccatttagcctgatgtgattattatgcactgtatgcctatatcaaaacgtctcatgtaccccataaatatatatatacctactatgtaccaataaaaatttaattaaaaaagaatgcatatttaaaaggacaacttaaaagcagaacaaaattaaaagttactcttttaaaaaacaaaattgatacacctctctaagactaatcaaagataaaatgagtcaagaaaaactagcaacatcaaaaatgaagaagagaatataataagaggtaagagataatgagtaatacaataagggattattaataactatgccaatgaatttgaaaatttagataagcacaattccttgcaaaacacaacacagcaaaatgaaacaatgtaaaatgaaactagactgttctatttaaaatagtccatctaaaattctccccacaaaggaacattttatttctttcaacaaattaagaaatattaatcttacacaaattcttccagaaaacagatacagatcatttcccaacttgttttatgacacctgcagaacagtgatatcaaaacctgacagaacaggatgagaaacgataaaagtctacctttcttataaacacagatgcaaaaatcttaacaagtataatccagcaatattttaaaggaataatgtatcatgaccaaaagtttattctaggaatagaagaaaggtattcattcaaaaagcaatcagtgtaattcaccacattttcagaaagaagagccagctacctcgatacatgcagaaaacacatatgataaaatttaccaaccattcatgataaaaactcgcagcaaactagaaataggatgagatttcatatatctgacaaagagtatctacatgaaatgtaaatactagtgggaaaaaaacttcccctccccaaactggaaataagacatggatgcccaccattaccacttgcgtacagcattgttctggaagtcactgccaagtaccatagacgcccccccttccccccaaaaaaacggggggggggggtgggtaaaacataaacattgggaaagaacaaacaaaactatcattattcataaactatgtaagtaaaactataattatgcatagattatgaagaaaatctaaaagaatctacaaataaactgctggaataaataaataaatgtaacaagactgctggatagtaaaacaacaactatacttctgatcattttagctaactcttttgaagcccaaattagaagataaagacaactaaattcatagtatcaactgcttcctggaagaaaagattacacctcacaagtcatcagaagaaaagatatgctagcaatgaaaaaacactacttggaataaatacggagtatgtcgggggagaagctaaaccaaaaataccacacaatccaaatatacctatgtggcccaaaaatcaatggtgagattctccataaacaggccttcataaataggtcttcaaaaaataggccaaaacatttttttaaagataaacttttgttacaatgttaccagaatgaagcagttttccattatagaatgtgattttgctcctatcctttcagaacttaccaaaagaaaaaaaaaaggaatgttattttgttttacactttaatgttttatctgcttgtcaaaatctgatctgtgctataaattctcaaatatgcaatatatttgccatcaggccttcttcagctctctccgggaaggtctgtgtctgatgctgttaacctcccaagtaccctgttggtggcattcacgtgtcttcatgtttttgttggtcttgagggttctgagatcctggcatctgggtcacctctttgggcactcatcacggtttggtcagttcaaagaatggcctcaactatagaatgacaagtcccaagagttgctttctgctacaatgactattctgtttctaccaattaacagacttccctgtgttgtttgtgtggttctgtatttgcttctgatccatggctaaagttgaacagctggggctgccaattctttgtgtgtctctaaatgaaaaaagtcttttaccccctcaccatggaaaggtaatcttttaacagggctttgttattgtagcccttctgtttctgcggccaattacatttttaaaaacttttcaagattaattattcacagagatctgccacttttgcgcactacataatatctttttcaataaattatcaaggcagaaatgaaaagattttaaaaccaaaaactgtttttacgtggcttaggccagtacttttcaaatcatctgtgatgaagaaccagtttaaatttccaacctatcacagaccaatacttttgtaaaatacaatgaaaaggaatttctagaaaaaagaagtttttttaaaaaaagacatacctaagccaagcacaaaatttccatcattagaatcaatcgacataaaattactatcaaattgctgtaaggtgtctagatgcttacaccaaatttccttatcttgtcctaggctgttaaacagttccagcaccaacattcatctgcaccaacattagtctgctgactacactttactgagtcctggctcagccaggctgcccagtttaaatcactgtaggcaagagagcaaatgtggactggaatgggagagaagatggaatgtcaataattgctgctcagctgtctacaactttaggtctccctttaattaacataggaaacatatcaagggttctcagtgcctaactgtttcttctcctcttgaagaaatagggcagttccaagtccagatgtgaagaaaaaagtgttactaacctctggagttaagctccaaggttcaacccacaacctgatgtaaatgctacataatgcagcacatacaaaaaagggaaaaaaatgcaacgaacataataaacaccctactctttactccagaattccctcatttataattactgtacatgttaagatcccaccaagataactacctcattatgcttaaagtacactgaccctttaataaaacttgagacatttgctgaagctgtaaaggggagggagagtggtgagggagggtgttgaaagaagagtagctcactgttagaacatgagagaataagcaaaggaatgcaaattgagacagctaaatcaaaagaaattatgacctaacttgaagagctttaagaatctgggtaatatttctagttaaagtgactccttaaactaaactggtataaaagttatcttctccatcattttggtattttctataacgcttgagtttattttcccataaaaagtctaacctaaatttcctgattttactagacaaagcagctaacatgaaattacttaatgtttaatatgccctttttccaatgtaactttgatacactttctgttaataagtggaatctgtattccctctccttgaatctgggtgggcttctgactctggctaagggactttctaggctaggaaataaaaggcaattaccaaaagaaaaataaaccaaaaagagttgaccaagattccctcggttttcttggaactcagccactatactgattactacagaaatacaaagactcttacagagactattgtgaacaacatttgctaacaaatttgaaaagctggaataaattgataaattcttggacacatacaacctatcaagattgaatcatgaagaaacaagaaaacctcaataagccaattgatgaattttacaaaaaacattttaagaagtaataccaattctactgcaaactcttctactcaaaaatattgaagaggggagaatatttccaaaatcattttacaagggcagtattacctttacaacaaaaccagacaacaatgcaacaaaaaaagaaaactacaggccaatatcactgaggaacgtaaacacaaatatcctcaacaaaatactagcaaactgaattaaacaacacattcaaaagatcaattaccatgattaagtaggattcatcccagagatgcaaggagagttcaacatatgcaaatcaataaatgtgatatatcacattaacagaacaaagaagaaaaaaccatatggtctcatctcaatagatgaagaaaaagcatttgataaaattcaacatctcttcatgataaaaattcccaaaaaatagggtacagaaggaatatatctcaaaataataaaaggccatatatgacaaatccacaaactaacatcgagctgagggaaaatgtgaaggcctttcctctgcgatctgaaacaatacaaggatgcccactctcaccacttttattcaacatagtactgaaagtcctggccagagcaattagacaagagaaataaaaggcacccgaatcgacaaggaagatgtcaaattagtttcgttgacagatgacatgatcttataacccaaagacttcaccaaaaagctttaagaactgataaattcagtaaagtagcaggatgcaaaaaccaacatatgaaaagaagtagcatttatatacaccaacaacgaacaatgtataaaataaatcaagaaagcaatcacatttacaacagctacaaaaaatatcaaatacctaggagtcaatttaaccaaagaagtaaatgatcaacataaggaaaactataaaacattggtgaaagaaattgaagaggggctgggtgtggtggctcatgcctgtaatcccagcactttgggaggtcaaggcaggcgtatcactagaggccaggagttcatgaccagcctcaccaacatggcgaaaccccatctctactaaaattacaaaaatttgccaggcatggtatcacatgcctgtaatcccagctactcgagaagctgagccatcagaacagcttgaacccgggaggtgggggatgcagtgagccgagatcgtgccactgcattccagcctgggtgacaaagtgagactgtctcaaaaagagagaaaaaaaaggaagaaattgaagaggacacacatacacaagttgaaaaatatttcatgttaaaggattggaaaaattaatattgttaaaatgacaacaatacccaaagcaatttacagattcaatggaatccctatcaaaataccaatgacattcttcgcagaaataggaaaaaaaaaatcctaaaatttatatggaaccacaaaagaccctgaatagccaaagcaatcctgagcaaaaagaacaaagctggagacattacactacctgacttcaaaaattacaataagctatagtaaccaaatcagcatggtacaggcataaaaacacacagggcaatgaaacagaatggagatctcaaatataaatccatacatttacaaccaattcatttttgacaaagcctccaacctccaagatcatgcagtggggaaatgatagttcctttaatacctggtgccgagaaaactggataactgtatgcaggagaatgaaattacatctctctctctctctctctcaccatacacaaaatagcaaatccacatggaattaaagactcaactctaagacctgaaactatggaattactgtaagaaaatactggggaaacacttctggacactgatctcgacaaggatttttcaacttaagacctcaaaaatacaggcaactaaagcaaaaataagacaaatgggattacatcaagataaaaagcctctgcagagcaaaagacacaattaacaaagtaaaaagacaacacaaagaatgggagaaagtatttgcacctacccatctgacaacggattaataaccagaatctataaagagcttagaaaactcaatagaaggagttggaggtacaatgagctaaaatcatgctcaatgaactccagcttgggcaagaaagcaagatcctgtctttttttttttttttttaaatacttttaagttctgggatatatgtgcagaacgtgcaggtttgttatgtaggtatacacatgccatggtggtttgctgcacccatcaacccgtcatctacattaggaatatttctcataacgctatccctcccctacccccaacaatcctgcgacaggccccggtgtgtgatgttcccctccctgtgtccatgtgttgtcattgttcaactcccacttatgagtgagaacatgcagtgtttggttttctgttcctgtgttagtttgccaagaatgatggtttccagcttcatccacgtccctgcaaaggacatcaactcatccttttttatggctacagagtattccatggtgtatatgtgccacatttttttttttttttggagatggagtcttgctctgtcacccagtctggagtgcagcggcacaatcttggctcactgcagcctctgacccccgggttccagtgattctcctgcctcagcctcctgggtagctgggattacaggcgcacgccaccacgcccagctaatttttgtatttttagtaaagatggggttttgccatgttggccagggctggtctcaaactcctgacatcaggcgatccacacgcctcggcctccaaaagtactgggattacaggcgtgagccaccgtgcccagccaccatattttctttatccagtctatcactgatggacatctgggttggttccaagtctttgctactgtgaacagtgttgcaataaacatacatgtgcatgtgtctttatagaatgatttataatcctttgggtatatacccaataatgggattgctgggtcaaatggtatttctggttctagatccttgaggaattgccacactgtcttccacaatggttgaactaatttacactcccaccaacagtgtaaaagcgttcctatttctccacatcctctccagcttctgttgtttcctgaatttttaatgattgccattctaactggtgtgagatggtatttcactgtggttttgctttgcatgtctctaatgaccagtgatgatgagctttttttcatatgtttattggccacataaatgtcttcttgagaagtgtctgttcatatccttcgcccactttttggtggggttgtttttttcttgtaaatttaagttctttgaagattctggatattagcccttagtcagatagacagattacaaaaattttctcccattctgtaggttgcctgttcactctgatgagagttgtttttttttttttttttttttttttttttttttttgccatgcagaagctctttagtttaattagatgccatttgtcaatttggcttttgttgccattgcttctgttgttttagtcatgaagtctttgcccatgcctatgtcctgaatggtattgcctaggttttcttccagggtttttatggttttaggtcttacgtttaagtctttaatccatcttgagttaatttttgtataaggtgtaaggaaggggtccagtttcagttttctacatatggctagccagttttcccagcaccatttattaaatagggaatcctttcccccattgcttgtttttgtcaggtttgtcaaagatcagatggttgtagatgtatggcgttatttctgaggcctctgttctgttccactggtctatctgttttggtaccagtaccataatatctgttttggtaccactgccatgctgtttgggatactgtagccttgtaggataggttgaagtcaggtagcatgatgcctctagctttgttctttttgcttaggattgagttggctatgcgggctcttttttggttccgtatgaaatttaaagtagttttttctaattctgtgaagaaagtcaatgggagcttcatggggacagcatcgaatctataaattactttgggcagtatggccattttcacaatattgattcttcctacccatgagcatggaatgtttttccatttgtttgtgtcctctcttatttccatgagcagtggtttgtagttctccttgaagaggtccttcacatcccttgtaagatgtattcctaggtattttattctctttatagcaattgtgaatgggagttcactcatgatttggctctctattattggtgtataggaatgcttgtaatttttgcacattgattttgaaccctgagattttgctgaagttgcttatcagcttaaggagattttgggctaagatgatggggttttctaaatatacaatcatgtcatccacaaacagagacaattttgacttcctctcttcctatttgaatatcctttctttctttctttctctagcctgactgccctggccagaacttccaatactatgttgaataggagtggtgagagacggcatccttgtcttgtgccagttttcaaagggaatgcatccagcttttgcccattcagtatggtattagctgtgggtttgtcataaatagctcttattattttgagatacgttccatcaatacgtactttattgagagtttttaacatgaaggggtgttgaattttattgaaggccttttctgcatctattgataatcatggtttttgtcattggttctgtttatgtgatggattatgtttattgatttgcgtttgttgaacaagccttgcatccgagggatgaagccgacttgatagtggtggatatgctttttcatgtgctgctggattgggtttgccagcattttattgaggattttcgcatcgatgttcatcaggcatatcggcctgaaattttctttttttcttgtgtgtctgccaaattttggtatcaagatgatgctgacctcataaaatgagttagggaagagtccctctttttctattgcttggaatagtttcaaaaggaattgtaccagctcttctttgtacctctggtagaattcagctgtgaatctgtctggtcctgggcttttttttggttggtaggctattaattactgcctcaatttcagaacttgttattggtccattcagggatttgacttcttcctgatttagtcttgggagggtgtatgtgtccaggaatgtatccatttcttctagattttctagtttatttgcatagaggtgtttctagtattttctaatggtagtttgtatttctgtgggatcagtggtgatatcccctttatcattttttattgtgtctctttgattcttctctcttttcttctttattcgtctggctagcggtctattttgttaatcttttcaaaaaaccagctcctggattcattgatttttgaaagtttttttgtatctctatctccttcagttctgctctaatcttagttatttcttgtcttctgctagcatttgaatgtgtttgctcttccttctctagttcttttaattgtcatgctagggtgtcgattttagatctttcctgctttctcttatggacatttagtgctataaatttccctctaaacactgctttagctgtgtcccagattaactttaaatgtaagtgtgctaaatatcccaattaaaagacacagactggcaaactggataaagagtcaagactcatcggagtgctgtatttgggagacccatgtcatgtgcaaagacacacacaggctcaaaataaagggatggaggaatatttaccaagcacatggaaagcaaaaaaaaaagcagaggttgcaatcctagtctctgataaaacagactttaaaccaacaaagatcaaaaaagacaaagaagggcattatataatggtaaagagatcaatgcaacaagaagagctaactatcttaaatatatatatgcacccaatacaggagcacccagattcataaagttcttagagacctacaaagagacttagacttccacacaataatagcgggagactttaacaccccactgtcaatattagacagatcaacaagacagaagataaacacggatattcaggacttgaactcagctctggaccaagcggacctaatagacatctacagaactctccaccccagatcaacagaatatacattcttctcagcacatcacacttattctaaagttgacaacataattgaaagtaaaatactcctcagcaaatgcaaaagaatggaaatcataacagtctctcagaccacagtgcaatcaaattggaactcaggattaagaaaactcaaaactgcacaactacatggaaactgaacaacttgctcctcctgaatgactactgggtaaataagaaatgaaggcagaaataagtaagttatttgaaaccaatgagaatgaagacacaacatgccagatcctgtctctaaaaaaaaaaacctcaaaaggataaataatcctgttttaaaaatgggcacaagatctgaaagacatttctcaatagaagacatacaaaaggccaataggtatatggaaaaaatgctcaacactactatcatcaggaaaatacaaattaaaaccacaatgagataccatctcacctcagttgtaatacctattataaaaaagacaaaaaataacaagtgctggcaaggatgcagagaaagaggaatgcttccacactctgttggtaggaatgtaaagtagtatagccattataaaaaaacaaaaatagaatatatgatccagcaatcccaatactgaatacatattcaaaagaaaggaaatcagtatattgaagtgatatctgcatccccattcttattacagccctattcacaacagccaagatatggaatccacatggacaatgtggtatatatacacaatggaatattattcagcaacagaagaatgaaatcttgtcagctgcagcaacatgaatggaaccagaggtcattaccttaagtgaaataagccaggcacagaaagacaaatatggcatgttctcattcacagttaggagctaaaaaaagtgaatcccatggaagtatagagtagagtggtggttaccagaggctgggaagggaaagggtacagggcataaatagaagtaggttaaggggtacaaaaatatagttagaaggaataagttctagtatttgatagtacagcaagaaaatcacagttaataatttattgcatattttaaaatgagaattgtaatgttcccaacacaaaggaaagaaaagtgttggagatgatatcctaattaccctgatttgatcatcacatattgtatacaggtatcacgtatacctcaaaaataagtacaatatttacataccaataacaagtaaatcaatgaaatgagttacctgacacaatgtcttaagaaactcacagttattaagattgaagcctatactaagaataccagtgaagacacaacaagcagatctcactgtttccactattttcagtactgtgaagacagatgctcaatctgatttaccaaatgaagaggacgcaatcggatattccaactggtcctagcgaaaaaatttatattagacattccaacacatgcttgctttatcttgtgctggttcaacctactaaactgttgaataaccactctagtcctttctgccttcttctctactatgagtgagtatccctaacctaaatgtttaggaccagaagagtttcagatttcatactttttcagattttggaatatttgcattatactcactggttgaacatcccaaataagaaaatacaacatctgcaatgctccaacaagtttccgttgaacatcatatcggcgctcaaaaaagctgagtatttgggagcatatcgaatttcagattttcagatcagggatactcaacttgtaccttcttccctagccctgtataatttgccttccccagcaatcatagaaattgataattcatccaactgccttttttttaaaacaaaaacaacaacaacaaaaaacaaagggtttgtggcaaccctgcatcgagcgagtctatgggcatcattttcccaacagcatatgcccactttaccaaatgtgctacattttggtaatgctcacaattatttccaactttttcattattattatttctgtgatgctgattcatgatatttgatatttctattgtaactgtcttggggtgccacaaatggcacccacgttaagagagcgagcttagttgatacgtgtgtgtcctaactgctccaccaacccgctgctgcctcatctctcccacctctcctaaggcctccctattcagagacacaataatactgaaattaggccaattaataaccctacaatggcctctaagcgttcaagtgaaacgaacagtcccattcctctcactttaaatcaaacgctagaaatgattaagcctagtgaagaaagcatgtcaaaagctgaaacaagccaaaagctaggcttcttgtgccaaaaagccaagttgtgaatgcaaaggaaaagtcactgaaggaaatacaaatgctactccactgaacacacaaatgataagaaagcagaacagccttattgctgaaactgagaaggttttggtggtctggatagatcaaaccagtcacaacattcccttaagccaaagactaatccagagcaagctcatcttcagttctataaattgaggtaaggtagctacagaaggaaagcctgaagctagcagaggttggttcataaggttgaaggaaaaaagccatctccacagcataaaagtacaagatgaagcagcaagtgctggtggagaagctgcaccaagttgtccaaaagatctagctaacatcactgattaatgtggctacactaaatgacacaatgaagaagaaagagtcttttattagaagatgccatctaggactttgacagctagaggtgaagtcaatgcttagcttcaaagcttcagaggacaggctgtctctcattaggggctaatgcagctggtgattttaagttgaagccaacactcatttcccattctgcaaatcctaaggcccttaagaatgatgctaaatccactgtgcctgtgggaattcaagataagatttggggggggacacagccaaaccatatgacagcccctcagaaggggccaattctcctgatgtccaaatcgagccctttgctaagaccagtttccacggaaaagaacacttcagtctcttgccaggattccagaagccaaggagagagaaaacatgccaaatttcacttaattctcaattttgagtataagaatgcattcaatataccatgttttaccagaatttttccataataaaatacatgaaactgggccgggcacagtggctcacgcctgtaatcccagcactctgggatgtcaggagtttgagaccagcctggccaacatggtgaaaccctgtctctactaaaaatacaaaaattatctgggtttggtggcatgtgcctgtaatcccagctacttgggaggctgaggcaggaggcagaggttgcagtgagtcgagattgggccactgcactccagcctgggcaacacagcgagactctgttggaagggaaggggaaggggaagggaaggggaggggtgaaactatacgcagacaacccacagtaaggataataatttattacaacagcatttcaactcttatggctttgaagactttaagtggttaagtatatccctcagaatttcaagactaaattatctctaccttgagccattacgtactttccatgagtaagaccctatagattacaggacagctaaaacttcacctaaatccccaaaataaaattttaaagcaagcccaatctaatatttgagcctacaactggagaaggttagaaattttacagaactagcacatatcatgaaaagctttatagatggtgacatctgaacaagatcttcaagaggagcagtacctgtcatttaataacaaggactgtgcttagctctcacaattatacaactcttaagtcaccacaggttccatacctgtaaagtgggagttgaaataataaatataaagtgtttaccaagatacatgaaacaaagttagcattcaacagacaataacagttgttaaagaaggatgaactgaattttctaaggccaagaaaaggggagttcaaagtaggaatattctttaaacagaaatccactgagaccttcccatggatcattacttagtcctaatcaacatctttcctgttacccctcatatctttatgaatgcttgtcaaaaaaggaaacaaaagataactaaccttactatggtaacatctggtatatttgaaatgtattcataatccaataaccaaattagacacaaatcttcctttaaaaatttctcctaaagcttgtcctattaaaaaaaatatgggtttttttctaaactgaaaatctatcatgagtatacaactccattatgaagttacataaaagttaaaataagaatatacaatagtcaggggctgttaccatctcattgattctgccaattttacaaaacagtaagattttcacagtcaaaaagcagtattaacatatatgatattctaacagtattttgtttcttagaaaaataaaagagtgggggaggtaacaaaacagaccttgaaggaaatacaacactctagcatcacccacagaacatctccctccctggttaacaaggttctggatttttcccttgcctttttttttaatatgaaagactacacacatctctcaatataacagtttttggccaatataaatttgtatcttcaaaacttcgtacataattttaaacaaaagtatgtatggaaaagtctcaagttacaatccaagtaaaatttgtaggacttaatctgtagggtctcataatcacagtttgaaaaggaggccaaaaatcagaatattaagggactccaacccttgaaagtgactgctatagaagtctttcttctacagataccctaatgcttcctataaccccaaacaaagaaattaagaatacagcgaatggggatgtaaacaaagctctaatttcccattttcctactctaaatcatcaatcactgaaagaacatcatgaaatcttcccagctctatagtcacatgaagtgactggacatctcagtaacttcttggcctgaattgccccattctctccaaaaccatctgccccattccctgaccaattacacagactgcttcaagctctttacctccttccccaactttctaaaggcctcaaatcccacttcataattataggtttgtttgacacagggtcttgctctgtcgcccaggctggagtgcagtggggtaatcacggctcaccgcagcctcaacctccttgactcaagcaattctcccacctcaggcttccaagtagctggaactacaagtgtcgcaccactatgcccagctaaattttttttttttttttgtattttttgtaaagccggagtcttgccatattgctcaggctggtctcaaactcctgagctcaagcaatccacccacctcagcctcccaaagcactgggattacaggcgtgagccacagcacccagcactttcttttttattgtaggtttttgtctgccttttttttctggcaattttatttcatggtatattgttttatcatacattgtaatatttagtgaagagccggcacattttccacatacaactgttaaccatattgtctggtaatcaggaaaccatgttttaaatcttttcaatcttacattttagattttgttcacatctagtcttttcactgtttttttaagaaactggtttaatgttttctgctgatgtatataattttccctttgcaaaatagaaaaatgcttgattttcagaaatgcaatgttaagtgggagacacattgatagtctgattttaatagtataatttataaaatacacaaatcctaaagtgaacagctcaatgacttttaaaatacacatacatacatatgtgtgtacatttatctccatccttatgactaccaccctagaccaagacacagaacatttccatcaatgttttatcttcatgtccctttctaattaatactaccccaccgaaagggctactattgctatcactataatgtttttcttaaactttacataattaatcatatacataaacgtaaaaagggaacattttccaacttattttattagaacaccagtaccttgataagaaaacctgataaaacgattacaaggaaaaaaattacaaacagatatccctcataaacatagatacaaataatctgcacaaagtattatcaaatttagctatatcaaaatagaataggccaggcgcggtgactcatgcctataatacaagcactttgggagcctgaggcaggaggatcttctgaggcaagaagttcaagaacagcctaggcaacaaaacgagaccttggctctacaaagaaataaccaaaattttaaaattagccaggtatggtggcacgcacctgtagtcccagctactcaggaggctgaggcaggaggactgcttgagcccaggacttcaaggatacagtgagctatgattatgacactgcattctagcctggacaacagagtaacactctgtctctataaaagaaaaaaaaaacaaaaaaacaaaaaaatcaggataatatgtcatgataaagtggggtttatctcagcaatgcaggttgttttaacattaaaaaaaaattcatacttgagtacagtggctcgtgcctgtcaggtactcaggaggctgaggcagcaggacttcttgagcccaggagcttgagatcagcctgggcaacgtattaacagcaagacctcatttctcaaaaaataaagataaatacaaattttaaacactataattcatcacattataaaaattaaaacagaaaaactcatatgagcaactgaatagatgcagaaaaagcattcgacaaaaatcaacaccctctcataataataaaaaaaagaaaaaaaacctctcagaaacctaagaattgaaaggaacctttttcaatttgaaaaaggatatcagctgggcacagtggctcatgcctgtaaccccaacactttgggaggccgaggcgggcggatcacaacatcaggagttcgagaccagcctggccagtatggtgaaactttgtctataccaaaaatacaaaaattagacgagcttggtagtcccagttactcgggaggctgaggcaggagaatagcttgaacctgggaggcggaggttgcagtgagccgagatcgtgccactgcactccagcctgggcgacagagcaagactctgtctcaaaaaaaagaaaaaagaaaaaggatatccacaaaaacaaaacagacaaaactagagttaacaaacttaacactgaacatgttctccctaagggggaaaaaaggggaaatctgtctcctctcaccatttctcaacactataatagaggtcctggtcaaggcaaagacatagatgaagatataaaggtcagaaaagaaaactatttttatttgccagtaacacattaacagatttattttgattttctatactcagatcaccagaactaataagcgaatttataataaggccaaaagataaactaataggacaatctatttctatatactaggccaagaattgtaaaattaaacttttttttttttttttttgacagagtctcactctgttgcccaggctggagtgcaatggtgcaatctttgctcattgcaacctcaacctcccaggttcaagtgattcttgtgcctcagcctcctgagtagctgggtctacaagtacacgccactacacccagctaatttttgtatttttagtaaagacagggtttcaccatgttggccaggctggtctcgaactcctggccttacgcaatctgcccagctcagcctcccaaagtgctgggattacaggtgtgagccactgagtccagccagaaaattaaacttaaaagccaaaaattattatttacaatatcatcaaaaaacacccagaccaccacattaagatctatcacacattgcttagaaaaattaaacaagacttaaataactggatatacaatgttcattactgtattgttcaatattgttcataagtcaattctcccaaatcaatccatagattcaacactgccccaatatttaaaaaaggaaaatatattaattcaacttataaactgctgagacttcctatccacaagccaacaaattcagttgaacactgtaatcaataacaaagaaataaccaaaatctatgagaataagaacgtggaaaatcaaccaaaggtatcaccaaatgaaccaaagatttcattactgttttagtcaaagaaaaaatttactaatcattgggttcaacgtcaaacttctataaaacacttaaaatgactcattttatacagtttttaagaaaggtataatataaaataaaaatacaaatgtattttagtttacttttctaggtaaagaagttaatatacacctaaatccaactctaaaattatgtgagctacgaatcaatgacattataaaaatgtatgcaaataatgttcaaatgcaaaattaaaatattcagggataactgttttaaagttagatttttctctaactgaaaactgttaaaaaaaatacagaaaaccattgaatttacaataaattccttgcagtttaaacaattatagatgaatctgaaatcaaagatttgtgaacactttacaaaaatcagcatcactaacccttaaagaaccaagttttgggttttttttttttaatcttttattttaggttcaggggtacacatgaaggtttgttataaaggtaaacttgtatcacgagggtttgttgtacagattatttcaccatccaggtattaagcctagcacccaagagtttttttttttgcttctctccttcctccctccaccctcaagtaaatcccagtgtctgttgttcccttcttcgtagaacaagtgtttttttaatttccacaaaaatctccatcactctctcatttgcttctaacgactgaaacctctgttgctcccagaagacaagatttaattcatttatccgtttaaagtaagagtctaccagccaggagtggtggctcacatctataattccagcactctgagaggccgaggcgagtggatcacatgaggttggaagtttgagaccagcctgaccaatatggaggtcttatctctactaaaaacacaaaattagccgggcatagtggtgcatgcctgtaatcccagctactcgggaggctgaggcaggagaatcgcttgaacccgggaggcagaggttgcggtgagccgagatcacgccattgcactccagcctgggcaacaagaacgaaactccaactcaaaaaaaaaaaaaaaaaaaaaagtctactacgtcttaggcactgggaatgcagcaatgagcaggacagataggattcccttgtctcatggggtgtacatttcactgagggacagcagctaaaccaaagaagtaaataaataaaccgtcaggtatgttagatagtggttaagagcaaatagaaaagacagaacagggatgggggtacagtgatggcaggaggatgagtccattttaaattgtttgatcgggctgggtgtggtggcacacacctgtaatcctagactttgtgaggccaaggtgggaggattgcttgagcctaggagtttgagaccagaccagatgacacagcaagaccaagccacatacatacataggtacacacatacatacatacatagggtgatcaaaggaggacacattttagggttcccatataatttattgcccaaaccaggacacttaggaggctgggagtgggaatgctaaacacatggaagacccagtcaataagcataatatggggcatgctgttattctccttcacttagaaggtcatatttgggcaaaaaccccatatccaggccgggcacggtggctcacgcctgtaatcccagcactttgggaggccaaggcaggcagatcacctgaggtcaggaggtcaagaccagcctggccaacatgataaaacccgtctctactaaaaaaaaaaattaaaaaatttgcaggctgtggtggtgggttcctgtaatcccagctacttgggaggctgaggcaggagaatcacttgaacctgggaggtggaggttgcagggagccaagatcacgccactgcactccagtctggtgacaagagcaaaactcggtctcaaaaaacaaacaaacaaacaaacaaacaaacaagaaacctatccactgacagctctaaaattacatacaaagaggaaaaaattgggcaaaactagcagtctcttccccaaatactaataatgaggaccagaaaaagaatatgagaaaaagtttaatacccactgccttatgtttgtggatgagttgatgttactaatattcaaaaatagaaatgaaaagggagagttcaccagtctttctgttaagacatctgttgagagaaccagaatgaggcatgtgtttcccacaggaggatatttaaaggctgattcactcctctcatggagctatttttaaggaatgtggattaggatagatcggcaaactgtggcttgtttctagtgggcctcacttttaacccatgcctgtgtctctggttaaaccaccacctcgtaggcacgaagaactggaaagatagccataaccccgtattcactctgttccagccacaatgccattttcccagcaagagcctttgctctacctatacaatcaacttggaactttcttttcccaagtatccacttggctaactcccatatttccttcaggtcttcaataaaatgcaccttttcaatgcagtctacacatagacattctatataagactgtcatctgacctcaccttcactgtaacacttaacaccttctatcacactaaccaatttacttacttacttggttctcattaaatatctgtggaatgaatgaatgaatagtacgcaaacatctgagagtagaagacatggtacatatatcaaaatgcaaaaattacacaaaaaagaaaattccgttatgatcctaccatttttctatttgggtgtgtacggcatattgattaagaatacaggcactgcagttagattcccactgttcagaatcttgctctgccttttattttagctgagcaacaattgccaagttatttaatctctcagtacctcaattatcgcatctggaaaatggggataatgatatttcctatctcagagagcttacaaacatttgtgagaatggaataacatgtatgttttttgtgcatgtttaatgcacagaacacagcatggcatgtagtatttctgaataaattttagctattactataagaagcacagctctcttttaaaatgccatgatttgaggtaaagcagaaagaaactgtaaaattgaccaggtgtggtggctcacacctgtaatcctagcactttgggaggccgaggtgggtggattacttgaggtcaggagttcgagaccagcctggccaacatggtgaaaccctgtctctaccgaaaatacaacaattagccaggcttggtggtgcacgtttgtaatcccagctacttgggaggctgaggcagaactgcttgaaccagcctgggcgacagagcaagactctgccaggaaaggacaggaaaggacaggagaggggaggggagggcaggggagggcagatgagaggagaggagaggaaaaaggaaaggaaaaaggaaagcattcattcatttattagccacccactatgggcagagtgctatgttaaaccctggataaatacttttactctaagagaaaaaagaaaacacaaactcaatgaaattagaatggccaaaagtttgacatggaagatttatttctgacagctgaatgatcctaaaactagatttacctacaaaacactgtattaatcacaagattttagctctgaaagagccttttaaaatcaaatctaaccctacaaagaatttattcattcattaaagtaataatcatttatgtcaactatttgtcaagaagaaaaaaaactgacattatgtctgtgaagtttacagtctaatagaagacagaaatccaaaaaagtaaaatatataatgacaaatcacagtaagtgctatacaagaccagaagaaaaggatataggaggggacactagagaaaacttggtttagactgacaggaatgagagcactggagtgagattcccacagtaatttttgcattttaatgtcagtaccatgcattctactcttaggtatttttctgtgcacactagtcattgattcattcaacaaatatttaacaaacacctagtatgtgccaagcatatggcagtgagcaaaagatgaagacacctgcttcctcatcgagctcatttaagctgagaccgaaaaggttaagtaggagttggctagtcagagaatgcagagatgatggttctaggaaggtgcaacagaaggtataaacgcctgagaggaagagttcggggtgtttgaggcactgaaaagccaaaataattgtgctattaatgagcaaaaggacaacggcccaaagctggagaaatcaagagatcagatcaggatttaacaaccaaatatctgacactctttagtccttcctagcctttcaaaaacatgaaataaataatgtaaaaactggtataatcaaataacttcccaaacagggctttctgcatttgatagtcttgcaacctaaaataccactgtgaacatttacatttaattcaatattctgaatcaaaactgtctttaaacctagaaaatcatgatgtagttgaacccatgttaaaacaaagtcctttttaatactttaaaatataatcttccttggatgggacctaaggtggattctttacaccaaattcaaccgcacagtgagcttggttcaaacaccccagaaggctttaagggtaccttaaaggtttcagttcaaggtatataaatatagtctgctctattatttttagcttgtcctggtattttatgtgtcttcttaaattgggacactgctgtgctttttgaggttaatgtgactgataaaatcaaatgtgtggtttagaatgtctaactgcagatagagatttgtatattctttggatttgagcttttcactgtgtctttatctacaagttgtaacttttatacttgaatataaccaattcagccaattcctatacaccaacatctttgtccttatcacacagataaaaattaaccagcataacaacaaggtttcctgcctccctgtcctggtacaagagtaacatgaggggagagagaggaagtttactaagatagttacacactgggcaatcacaatggaagcagtgtgtgcagcaccaggaaggaacaggatgacagctcccaggttttgtcagaacctcctctgaacaactggaaagcaaaaccatgtatatgaggagatggcttgctgcagccctacatatgaaactgattctgacccttaacactatccctaccttttcccatcttttatacgtgtgagctctgttccctctcacccaaccctaacctctatcataatgcatatttcagttaaaaatagttgtactcatttgctctgacagccagcaaacttaattgaaaaataagttgtttccatcaatcactttggggtgagcaaaaacactataatctcttttcttccaaagttcacggttttaaagtcacactgaataaaaagaaatccagtagctgataatttaatattctgttggtactggatgtgtagatcttgaatacagcttaggctttgtgaaggaaatcagagccttagtgttaatcatcagtgctaacacaatgttatcatacaatggaggtggcaatatgcaaacgaaccccagcaaatccaggaaaagaccaaaattttcaagaagtatagaattctttggctctgaacactattagtcacactcacttatactatacatttctgatgctcagaaactaaaattttaaaaagttcccattcccaaagccctttaaaatccaagagtgtaaatttaactcagcaaaatatttactctgagtatctaattacataatcaagtgaacaaaatgaatactaaaatagttctaatatcacgttttgtaaatgtttaaaagcctaggaaagaatcaatagatgtcagcaacaactaaataaaagcgattttaatggtgaaactgtagtttggtgctaacttggtttagtacccagtggtactaaaatttttaccctgaaaactaaaatcaatcagtctatacctctactcataaaactgcagccttttacaacagtgcagcttcctccttttaaaaatctttcctaagggagtaacatgacatttaaatatattagaaataataacaaaaaatatttattatattcttcattaagaactttatttcctaacttaaatatttctactactctaagcaaaacagctgatttgcttttagtcaagcaccaattacatagcatttttaacttctaaatatgtttcccaaatactgtcttgaatgttacaatgaaaatgctattattttatatttacatttttatgtgaacaaaaaccctaacaacattaaagaagaaaattgtttatgtatggtattcctaagcccaccttacaataataccgagtttcaaattgaatatacaatctttacagtgagtaaagaaaactaatttttaaaataagaaaatacatgttactcttatttcctacaaccctgtttaagttaaaattcctctttattccttaaaaacttccatattacagaatacagatgtcttaaaagaaaaaaataaaactattgagacataggacagagcattaaaagatagcttaatgcacttaaaattcatttccataaaaaatattttcatttgctatttgaaaagctatctaattggttttatgtaatagctgtaaacccataccaaatctatttccatttttccttaaatttaactgtaaatatattgaaataaattctgaaaaacatttatctaccttttcggtgcaaaagcatgaattcaaataaaacggaacatatttttaagttatttatacctttagcccaacacactggaaatggactacatccgcttttctccatatagatggcacctgctggtttcagggcctcttggcctgccagttccaacaacatacacccaatcctataaagatcaagccaggagtctgcacacaaagtcccagttcctcgctgtgatagtatttgcttcgatccacaagcaagactaaggttcccctgtgtgctccttttttcagagcttgaagcaaaatttggaaggtgttccttctgtaatattttccagcagcttgaagaatgcctctcagttacagaatcttctcatgcttccgcaatctgaaacacagaccatcctggctagatcaagctactgaacagaatgaaaccagcttagtaatgtgaccccatggctctgtgttcctagattcattcagggaaggagaaagagggagggaaaagagggaggagaaaaagaaggccagtagccagtaacttattaatatgctaatctcacccttctgttcaattcatccagcagtcttctgtttacaaaactgacaaccgattctaaaattgagtaagctgcaaatcaagtctgacccagatcatgtctgtagatggcttctcaaaccttttttgttttcaaagtcatgcctttgtcattttactaacctaattctttatgaccttagagttaaaataattactttgatgaaataaaaatcctttctggaaaaaaattcctgatctatctatgtctctatgtctataggtacccaaatatttttgctgtaaaatatttttcctggttggtactgtcatagtaagtgtataaattttaaaaactctctcgaaaacataaaatcaagaatttgaggtagccacattctttaacattagcttagggaatattgaggtatccaagaggcatgatttcctttcttcgtttcaaaacataagtgagtaataaactcatactaaagaagacagacagaaaacacccttacaatctgtactagcaactttttaaaatgcagagctacttagtttttccattcaaactgtgagacagtcaaggtcatctcaaaaatttagctgtctgaacacattccactttagcagtaagataattagtaactaggctcctggtgcctttgttctccgaatgtacataagacacactgagactctacagttctagctttcctaaatgtgggtaattttgttagtagtacatttgtataaaccaatcaaaaatcaagtattttacttaacagtgaaaatgaccgaggctttgtttatgaagtcactaacttctgaaaacaatagcttaacaaaggctgaggagaacaagaggcttatttgtgtccagtgatgccccaggacagttgtttcatttctaacatgctactcttgatgatggctttgtctctaggtttactttcaggctcctaatagtagccagagttcaagtgacctcttctatgctccactgaaaacatatcattcaccagcatgaactctgaccccagggaacactgggaagaaaggggctccagaaaaacatgagcaagctaggaaaagaacagaggaaacaagcaactagatcaactagaatacatgaaaaaatatccccagcctccaccattatactaagagaccaagactgtaaaggaccactgtcatgatgggaaggataagagcacatccaccagcaagcatatctgacacactcctgtgagaacggactggagtttaatctgagccatcgactaatggactgtacaaataatccaagcacactgagtccatcttggaacttacggctctcaaaagttacaaaataaaagctaccttcattagtaacctacaattatattctacacactaagtactgattacaactaattttcacatcttttaaacaaacttggtattacaattcttttaaaaatgagagcactaagactaaagacagggtcatagactaggaagaggtacaggagttaccaagcccactcggtcatctacgatgccagggtcttcacaccacagcacaccaccctaccacaggaaggattttttagtcagactgaacacctgccacaggaccaggtgagcaggagagagagtggtgtaagcacagggtggtggtgactggagctaatgcagtcgcagtgacagagaggatgagaggacaaacaagaaaagtgatggagagaatgagggagagggatgaacctggtttctgtgactttaaagtgaccagtagatgggggctttctctcctacccctgcaactacttcataatttatttcaatatccaaatatcatctcctaatgtgcaagatcttgagagtataggaagatgttaagatatgaaagagcataaattctccaggccagagaccaaggtgactaagtagagaccagattgaaacagcagctatggaaatgttaggaaccaactcatgccacagagaagagctgaagaggatacaggtgatactgctaataataacctataccttttatcaagcaactatagctgtatataaaataactgcatttaacccataacacaatctcagtgaagcagctacttccctattttcatagaagatgaaaatgaagttcagagaggccaagcaacttgcccaaggtcaaagagctgcaaaatgaggcaagtactggctagtttggtgatacagagttttattattttcttcctgctaaatattaaagacaaactatgcttttaaattcctaatccagtgacatcttgaaaagaacagaaacagactacagttaatggcaacataagtgaaaaagcgtaagcagtcctctatattcccttatttatgaattctacatactaatataaaagccaaccacttatttaaaagttctgtgacctttacaccaacctcttttagtactggcatattttaaagcaattctggtaaatcctacttgaaaagtaaactcttatctttaccttccagatataaccagaatacatgtatttctcaccacatctcctggcctcaccccggcccaggctgcctggattacagccataggcctcctacctggtctctctgctccagctctcaccgccctacactctattcacaacccttctgagttgtgcactgatccttccaaaacatcaatcacacaattttactcctctgcttaaaactcatcaacagttctccaactttcccagattcagcacctacatacttagcacagtctgtaaggccgtgcgtgatatggctcccctctatcgccaaggatcccctagtttccttggcacaaccacactgacctccttgccactccctgcccacgtcagggactctgcactgcctgtccctctatgtgggacactcttgcccccgcgttatccacatggcttgctccctttcccctgccacatctatgctcaaatgtcgcctactcaacaaggcctatccagaccaccctgtctgaaactgcatggcccatctgctctccctgcttcattttattcccacagcacttataccttctaaaacacctcatgatttacttcaacattcagtttattgtttggctacccccactacaatgcaagctccgtgacagaaggaaattctgtctgttctgtacatattgtctccagggccttactgaagtgtaggccatattccaccaccctcctatcacctctaagtaatgagaagacggcaaagagaatttgttttcttttcaaggctatggtcacagagaaggtatatgtatatgctggacgtcagtgacagtatggctgtctgggcactgcttcacttccagatctcagtacagtatgaaggcttagtacatacttattgaatgaataagtgaactaaacattatgaaaactttgctttctcaagaatatgagaagagaaaaatggacataaagtctaggaaaatcatgtaaactgcttcttcccaccccacataaaaaaataaatcacataattttagtactgatactattaaaactttcaccgcaaattttaatagagcacaaatgaaaatagtgtgtgagattagataaaatcattagggttgcaaaaaatgttataagcaagatcagtaagcataagagagaactctaaaccccttcatatgatgtacaattttgtccaatctgacttagctacaaaaccctggccatatatgagaaggtccctgggaatgaactattaggaaatgtactacttgtaaatgtcaccaaaagcagttcacaaaataccagcctaactttcacatttctcatataattgtcataattttgtctctcttaaggaataccaaacaccaaggcagcactacttggcaaagtaaagcactaataaatgcttttatgccagtcaacaggaggaatgtaaaaaaaaattattattcatattatacatgcatacttctaaatatatcatctttcaactcttttatgtttgcattaatcagggagttacagatttaaataacttcgacagttttacaatatggttcctccaattagcacttgataattacaatatatcctaactttagaatgtcaggtatctcatactgcgctcatttccagtaagattactaattaccattcctgtcattttgtcttgctgtttccaccacgaaaacaatttttcaaaaattttagtctatccacaaaaattatgacttggttaaaatcaaagaaatattagtcataataaatctaatcaccttccaaagacagacaacaggaaataccaacaagttccaaaaggtgacagtactggcattattcactttctttgcaaagtttcttaaccattactatacctcccttccgttattcttgaggagctctggggaaactgcagaaggcactgaatttgtaactggaagatgcaagggagccccagttctgcctgtgagacaaagaaaatcatttcaaaatcctgaacttcagtttcttcatcagcaaaatgaggacagtaacaataacaatacctatcacttactgagtactacttgccagtcatgaaatagcgtaatagcaatgctaataataatgaaaatataattttgacatgatgataccaggtagatgctaactctgtgccaagccttcttccaagtactttaaaaatgatgactcatctacctatcacaacaaactacccatggggtagatactgttatccccattttaccaatgaagaaatcgaagcacagagaggccaggtaacttaaattcacaatatcgcagaacttctgaattgcaaagctggaaatcaaactcatgcagtctggctacagagtccatgtacttcaccaatttgctgcagtgctttacatctattttctcaattaatactttaaataaccaataacatagatgatattacaatccatgtatgacacatgaacaaactgaggaacagagaaattaagtaacatatctaatattaaaactaactggtcaggtgcagagctgggatatgcatcaggcacttggacaccagccagatgacacagttaaaccaccacctatagtatcacctacctccagatgctacaaaggtttccagagaagagtctggaaacaggcctacaaagggtaaatgaatcacagtgaggaccaatgggacaaagaaaggaagagaagaaacacagcaaagaatatgggacaaataagctgctcttatccccatgcaacaccctaattcaccaaatcatgaggctcatgtgatagtcctctagtgtcagtaatcctgccccaatatgaattcagataaaagtcatcacactacctgctagacacgtggctggtacttgacagatgtatcaaagtcaccagaaaataactataaccactaaattaagcaacagtgaaatacaaaaaatagatgggaaaatgcaactcttaccatgaaaatcttatttaatatttctgccaattggataagacaataaaatgtgtattctcaagtacctctaaaattaatggcataaaaactatttcattatctaaaaaggcaaagacaacaaaaccctgaccttattaatctaagtagtatttttacggactctaattaatgataatttcttatttctgttttgacatatatacagagatcaaagctaaattccagatttagaaactgctgagaggttaactgctgtaattgcttttttcttaaaggctcctgaaatctgtaagatgctgcattagtttttcagatgcagtggtagaagcatgacaacacaggacagaagaagaagttcaaagtgttcaatctatccatatatgttataaaacagagttttttttattgcttatactgaccataataatgcaaacatcaaaaggcaatccagtagttacttaacgctaacattgcccaaaacaaacatagaacttttattttatggaaaatgtatatacacacatgcaacttatttcatcaccatcaattttttttaccctataaatgcaatttatccacagtttgactgctcaccttatttaacaaatagcaacagtgtcaagctattgtgtctttccaagttaggttaactttccaagctaactgaaacagagaaaaccactgatcaggctgtaaaggctctgggttacttgtcagaaattgggctttgcagtcacagacatattaatactggcctgggggtctgatggtgtcaggaggaccccttgtggtgaatgtaaatcccttctacaacctgcatttctcagctaaaagtgaaaaatcaacaatatacattttaaatttatccctcatgatggcctgaaaaagctaaccattactacagactccatactctgtatcaggccaggcgaggtggctcatgcctgtaatcccaacactttgggaggccaaggcaggtggatgacctgagatcaggagttcaagaccaccccgaccaacatggtaaaaccccatctgtactaaatacaaaaaattggccgcgcgtggtggcacatgcttgtaatcccagctacttgggaggctgaggcaggagaatcgcttgaacctggttgcaatgagccgagattgtccagcctgggcaacaagagcaaaactccatctcaaaaagaaaaaaaaaaaaaaaaagaaaaaaaaaaaaaaaaaatatatatatatatatatgtatatatataatatcagtagcagctagtgtggatctatccctcatcatatctatattccaagcaacagacataaataagacagcttttcttctttccaaacggagctacatagtagttggccttttttgtcaatttccctcccgtatgcttttggttttgtcatgctggcatgaatggttgttattccagcttaccaagaaatttcaggagtcactttgctaattctatctaaaaatttgtatcattaaaaaatgttaaaaccaacctaacacccattataatagctgctacttttttaaaaaatagaaaataaggtttggcaaggatatgaagaaatcgaaacccttgtgtattgttggtgggaatgtaaaatggtacaactgctatggaaaacaacatgggtggtcctaaaaatattaaaactaggaccaccataaagattcaataatcccacttctgggtataaaccaaggaactgaaatcaggttctgcaagagatattcaaacacccatattcatagcagcattattcacaatagccaaaaggtagaagtaacccaggtgttcatccacaaataaacaacatgtggtatataaattcaatgaaatattattcagccttgaaaaggaaagaaattctaacacatgctgaaccttgaggacattatgctaagtgaaataagccagtcacaaaagaataaataacatgattacacttatataacatatcgaatgtagtcaaatttatggaagtaggtagtagaatggtggtttccagaggatgaggctggaaggagagaagctgctttatgggcatagagcttcatagtttcaagatgaaaaaaattctagagatctgtttcacaaaaatgtaatatacttaatactactggaacagtaagtacacttaaaaactggtaaatgtcaaatttcacattttttaaaatttatttttatcacaattttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccattttagccgggatggtctcgatctcctgacctcgtgatccgcccgcctcggcctcccaaagtgctgggattacaggcgtgagccaccgcgcccggccacaattttttaacttaaaaaatgttaaaaccatttttaaagagtaaatctcatttatattttacaacaaatctgcaaatataattatgtttacttttataaatgaagagaaaagctttgagagtttaagaacaagtctaaagcgaaagagacaggaaaaagagacaataaccaatcactgactaagggcttatattgttccagccctgtacaaggtggctttatgtgtgtgtgttttaaaatgtgtccccctaataaacttggaggtaattactaatatcatcattttcaagaaaaagaaaactgaggctcacatacacaagtaaggacttgtgatacaattagactgtaaaagtaaaatgtcaaagccgcatgcaactccaaagcccaaatcatcttttccatcaccctaaatttaaaggtccattcagtttatttcaagtatcctaaaacttaaactctgccacatggtattagatatgtgaccctggcactttttttttttaactttctctccataacttagtttctcgtcggttaaataaagtttaaaatggtatgtatttttcagttatgataattaaacattacaagcataaagggctttgagagcgcccataacaaaggctccatgtcactgtaagtgcatcattactgtctgcctcttctgtgcataggcaataaattaagcagtagggatcccaaaataattggacagagtcccatcccataaggagttgacagaccatcagaagacaagcaaacaaatctgagtacccagaagtctaacttctggtagactggtctactaaacctccaataaatctcctctcagttttaaggcagtttgaggcttataatatgtttatttgtaatactgaaacactgttaacagcctacatgtttgatagaaggggaatgaataaataaacctcggaacaccaaaatgaatgactatttttaaatgttgtgtctgaaaatttttcactgacattggaaaatactcattaacaacaaaaacagaaacatatcaaaaaaataaggcagctcccagtcctaaattgcaaggatttcaagataaatagatactttaaaactcctttatcttctgtcctatgttccaatgtgccacactctcctgatctctctttacttctcattatttttggtttttgtagcttcttaaggtaaaaacatagacaactgatgcttttttcctttcagttatataagcacttaaagttataaagttccctcttatgtactctttcaagctgcataataaagactgatgttatatttttactattctgtttcaaataactttctaattttgaaacattttctaatttctcttttgattttagactcatgtattatttagaaaggtatttcatttctaagtactgaggactttactggatattgtttctttaaaatatttgctttttacatttattcttttgatcagaaaacacacctgcatggtatatttgctgtaagattaattggaaaaaaagaaaatacaggccaggagcagtgactcacatctgtaatcccagcactttgagaggctgaggtgggcagatcacttgaggccagaagttcaagaccagcctgagtaacatggtgaaaccccacttctaccaaaaatacaaaaattagcagggtgtggtggcatacacctgtaactccagctactcaggaggctgaggcacaattgcttgaacccagaaggcaaaggttgcagtaagccgagatcacaccactgcactccagcctgcgcggcagagcgagactctgtctcaaaaaaaaaaaaaaaaagaaaaagaaaaagagaaaattattaaatacatggtacaaaattcacatggatatgcaatgaaccataaacatcacccccccttcaccctattttctttccatcacattctctctagatagaatcactgttcctaattgtttgtgtaaccttctggaggtgttccatgcatatacaagaatgcacatatgcaaatacagtttcttttgcattacaccaatataatgtgttctacatactcttctataccttcttaaaacttactttaaaatatatcttcagcctaggcaacaagatgaaaccccaactctataaaaaaataccaaacaattagctgggcatggtggtgcctgcctgtagtcccagctgctcaggaggctgaggtgggaggattgcttgagacggaggaggctgaggctgcaatgagccatgattgtgccaatgcacatcagcctaggtgacagaacaagaccttgtggttttaaaaaaaatttttaaataaaaataaaagtatattgttcactatagattttcttgcataaatttttgattcttaaaaatactgtaggccaggcgtgatgactcatgcctgtaaacccagcactttgggaggccaaggcaggaggatcacttgagcccaggagttcgagaccagcctaggcaacatagtgagacccccatctctacaaaaaaattttaaaatagctggttgtggtggcacacacctatagtcccagcctgggaggctgaggtgggagggctgtttgagcccagaaggtggaggctataatgagccatgattgggccactgcactccagcctgggcgacagagacccagtctcaaaaaaaaaaaaaaaaaaaaaaaaaagctgcattaaattattgtttatcttaattactgagggttttggtgactctttagatattatgtcaagacaaatgcctcagcctagtcctgctggcactgtccaaagatccatttccacattctactctttcccccactgaccccattctcctcaaccacatgactctcaggggtttgtgaaactagaaatgtttctgctcaatgcatgttaaacataatcacgcaatttttaaagtttcactctaagaataaagatatttaacatttcttttttttctttttttgagataaagtctgttgcccaggctggagtgcagtagtgcaatcttggctcactgcaaccaccacctcccaggttcaagcaattctcatgtctcagcctcccaagtagctgggatcacaggcgcccaccaccacacccagtttatttttgtattttttagtagagagggggtttcaccatcttggccaggccagtctcgaactcctgacctccagtgatccacccgcatcagcctcccaaagtgctgggattacagatgtgagccaccatttcttttttcagggaccagaactacagtaagcaaaactgtcaaagccatatctagtttaattgaaataattacaatgtaatttttacactggaccagcaaactcttgaattcataaaatgtctgaatttcaaaggaagcatgccatataaaaacttgttagcaaaatcaataaattatggatatttgcatcttctatgatacagcagaaataatgtattcattcactctttttctgtccaaggatcctgactaacagcagcagagactaaaatcaactgcctcatcagggtacaacagaagacaaacaagacgggggtttgtatacagctagcttactaagagtcttccttcccctttttttgagatgaagtcttgctctgtcgcccaggctagagtgcagtggggcaatctcggctcactgtaacctctgcttcctgggttcaagtgattctcctgcctcagcctcccaagtagctgggattacaggtgtgtgccaccacacccggctaattttgtattttcagtagagatggggtttcaccatgttggccaggctggtcttgaactcctgacctccgatgatctaaccacctcagccttccaaagtgctgggattataggtgtgagccaccgcacatggccccctgactttttaaaaccaggatctctaacaacagtaatgaaaaaaaaaaaaaagacttgagatttctaaatccaagacagatgcaacagctggcaatagaagagcatttcctttagaaaaaaacagaagaactgcataaaatataaaaatcatctgtttgaagacagcaagaacaggaggggctaaaaaacttcaaaaccacagaagttcagctgatcttttgcatttacttttacctttggtatgtatttaccaattctgagaagaagaagcaggtggagaatctaggctgtgcattcacagaaaactgctgccagaagacagaaaaatcaggcaaggttttggaacgctaaatcctagagcattagtattcttactgtataaaggtgtatttattgtcaaatattattctgcaatgaaaaggaatgaagtactgatacatgctacaacatggatgaaccttgaaaacattatgccaagtgttagaagccacaagagaccacatacagcctgattccttttatataaaatgtccagaataggcaaatctataagaaagtaggttagtggtttccttgggctgaagataaggaataaagagtgactcctggtgggtatggggttttcttttggggtgagggaaatttctaaaattgatggtggtgattgtactcattgtatagtatgagaattatacgtcaatttaaaaaaaaagacacaaagcctctaaaggcagtgagtagagattttcaagtcttacaagacaaagattaaagtgccacacacgaggaagataaggaaaaggagccgataaatataaaataaatgacatagagctaaaggacaaaaaaaaatacctttaacaaataaaagccaccagttggtattcagaaacaacaagttctagaagatcaaccaagaaagaaaaagaaacacaaataaataactaaaattcctaaatgaactataaacattacagaaaagaaatcatatatctaataaatcattggtctaaaatcttgtttacaattataagaaattgaagataaacccttggctttcccctcaaaacctaatcctgaaacagatttccccaaatcagtaaatagcactggggtcagtgtcatgcgcctgtagtcccagctactcaggaggctgaggcaggaggacagcttaaggacaggagtctgaggctgtcagcataccatgatcacacctgtgaatagccactgcactctagcatcctgagcaacataaggagactttgtctctaaaaaataaaaaaataaattttttttttgaaattagcaactccattctcctagctgctaatgaaaataccttgacatcatccttgattccttaactttagaacacaaccatcccaacaagtttcttaaaatttacgtcacgcctctgctcaagatcctccagtggcttcccatctgactcagaacaaatgcacaagacctcacaatggcccagaacgctctaagagatctaaaccacccatgagaaataacacctccccaatgttcctgctaaacggcctcaaaagttttaaacaagtagtgtttatcaagttatattctgctaagcctctgctatgacagtgatgaaattttctgaccatctgttgttatagacttattcctattttctgcatataaagttcacttctgaaaacaactctctattgatctctctctagcaagatgttttcttttctgtagggaaaagaaagagatatcaaaatggagttagagagattagactgttactgtgtttatgcagaaaaggaggacataaaaaactccattttgaagtttgaatcagcactgcaattacaacattaacaagtgacacatgatcttaagtaagttgtcaatcagaggttaaaagtattatcacaattgttaaatgtgtatagctaattagaactatgagagcattaaagaaagggggagataggaacaacttttcaacaacatataaatgtttattttatatctattagacaaactgtccataaacgatagaaccaaacagaaggaaaaaagctactttacacccatgaaatgtcccagggccccagagcatattatagcaggagctactgtggaaaagaaaaaatgattcatatcaacaactcaagaaggaatcaagaatcaggattacaattcactgaaggcaagcaccccaggtccagaggtaagcacctatgcctcagagtgacttatcctgacagattcttagagagcataaataacacctaggctgcgatgtatccatggttctctggcctcaggacccatcaactgtagacaggtcctcccagaagaaagttattagtacctcgcctgaatataaacggggttatcctatactagagacaagggaagacggggaggggttcaaagctgagtccaatgccaaactggcttgcaaagacctctatctgagattcactctgttatttgaaaccaataaaatgaaagtttttttcctaatgcgctgttcatgtaatctcaatgctcagtatgtcctcatctttttttttttttttgagacagagtctcgctctttgcctcggctcactgcaagctcctcctgggttcatgccactctcctgcctcaggctcctgagtagctgggactacaggcatccgccaccacacctggctaattttttgtatttttaggagacacagggtttcaccgtgttgaccttgtgatccacccgcctcaacctcccaaagtgctgggattacaggtgtaagccaccacacccggcctgtcctcatcttttaagagtagatcagagcctaggcaacaaagtgaaaccccatctctccaaaaggaaaatttttaaaaataagccaggcatggtggcatgcatctgtagtcccggctactcaggaggctgagacaggaggattgcttggctacaagtgagctatgatagtgctattgccctccagcctgagctggagtaaaactctgtctctaaaattaaaaaaattaagtaggtcagaaccttctagttttgtgaattcaatctttttaactaataaaatcaattgtgggaaaacaagaagcaggatcaatgaacactgtaaattttacacatctacatcacctaaagaggtcaagagaagacaaacatgtactgtatagataaatcaacgtcatcctaaattctcagcaatgtactgagcgctcacgaagtctacaacaaggtataaggtaaaacacaggaggaggggccactataataaaagacacttcaactaaaagcaaaaagaacaacttgttaggcccattttctacctgggatgcaaatatgggggccttcctgactcactgcacccgaccaatgctgttgttatgtttcaggggcatctttagttgccctaaaaaaaaaaaagatcagatcttgatctacctcagaaacaatctgtaaccaattcaaaaactggacctccttaaccttcacacctccaccagcaaattaaagagccatctccgaatgtgtcacagcacacatcacatcagacactttggttgctatgatttttaagcatggcaaagttacaacttgaaatactacataaaattttaaacttaagtcccacaatagttttaaatataaaaattaccattatctgcagctcatcagtccaataggacaaaggatattctagagaacatcttttttttttaactttctaagatgataaccttttagagaaaaatactgctttcagttaattacataaagctattataatgactactgctcttttgggatacggcctttccatgcatcttaatagctaataaagtagtttactcacaaacaggaaagctaaacatcaaaaacagatgtaaagataattaacagcaacaactaaaagcatttgatttctgatcctagacaaataagatttatattaatgtaatacagaaacatggatctcctgtagtacaggtgtcattaaaatatacacctaatttgcacatttttaagaacatccattttttaaaataagtgatggagggcaagaaactgcaaaaaatatgttaaagaatttaaattttctttttataatcgttattgcatacttttatacttacttcctgaggaaattataatttacttcagctgtggttttaagtatttccacacctgatttttctgaaaataaagttatgccatgaatttgtctatataaaatggacttaaatatgagagaatgaaagtttatttttatgctctaagtatatataaagcctggacataattacacgtggcttaaagtatactctaattggcacccttgaattacccaggaaccacctttgactacaggcatttgctagtatgtatctcccaagtttaaggaaatcaaatgccatctttaagtaaacaataaaaaaaaaaaaaacacaaaaaaacaaatctgatttaatctaacaaaaattggaaagaaaacaaaaataatggcattactacatacagggtttaatgtaactgcatattcctagtcccaaaatacatcaaatacatttacatatttttaatgtgaccacaaaagtacaacacatatttactacaatgtaatctttccatatagaatatgattcagttggacatagtggcagtggctgcacgtctgtagtcccagctacttgggaggctgaggcaggaggatcaccagagtccaggagtttgagtccagcccaggcaacatagcaacaccccatctcttacaaataaaacaaaaagaacatgaccaaaattatttcttctgttgaaaaatatactcagtacaatctcactttttgtatcctcaaacttagttgatctctacattattctaacagttatctaagaagacaacacaacctcctcttcacatctaacacaattcacagtacaaaatcgagagtatctttgtctcccctcatgcaaagagagacgatgcaaatagaaggcgtccatcactaagtccactagtgtagggctgtcctgttccctgtgctttcattctatgtcctgaccaaataccagagtgctttgaccgctctgtgacccagccacgtgcaggttttccctagcaagcttgaactcagtatggagccttaaacattcccaggcattgataaaggtatctaagttgctgcacaaaacactaaaagaaactagccctagacctgagacaaattcctcaaactctcataaaaactccacaccttaatccccttgctgcagacatacctagagagaacaccgccccactcctttttgctgtctgtcacaaggattgtcgcaatcctctgtaagtttccccaataaatgctctagactgatcaccctggtgtttagtacttctttctttagaatcccaaccagccccatctcaggataatctggagcactcccttgtgggaactgccctgccactgctttgggggcaactccagcctcagctcagtggtacaaaacaaagagcttcagctgaggaaacaactccgcaccaccccttgggtaaatgtctggcagcagccacagtatgtcctaaaataaaaacagccatcatgattactgtacaaatgccatgcaaacatttgaccaagctttgttatcctcttcttctcaataaaatccacttataaactgactcgttttcataatcaaaatattttacctaggtgtggtggtgcatgcctgtaatgtcaactactcaggaggctaaggcaggaggatcgcttgagcccaagagttcaaatccagactgggcaatacagtaagaccccattctcagtatttttttttttgaaaaaagaatatttttgcataaaaagtcacaccctgctttcctcccctcttccatcttcttacgtgaataaaagtagggttggggaagaaaaggaaagggctgggggcaaacaaaggatacatcttcttcaacagtctgaacaatcttccagatgcatacacaataaactttatcatctaatgaataaaagtatatcctaacctttaaatccagagacttattctaaacatttaaagccagattcgaaaaaactatacattttatttttaaatgtttactagttcaaaatttttcattcaagaaattgcaaaaaaattaatgacaagcatacataagtgatcaaagttttcccacatctatcactgctattgatatgtgtactatacaagttcagctctatatactgcaagttcagctctaacaatgatcaagtctcatctgcccctagtccatcaaaagatgatagatttaggatccagtttccacacaaatccaacaggtagccttcatcaaccctacaggcccagaataaaattatcatttggggttgcacaaatcttccacagtcaaatattacataccattctggccatgtggcctagaagtcacatctagtccctcattctaggtcacctatgtcatacatatacccaaacaccattattctaccaggattttttttatttcaaagctgttgtcactaggagataaaaactaggtagtatgtacacatttattcactttatggtaaatcatttcgcaaaaggcttatacaatgaaaaattattttgatatttgtcctgctctggcattaactatttattagtgataatctcgatgtcacaaattaagaaagaaagataccttttaaaagggagagactgagttactaaaatttacatcaaaatctaggcgaagtgccaaaaacaactccaaatcaccaaggaatcatctgaaagatgagtggggaaaaatgaacagaagaacagagtagagcacggggcctggcccacggaaggcactcaactgtgtcgaatgaaagaataaatccatttacttttcttgattcacattcactcatcactagctccagctacacttactgttcgtattgacatatcctaacatatccctgataggatgggcaagtaataaatacagacttttgcttgaagaacttgggattaacagttatgttcatgatgaaaaacacaacatcctgtacatcaggaaagaaacactactttgcatttgggaggccgaggcgggtggatcacctgaagccaggagttcgagaccagcctggccaaaatagtgaaacaaaaaaattggccaggtgtggatggcgccacttgagagactcaggcaggcctgaacccgggaaacggagcttgcagtgagatgagatagtgccactgcactccagtctgggtgacaaagcgagactctgtctcaaaaaaaaaagactaaagagtcatgactatatattacaagtgattccagacaggatcctgtatcaagggtaagaactgctataagggacatcacttgccaaaatatgaccatggtctacagccatgccatccaatctcaaaagctaagcagcgtggggcctggttagtagtattgggattgggaggctgcctgaaaatactgggtgctgtaggcttaaaataaaattgtttttttaatatgaacatggccgggcacagtggctcacgcctgtaatcccagcactttgggaggctgaggcaggcagatcacctgagatcaggagttcaagaccagcctggacaacatggtaaaaccctgtctctactaaaaatacaaaaattagccgggcatggtggtgagtacctgcgctacttgggaggctgaggcaggagaattgcttgaacccaggaggcagtggttgcagtgagctgagaccacaccattgcattccagcctgggtgacaagagcgaaactccatctcaaaaaaaatttttttaattaaaaaaaaataaattcaacatgtgtaatacaacaatcacacacataaattcaactgaaatgaacacaatatgaacagctatcccaagttcatgcaatgacaagtgaaccatgaatgactgccacctgggctacaccaaccggaactgtcaccaattctaaaaagcgtaccagcacacttttaagccttcaaaaccagggttaagttaatgaagacattcccagagaaaaatacagggatggagtgagacaataaaatataaaaagcagaacaatcagcaatctccctcctgttcccaaacaccaaatgtcaaagaggctaccattagatatttactgtgtgatcaacacacaaatagttctctgcagaggctgtaataaacaggtctcatctgctggagacagtgtctcaagacacagaagagcatatgcattaaataaacaaaaagcaacttaggaagccctactgtaatgcaccttattctatcactgattctattagtgccacacattatagtatatcctgaagatcgtaaaatgatgagctcatcatttaaaataaactgatttttaaacgaaaattagaacatacaactttctactttgattccactcctactcactgttgtggctttttaaccaagagtttattgggaaaaaaaatgctaaatggctgctccacaggacatcaacaagtaccacaaagtagtaatgagcaactctattttttttttggagacagggtctcacttttgtcacctacgctgggatgcagtggcatgatctcagctcaatgcagcctcgacccctcaggctcaggcgatcctcccacctcagtctcccaagtacctgggactacaggcacgcaccaccacgcccagctaactttttgtttgtttgtttgtttgtttgttttattgagagagggacttgctctgtcgtccaggctgcagtgcagtggggtgaacatagctcactgcagcttgaccacccccaggttcaagcaattctcccgcctcagcctcccgagtagctgggaccacaggcatgtgccaccacacctggctaattttaaaattttttgtagagatgaggtgttgccatgttgttcaaactcctgggctcaagcgatcctcccacctcagcctcccaaagggttgggattacaggcatgaacctctgcacctagacttactatgtacattcttaattctagcagtttaaaacataaatgtaccctaccattatagctcattaactattaactaaaagatggagctgaagactgcatagtttcatcaatataagaaatagcatttttatttataacgctgataaaactatttttctccagagctacaagaacttgagcaacaaatactaaaataacttttaaacatcttttatttctgctaattatatgacctttataatatacaatctcattatacaaagacaaatataaagcctttaggccacaaataaatcagattacataaatgaatcaaggacttcaagactgttttcaaaagcagtgtctacactgaaatctacttcacttcaactttggtggtacctaatccagacaaataaatgttgatccagctggaaagaaaatttgagctctaatgagtgcgtgcgtgtgtgtgtgtgtgtgtgcgcgcatatatgtgtgcaagagtatatggataatatctgtttgcatataagtcactttttcttctctttaaagttttatttcttgaggcataacgtgcacaataaaaacatcaggtggatggtgataaggactggatctgtttcccagccaaatctcatgttgaaatgtagtccccagtgttggaagtgcagcctggtaggaggtgtttggatcacgggggcgtattcctcatgaatggcttagtgccattcccttggtgacaagcgagttcatgtgagatctggttgtttaaaagtgtatggcacctcccactctctctcttgttctctcttgccatgtgacgcatctgctcccacttcaccttccatcatgagtaaaagctctccgacgcctccctggaagccggtgccatgtttcctgtacagcccgcagaacagtgagccgattaaacctcttttctttacaaattacccagtcttgggtatttctttataccaacgcaagaacagcctaatacaagtgggtctgtgtaaccaccaccacgctgaagacacagactatttccatcaccccaagaagtgcccccatgctcttttatactcaattctctcttccgccccaggcaaccactgattttatttctgttcttacagatttgacttaccaaaatgttatataaatgaaatcacagttatatggagtttagtgttttcacttagtagactgctttgaagatctgcccattttgttaggtgcgtcagcagttagttcctttttattgctgtataggattccattgtataggtgtaccaaaatctgtttatccatttaccaactgatggatatttgagctgtctccagtgattacgaataaagctgctataaatgttcacatagaggtcattgtaagaaaatgttttcatttctcttgagtaaatatttagaagtaggactgctgggttgggtgacaagtctatgttcaacttcataagaaagtgccaaactgatttctttagcaatcataacattttgcacttccaccagcaaagcaggagagtactaactgtctcacattcttgtcatgtggcactgtcaccttctttttggtttttaacatcagccattctaatagggttgcaatgatatctcgtgtggttgtaatttacatttcctaacgactactaatgtggaacatctttttgtgtgcttactctcattcatatgaaatggatgaaatgtctgtccaaatcttttggccactttttcattgaaatttttattgagacacctatcttttttaatcagacagtttatcaaagaaaaaatgctgaagtgtttgtatattttgttaaaccatttggaattcatgagtactgggtaaaaatctaaactgcctacttgccaccccaactcacaacactatgatatgcaaagacggattgaaagaaaaaacactcatccccgtctcttcctttctctgaaggtaagatcctatgcaaagttgcctgcccactttcagaatcaggaaatcaaaattttccctgttttgacgagtattttatgaaactacactcttccctcagtataagccagcaacacagatgattaagaaatttgcaaggctttgcagaaatactgcattttaacacgactgatacattttaaaaggaagtacaatactagaggggaaagggtcactggcaattcagtaggtggcactattcttctctctgttaaatgtatgactcccaattgtgcactgtggttaaccttaaggcctaagctttactgtaaggaaatggagaacttgatactgccacgaggaatcttggactgtcttcttaacttctctaagcccagtttctcatctgtaaaatgagaatagtaatcaaaaccttactgagctgctgtaaagaattaagatttgaattaacacaatgactgacacatgacagcgattacgatttatgactatttccttcagccgcgactcctgaatcacagtgcaaataaagaccagaaggatgtgctcttcacaaaactgagtaaaaagtcaaagcttcagccggcaagtaatatttgtgtacagcgcacccactgaacataacggcctgaccatccatgagaagtcccatgcatttacacaaaaagtactctagagtttgcaatcatgaagaccacttgtgaaccttatttcttagcattttgcttcagcatttcaaactgagcaatgcttcttttagaaaggtactcatctcttggtttttcagtatctcattattgttggcttaattttctctatatagctacgccatatagacgaaagttgtgcttacatgcctcaatgacatttttccaacttccctgcttgccctctctccaatttggccaaacacggagcagcttcttaaatttcctgttgtcgttcatcttgttcttgcctgaaaactgaagtggtactacagcactcattcctgcactgatgaattggcttggatagttagatgccaagattattaagtttttgtaaccaatgcgtaaagatttttccgtaaatcaatatataaaatcaacagtttaaggttatcacttgaattcaagtgttcctgatatatcctatgttcaggttttaggacattaataatttaccatcaaggctggacactatggctcatgcctgtaatcccagcactctgggatgccaaggcaggaggatcacttgagcccaggagtttgagattagcctgggcagcatagtgagagccttcctccacaaaaaattttaaaaattagccaggcacagtggtgtgcacctgtggtctcagctacttgggaggttgaggcaggaggatcatttgaacccaggagtttaaggttacagtaagctatgaacatgccactcactgtactacagcctgggtgacaaaatgagacctttatttctcaaaaaaaaacaaaacaaaaaatatatcaatgtttaacattctgattgtcacaattcccatttaaacttttttaaagctcctcagggcctgattgtcacaattcccatttaaacttttttaaaagctcttcagggcaaagtcaataagttaatatacatataatctaagaaggtaacacaacacaggcttttcaagtcaccaaaaaataaaagatcacttccatctccatgctttttctggcaccattttcactacctagaatgctcttcctcaactctagtttctccttaacacaattccccaagaagacatcatctccattcctcctctgtccttcccatcagttttttcaatcagtattttctactcacctgtcttacctgttctcgccttatttttgctggtaccacaggtttctccaccctggtaccatttacagcaggtctagagagcaacctctctagactgaagcagggaaaaggagaaggaaagctccaggaggggtgtgtctagggggtgaagacaaaatgaatacacttgactgcatggaaactaattgagaggccctacttacagagctgtcagagtaggaaaccttagccagacctaagaatattaagcaaacaagagggacaactgcaattttcagtccaagaaaacaagaaaaacaaagctgaacaagaaatgcaaccatactacttcaattggctcaatactgagttatgtttaaaagtcaaaataattaaaaacgaaaatacggatctaaacaaaaactgttctagaactacacgaggaagatgggggagaggaaagaccacgtaagagagagaaaatccctacctaccatgataggagttcagtatataactttttctaaaattgatggagcaatgactagtaaacaaatactattaggaaacaagaatgtaaaagctaaaatcaacacctaaaacagattatttccgttgcttctgggaagcagatggaagaccggacaggagcctgtggtttcccgcatgaatacacccatctcctttgtatttagctcaaatctcacttttgcagtgaggcttattatgactaccctatttagacctcaaattcactcatactatggcattacttttttctcatcccacgtcccaccttccagtacattacataatgtactcatttgcttattatttttttattatctgcttccctacactatacagactctgtttggtctactgatacatctatctaaagcaattagaaccatgccaagcacttagtaaaagttcaacaaacatttcctgaattgtaaagtcatagttcaaaccaatctttgaccaatattactaactcccactgtccttccaataaacaagcctggaaaaaagtccatttcatgattcaatacaaatattaggacaacttataccagactacacctggactgctgagagccagcaccagacaaaacatcattaactaaaaaaattcgtacattctaatttaactgtcaccaatctcagttgaaccacaacactcctaggcaagccttctccacccctgcttggctctgtcctcactatccctatttcaaacctcctccactatcatcaaatctccaaccccagcattgctttttccactccttcttaggagatgacttcaaatcctactttagagaaatacagaaggcattataaaagaactacctcaactatccccacatcatcatgctacaaacaatgtctcaataaatatttgttcaataaatgaggaaactgaggataagaaaaataaaatgttttgaccaaagttccacagctaaaagtggcagcaccaaagtctgaactcgagctcatctaactctaaaactagccacacagcaaaccaacatatcactccaccacttaaaatcctcaccctacagatcaacatgccaccccacctcctaaaatcctcagtggtttcaacttcaaggtggtagagtaatgagttttattcctgtgaagacttcaatgaaactgaagtatgcaagtttttttttttaaaggtaaataagaggaagggaagagccaccaaaagatgagaattcaacaaatatctagctattaaagaggagctacacgcacagtgatgtgtaaaacagagacaaaactcaagtgaatcttgatgaggctttgggcctggccatgaggtattggggagggctgatgttaatagccaggggtgaaaacagggtttaactgactagttgtgcccaggctaactcagcatttaccctcggacaaaaaataataataataataattttttaaaaatcccaaggggctatttctctagaaaataaagcaaaggtttctggtataggtgttaacaaccttacagtaaaactctcctttattttgttatttaggggcccacagactaaaagcatgctgaagcaaagtacttcagttctgaattcctaccaggggctaaatctaactccgaaaagtagctagtcctgcttccctatacacttacagacaataaaggatcatcagacatacagggaataccaccttcatgaaaaagaaacaaataccggagaaaacaaagagaaaaactggccttgaaagaaagctaagctgggaaagctcaagaaaacttaaaattaaaaataataaactagttttagagttcaacccatgagcagtccccagaacacttgtagttgcagataaaatacaaatgtaaaaatcccaacataaaagaaataacaaaaacaaaatatgaggcagaacagggagacatgctggaactggggggaagggtcaatatttagggcaatactatctttatcttaaaaggaatcaagatattgacatgaatcaataacccaagcaaaggaaagatattggtaaaattacaacagaagacttctaaaagaaaaatacacatatcaactatttaacaataagtaatgcaggaagagatatggggaataacataaataagctaaacctttatatcccaaatcagaaaatcaacaggtcatttaaaacagagaagtcacaaatgataaagtttaacatacaatacagtcagccatccacgtcagcgggttccacatccagattcaaccaaccatggatctaaaatatttgaggaaaaaaatgaatgactgcatctataccaagcatgtactgatgcttttcttgtcattatcccccaaataatacagtataacaactatttgcaaaggatttacattgtattcggcaatataagcaatctagagatgatttaaagtacagttgacccttgaacaacatggatttgaatggtacaggtccacgtatagggggattttttttcaataatagttacactgagtgtgcctgcctctcctgcctccccttccacttttgccacccgagacagcaagaccaacccctcttcttcctcctcctcctcctcagcctactcaacatgaagacaatgagaatgaagatgtttatgaagatccacttccatttaataagtatattttcttaatatttcttaatatttctatatttcttaatatttcttatgatcttcttaatattttttctctagtttactctgttgtaaaaatacagtatataatacatatacaaaacgtgttaatcaactgtttatattctcaataaggcttccagtctacagtactgatagcagtggaagccagtctggaggggctgctgccaagacacaggctgcagtggggctggcaggaggtgggaacaggtggaaatcccaaccccctactgagttggcggggcaggagccccacattcccaggtacagctgcagcctcctagcctcggctccggagctgggcatccctgcgttcttaggggtccgggaagcccccccgccctcacaggctcctggcctctccccagcccactccagggcagagcaaagttgtggctgagcctgagtctgtcacaacctggccgagtatgcacatgctcgaggcagcgctgacacaccagccccctgccgccctggcccactccagactttgggcactgacaagcacgggagggaggccaagggggagctgagggtggctcagtgtgggcctgcaggcacacctcgtcatgaacagcctaggtgccatggatggcttgttgatggtgggagaaggcagaaaggctcctggatagaaaggggcaggtcccccatgaaattccaccttcaagccagggacagccttgaagcccgggagccaggccaccagttacgggtggagtctacagcctggagtgagaacttatggtgctttttccgggcctgcccatggcccaatcagtacgcacttcctcccttctgagcccataaaaaccccagactcagagagatgttagcactaccagctgcaggaaggagctacccactttgggtctcttcaactcaccaggacaacctgcctgtggaaaggagctacccactttgggtctcctgagagctgttctgctgctcaatgaagcccctctccaccttgctcatcctccagttgtccatgtacctcattcttcctggacactggataagaactcgagacctgccaaatgcagggactgaaagagctataacacaaacaggactaaaacacggcctcctgcttgccatgttgtgagcaacgagcagaggagaatccccgagccagggctatgacaccctctttggggctttgcagttcctggcatctccactcttctgggcgccacctcgttcccctcatccagatgcgggtttccacagcagaggctgcatgcagtacatctggtccagctgcagccttgcacagaactggcacctgtgccagtgcctggagctgcccaccccgctacagcagctggctgtgcaaggtggctggaccacatgctcacacacccacacacccctcacagctctgcgcctggctcgcccttggcaggtgtgggatccaggcttgtagtgtgagccaagcacagcatgccaagccgagtaggcgaacaagcccagtgggcatgggcaatactcaggcagaaggtgccaccagccaccgtgatttctggctggtgaagcggcatcccaaagatcctgtgacactattagtagttaggttttggggagtcaaaagttatacacaaattttcaactgcaaaggggatgggcacccctcacccccgcactgttcaggggttaactgtatatgagaggacatacataggttatatgcaaatattgcactattttatataagagacaggctccatagattttggtatcttgggggaatcctggaaccaatcccccacagatatggagggatcactacatattaggaggtacctaataatataaataatatatatatttttttaagtcaacactcccagaacctcagagtccaatctatctcagctgtgctcatctgcccatatgctataaaagatgcttgtattcacaaatacgagattttgcagaagggtctcagggaggccttcctttctgtccatcaccttcccatgccacattaaccctgaaaattatctccatatatatcccagcaactcaattcctcccaaactttcctttgcttgcctagagttctggttctaaaatacttccttcccaaatttctgtcttccaatgtgtcacttaaaaacaaggcaaggaccaagaaccaactccgccaaagctagctgcttcgcaaccagatccatactgcaggagctcaaatggcccaacggacttacgaaggggaactctgtgaaataagggacctatatctcagcattacatcatgaaattcaatggattggaagccagacttacacatatggactgaccatctgtccagaatttgcggtgggggggaattacaggaacactggttatgaggttattttcctgggtttatatattttcaaatgattttaaaaggacaaaccaagatgggtagattttgtcctatagctaaaaagttccaatgaggccaggagcagtggcttatgcctataatcccagcattctggaaggctgaggtgggagaatcatttgaagccaggagtttgagaccagcttgggaaacaaaggaagattcatctctacaaaaaaatttttttaattagccacgcatggtagcatgtgcctatagttccagctacttgggagactgaaatgggcgcatcatttgagcccaggagttcagaagctacagtgagctatgatcataccactgcactccagcctgggtgatggagcaagactctatctgcaaagaaaaattaaaaaaaaaaaaatttttttttttaagttccaatgagccaatgagatggctcttgggtcacaaatagctggtttgtcatctcacctctctttagactttcgtttcccagcacattacactaagaatgtaagttttgtatttctgctatggaactgtcttgtgctataccaagaggaaatatttttacagctaatgttgctgaaaagttacagttggtattctttcttttgctcagatctactaagaaaagagaacttattttgtgacaggcgttaaacagtcctaattcagcatttagtgcaagttaactgcgggttaagcagagatgaaataacaaaactgccctcacacacagactcacacccaaataaacagaatgcactgttataggaagaaaggtacaatatggacgggggaaggaaataggggaacacaaatagaggggctgtgaccttctcacactgtaacaatcacatctggcacagcacaagggacagaataggctcctctcccttagcctatgaaggacagggggacacaggacccagacttctaggccttgcaaagaaatggaaactgtatgacataatttcccttcactaacacctagaaatagatttgggggagaaaagagaacaaagaaagatgtgaactgacactcatgtggaaattaaaaaataatcctaggcccatactccaaaaacacttgcgaaagtcaaattcaatacagctataaattatcatgaattctgactccatgaagtccaagtttatgagatatgtactgtaacaacataaacaaaatgcccacaaaagagatttataaatactctatgaacctatctgtcctccatttaccaccagacttagaagaaagagcaatctttggaaacaagacaaagtaggattaccctcaattgtacgatttctaaactgtgaaacatgcaccaagatctacaagttacaaactgacaaattacaagtaatataatctctctagggctccgttttctgctaattaaaatgagaaaaatggcaccaaataatcattgctaacaattttgagtgaacaccttacgcatatctcacagcatcttcgcaataaccccataagggagattctataataatcccctttgtcagattaaaaaaaattgactttcaataggttaaataatttgattaaaattaaggagttaggaaatataatacctagctaaaccaatatctgaatctagaacccatgagaataagatacagctattcccacttatctgcaggggatatgctcctagtcccccccagtagatgcctgaaactagggacagtacttggcgctatatatactatgtttttcctatacatacatacctacaataaggtttaatttataaattagggactgtaagacattaacaagaataacataataaaatagaacaattataacaatatgccagcatcactactacccctccgtttgggggccatgatgaaataaactaagggttacttgaacacaagcactgtcattccttgacagctgacctaactcagatggctactaagtgactaacaggcgggcagcatacacagtgtggtggatatgctggacaaagggacaattcacatcccaggtgggatagggcgggacagatcagggtgcatgagatttcatcaggctactcagaatgccgcacaatttaaaacttataaattgtttacttctggaatcttctatttagtatttctggactgcagctaacattgggtaactgaacctacaaaaagcaaaaccacagactggggggagggagctgctctaccagtcaagagcacaacactgtgaagccagaatgaatctgaatcccagctttgccatctactaatttagtaatcttttttttgagatggactcttgctctgtcactcaggctggagtacagtggaacgatcctggctcactgcagcctcaaattcccgtgatccaggcatgcattaccacacctgacaatttttgttttttgttttattttcagagacaaggtcttgttgttacccaggctggtctgaatttttttttttttttgaaacagggtcttgctctgtcacccaggctggagtgcagtggcacgatctcggctcactgtaacctccacctcctcctgtggaggttcaaggaattctcctgcctcagcctcccgagtagctgggattacaacagctggatgcaacatcacgtctggctaatttttgtctgtttagcagagatggggttttgccatgttggccaggctggtctcgaactcctgacctcaagtgatctgcctgcctcaaccccacaaagtgctgtgattacaggcatgagccaccgcacccagccacttggtctcaaactcctgaactcaagcaatcctcctgtctcggcctcccaaagtgctgggattacaagcatgagccactgtgtccggccgtaacttagtatcctttaacctctctgtattttggtttatgcaaatgtgaaatagggaagaacagtaaaccttgcttataaagttattgtgaggattcaattagtaattgtaactcagagtgtttataatgtaccagacagtattctaagcacgttattaaccattattatactacctgtctcagaaaaaaatatataaagtatctacacataataggcactaaacaatttatatttcttccctcacccactctgcaaaatcaactaccttttgtttatttctattgtacatcaaagagacactaagacaggtgaaagaaaaaacaaaaccaaaaatctcaagacacaagtatagcaagagaattatactcacagttcagaagcccacaataactctgaagaaatcaaatgacaatttaaaaaaatacttctaatttctctttcctctttccattgcagtcagagagaacctgaaagactatatatatatataaccaccattatttcactagtttttttcaaggctttattgtactgtccaccttacagttagcttcttcactgcttaccatacttactgtactggaccttgaatgaagaataacaaatttggaaaaggcctgtcttcaaacccgtattttagttgaaggaaatatacatgaaataactaagaaccattaaaacatcaacaggcataattaatctgacacaaagttagctaacaaattcagaggaagatggcaaacagaatatacacatctatttcacttccactaaaattatacaaaagacacagatatggtttggctgtgtccccactcaaatcttgaattgtagctcccataattcccatgtgttgtgggagggacctgctgggaggtaactgaatcatgggggcaggtctttcccgtgttcttctcatgatagcaaataagtctcacaagatctgagggttttatataggggagttcccctgcacacactctctcttgcctgctgccgtgtgtaagatatgtcttgcttccccttcgctttctgccatgattgtaaggtctccccagccatgtgggactgtgaagtcaattgaacctctttcctttataaattacccagtcccaagtatgtctttattagcagtgtgagaacaaactaatacagacatattaaaaagataaatttaaaaaccaaacccacaggacagggagaaatgaaagaaaaagtaactgaatttttgaagctataagaaaagcctctaacactgaagatagaaaccgaacaaacaggaaaacagaaaaacttgggggaaatgaacgataaaagatcggaagcatagcaaatgactcagcaggcccaatgcagccagaccaagccagcagccaaaaacactaagaaccaattccatttccacagccatgtcggaagaaggttcagaactggcagcactaaatgcagacagaacaaggggtaaagaaggtggaggcataaaggatgatggaggttaggtgaagactatctacgatgcagctaaagcctcaacaccatgccttcgtgggactccccaaccatgacagaagactgggggctctctggaaaaggagagcatccttagacagaagtcaccctgcccaactgtacaaaacagaggtcgatctagtcactgaacacacatttcagctcctccactacgccctatgcactttcctctcaaacttcagatagtcaggtctttaccctgcaggaacctgatacgtctaagaagaaagatctaaagataccaatgctggggatttcccaacaaatgggccatccagaatatcctgatgcaaaagtcagagtcaaaaggctgaacccacttgctaaagcttccaaagaattttttattcaccacaaggaaattaataccagacatgtgagaaaattctgtaacacaaaagacagagaacaacacgggagggtggggaagcggggaaggaataaaaaagccacttgggggaaataatacattactcacgcgttttagtgaagctggggaaaacagacctactgtgctgccagtcgtataaaagtctagcacatacgattatgtacagtacctaacacttgataaacaattatgttactggcttatttattgtgcacttttaattatcattgtagagtacacgccttctacttatttaaaaaggacaactgtaaaacagctcaggcaggtcctttgggaggtattccagaaggcactgttaacctaggcgataacagctccatgtgtgttattgcccctaaagactttccagtgggacaagatacaaaggtggaagatattgatattgatgatcctgaccttgtgtgggtctaccctaatgtgtgtatttgtgtcttcattttaacaaaaaagtttaaaaaccttaaattaggctgggcaccgtggctcacacctgtaatcccagcactttgggaggctgtgggtggatcacctgaggtcagaagttcaaggccagcctgaccaacatggagaaaccctgtctctactaaaaatataaaattagccgggcatggtgacacatgcctgtagtcccagctacttgagaggctgaggcaggagaatcacttgaacccaggaggcagaggttgcagtgagccgagatgatgccattgcactccagcctgggcaacaagagcaaaactccatcacaaaaacaaacaaacaaacaaatgaaatgataaattaaaattttaaaaaaatacagaaaagctcatagaatatggatataaagaaaatattggctaggtgcagtgcctcgcttctatcatcttggcactttgggaggccgaggcagatggattgcttgagtctagaagtttgagaccagcctgggcaacatggtgaaaccctatctctacagaaaaaattagctgggcatggtggcacacgcatgtagtctcagctacttgggaagctgaggtgggaggatcacttgagcccgggaaggggctcacattgtactgctgtacaatgtgcctctgttgtaagctaagtgttattacaaaatagtcataagtttaaaaacatttaaaagtttataaagttatagtaagctacggttattactgaagaaaaatattttttataaacttagtgtacagcctaagtgtacagtatttataaaatctacagtagcgtacagtgataatttaggccttcacattcactcaccacacactcactgactcacccagagcagcgttcagtcctgcaagctccattccattcatgcatgtaagtgccctatacaggtatattttttaatcttttatatcatattcttattgtaccttttctatgtttagatacacacacacttaccactgtgttacaactgcctacaatattctgtacagtaacatgctgtacaattttgcagtctaggagcaataggctatactatatagcccaggcatgcagtaggctaccatctaaatttgctgagtacactctatgacatttgtacaatgaaatcacctaatgcatttcctgtcgttaagcaactcatatataaaaatcaaaaacagaattacaaaaagaaaaagacaaatccacagtgatagattttatttcatttatctctcatgaaatagcaaagtctcttgtccatcctgctaatgagttaactacctttttcttgacatgttacatattttttatgcaaactgttagaactatgatttaccaatatcttctcccactctgtaatttgcctttcactctcctactaattttttgtttttgagatagtgtctcactctgtcacccaggccagagtacagtggtgtgatcatgcctcactgcagcaccaacctactgggctcaagcaatcctcctgtctcagcctcctgagtagctgggactaacaggtctgtgccaccatacccagctaatttcttttttttaattttttgtagagacagggtcccactatgttacccaggctggtcttgaactcctagactcaagcaatcctcctgctgtggcctcccaaagtgctgggattacagaagccaccatgccaagcctaataatgtcttttgaggaatatgatgtcctaactttaatgtagcataactcatcgatttttcttttatggttgctttttgtgtccagagataataagatgttatccatcataatcctccaaaactatgctctccaacacagtacccactagtcacgtgctaaggagcacttgaaatgtaactaggccacactgagacgtaagtgtaaaatacacactgaattgctaaaactatagtatccttgccccccaaaataaaatatactaataatgtttaaattacttgcacattaaaatgtatttgagcattactgggttaaatacaaaatattaatttatctgtttttcctaaatttagcttctagaaaaatttaaaatcacatgtggctcacaatatatttctattaaacaccgttataccagttttatttaatcttttcatatctataaatccacttgaaattattttttattgtgtgaagcaaattattatttttccctatatggatactcaaatgacccagcaccatttattgaaaaagtgtctcttccccgttgctctacaatgtcaatttgtcacagatcaattgtcacaaaagaatatatacagtataattctattcctataaagtttaaaactatacaaaagctaatcctaatgtttaaagacacataatagggagtaaaattttttttttaatggaaatgactgtcacagaagtcaagatgatggaaaagggagtaaaaggctggcaataattttttacctgaatgtggttacacacacatatattttttaaacaaaagtaggccgggcgcagtggctcacgcctgtaatcccagcactttgggaggccaaggagggcggatcatgaggtcaggagattgagaccatcctggctaacacagtgaaaccccgtctctactaaaaatacaaaaaaaaaaaaaaattagccacgcatggtggcgggtgcctgtagtcccagccacttgggaggctgaggtaagagaatggcgtgaacccaggaggcggagcttgcagtgagcggagatcacgacactgcactccagcctgggcgacacagcaagactctgtctcaaaaaaaaaaaaaaaaaaaagtagtgtaagagtgatccgttcccctcagaaatggtggacttttatatataatctatatacttatatctacgtttttgattttcaaaaagatatatgagtatcaccaagggataaagaaggcctaaatggatcttttacaatcttacctgtggcccacgtatagcagctcatgcctgtaattctagcactttgggaggccaaggttggaggacagcctgagcccaggagttcaagaccagcctgggcaacacagagagactcccccttgcctgccccccaccaccctccttttccaacaaaaaataaattagctgggcatggtggcacatgcctttggtcctcgctacttgaaaggctgaggtgggaggatctgcttgagcctgtgaggtcaaggctgcaatgagcctggtcacaccactgcactccacactgggcaaacagtgagactctgtctcaaaaagaaaaaaaaaaaaatccaacaacaacaaaaaaaacctacctgtggttatccctgagagatacaattcaccagcaattattttttgtatacagtatttttttaaatgttctacaatgaacatatattgtattagaaggaaaaaaacacattgtaaatgcaattttaaactttttttttttttttttttttttttttttgagacggagtctcactctgtcacccaggctggagcgcaatggcacgatctcggctcactgcaacctccacctcccaggttcaagcaattctcctgctcagcctcccaagtagctggcatgcgctacatgattacaggcatgcaccaccacatccagctaatttttgtatttttagtagagacggggtttcaccatgttggccaggctggtctcaaattcctgacctcaaatgatacgcccacctcggcctcccagtgttgggattacaggtatgagccaccgcggctggcccattttaacccttaaaaaaagaataagtaatcaaggcaagataaactaggatgaatccatcaatggttttacaccaggctgtaaagaaagcatgatctcatactgaatgacttatcaggtgaactaccaaaattgttcattgccacatacagaatcaacacttcacaaatcttgtatttaacgtatcatataggctgggcgcggtggctcactcttgtaatcccagcactttcggaggccaaggcgggcagatcacctgaggtcaggagttaagaccaacccgaccaacatggtaaaactctgtcactactaaaaacacaaaattagccaggcgtggtggcgcatgcctgtaatcccagccactcgggaggctgaggcaggagaatcacttgaacctgggaggcggaggttgcagtgagccaagatcacaccactgcaatccagcctaggcaacaagagcgaaactctgtctcaaaaataaaaaagtactttatagataaagagcacttttccttggaaatgtactttaaagtcagaaaagcagcagatatatagaaaagacatctgaaatcaaattcaagaaacctgaattccagtcctagttctatcactagagcaagtttgggcactgtgagcaagttatacatgccttttacatttatttccctcgaagacaggcaaataactacaccacactttgctaagcttatggatggtatcaaacagccaactatatagccacacaatttgttattacatttgctatttccaagaaatgtatctaatcctaaaaataactcagcaaccataccaaatctccagataaacttcaaattccaaatgcaaagtttcctttaagatttggtactacaggccgagcgtggtggctcacacctgtaatcccagcacttttggaggccaaggagagtggatcacaaggtcaggagatcgagaccgtcctggctaacacagtgaaaccctgtctctactaaaaatacaaaaaaattagccgggcgtggtggcgggcacctgtagtcccagctacttgggaggctgaggcaggagaatggcgtgaacctgggaggtggaggttgcagtgagccaaggtcgcgccactggtctccagcctgagcgacacagcgagactccatctcaaaaagaaaaaagaaaaaaaaaaaaagatttggtactacaaatcagtctcaccaagttaatactagagagctcacctaacaaaaagtacttatagtacacattttttaaaaggcaatgatttaagcctggtaaggaaattttagataaaagaaagcaaaggtttcttttataggtttaattcttttaaagatttcatttagaggtttatcccttcaaccatacaacccaactggagtggtggtgttttaggaaaactgcctcctcttttgcaatttattgagttagtatctttaaactcaaaaatatctgggcctggtgtggtggctcatgcctgtaatcccaggcagagacaggtggatcacatgaggccaggagttcaagaccagcctggccaacatggcaaaaccccgtctctactaaaaaaaatacaaaaattagccaggagctactcaggaggctgagacaggggaatcgcttgaatccgggaggtggaggttgtagtgagctgagatcacaccactgcctgggcaacagagcaagactctgtctcaaaatttaaaaaaaaaaaaaaaggaaggaagaaaggaagggaggaagggaagaagggagggaggaagggagggaggaagggagggagggagggaaaaaaattatgtggttatttttactcatttcaacaaattcttgctgttttgtgtggcaatgaagacagcagtcccatagtaaagagctaaagaaaactgtgtacaagcatccagcaatgccaaaagctctatcagtatactatgcctactacaaacacacatactctgtgaggggcctgaggggcctcctgtataggacacacagctcgagcatactctacagtcatcacacctgtaatcccagcactgtgggaggccgaggcgtgtagatcatgaggtgaggagatcgagaccatcctggctaacacagtgaaacctactaaaaatacaaaaaattagccgggcgtggtggctaatcccagctactcgggaggctgaggcagagaatggcgtgaatcggggaggcggagcttgcagtgagctgagatcacgccactgcaccccagcctgggtgacagagcgagactccctcaaaaaaaaaaaccacagaatgtccaccctcctttcccagcattagtgacactcctcactcatggcaatcctacaaacttcctggcccttgtaggtccccccccccaacccaacctacctaggcttcctctgcttgccctttaagtgctctcctggggaccctattctttgtgttaagtacattccctttgcagtgcaaaagcagccatagacaatatataaacaatttgaatgcatcccaataaatacatatttacaaaagcagatttggcccacgtgctatagtttcctcagccctgtaacagaccactgataccaacacgcacgaaccttaaggccttgcctctccctctaatacagcctatatatgttcttcctcctataaatatataccctataacaatgaacagcttataatagcatctcctcttaactaattctttccacgagctatactctgtgctaagagtcttaggagtactcagtcctcaaaataacctctcaaggaattattcctgttacacatttccggaagttcagatttagaaggttatctaattttccaaagtcacataataataaaaagccaagctaagaatcaaattcaggtgtctgaccccaaaaatcctgcccttaaccatgaccagttgcccaatctaactctttcacctcacttatctctcacccctaagatccctgctctccaattctatggccatccatttaattcaagttacagtgttgcaaaaacaaaaacaaaacaaaacctcctaactgatctactttctttattacagtgcccccttcaattcaacttcttcaccagtacctacctgagtgacctttcctaaaacaaattatgtcaaccgctcaaaagtcttcaacagctctcattactttgagggatattagaaattctttgctttgaaaagcaattttccaactgtgttccctattctgctgacatttatctggggcatcaaagcataccttctaagcctttacctcttcctcctcaaaatatttctcatcatcccattccaaatagaatattccagggggaacagggaagaggagaacttgaggggggttagggggttaagagggagaaggagagaaagaacagaaccaaaccactagcttcctatctcattttccatcacttgctcattccttttctacggtagggtcatactgaacaacctcaacttcccttaatgtgccatgctacttcttacaaacaagcctttacttatgccagtccttctgcctggtaggttcttcccttcccccacccagcttactcctaatcatccttcaaagttcagttcaagtgcaaccaaaaatctgccttccatgaccctcctcccacctaagactgatgtggatgcaccaccctatgcatgaatgtttctaccacaggatttagcccactgaactataatcaataatttgcctgttttttaagagacagggtcttgctctatcttccaggctggagtgcagtgaggagagcctagctcactgtagtctcagacacctgagctcaagcaatcctcccacctgagcctccctcagccacaccatcacgcgccagctaatttctttttttttttctggagatagggtctcactctgtcatccaggctggattgtggcaatgcgatcaagctcactgcagtctcaacctcccaggctcatgcgattctcctacatcggtctcccaagtagttgggaccacaggtgggcaccacccccagccccaggtaatttttttttttttttttttttttttttggtagagaggggagtctcactatattacccaggctggtctcaaactcctggactcaagagatccacccgtcttggcctctctccgcctcccaaagtgctaggatcacaggcatgtgccactgagaccatttctcatttaactattacttttcagaaccaagtataatgctagcaacagtatatgcaaatgcaaagaaaggttttttcatttattcatgtacagagatctgctatacattcctggcatcattccaggaacaaaaattcaaagacactcagaccttgcttgcccttaatgagtttcaactacatattctttgctcccaagaaaaaaggtatttatcctatatcctctttctctccaaaagacagaacattcaccaatggctttacagaattttgatggtcctgctatcatgaacggatatggaaactaagacctaataatccttttttgacattgcatgcatcatgtaatatgaagagtgtcggcctgggcattaggaaacctgatttctattgtttagaaaaaaacactattacttttaaagaaaacaaaatccaaactctttattatgacccttacttgtcaagccaagtctaactctctagtctaaagtctctcagcactgtctcttatgaatcctacactctggcaaaactaaactattgtcagtttacagagcaacttgtactttctctcacatctctatgccatctgctgctccttctacctagatcttcttcccattgcttaacttgatgtacatgtggtaggggctgttctgtctcaccccaggttagatgcccctctcctgcactccacagcatttcttcactcaatataggttattcagtgacagacacaagccatgcactgcacaaggtattggacatgcacggtaccagagacatgaccctaccccaaaggaatcttgtggtgaagcttactagagaggccattaaaattttgccttttctgtcagtctcttcctcctccaagtaaacaacaatattctaggccaggcgtggtggctcacgcctgtaattccagcactttgggaggctagggcaggtggatcacctgagatcaggagttcgagaccagcctggccaacatggcaaaaccccgtctctactaaaaatacaaaaattagccaggcatggtggcacacacctggaatcccagctacttgggaggctgagacaggagaatcactcgaatccaggaggaaggggttgcagtgagccaagaacgcgccactgcactccagcctgggtgacagagcaagactccatctcaaaaagagaaagattctagggacagtgacaacctctttcagctctgcagcctcaggacctaaacaccaggtaaacaacttaagcactattaattaaaaccaaagtaaaggtcagaaaagctccagttggttgcagttggaagcatttcttctttccatgcactctgcctttcctgcctttctattaggagtgtaaacctaaaaacatcacttgttgaattattctgacactcttggaactggctttcttctcttcattaaatatgaagacaaaccatcccagttactccccacatctactttttgttcaccattgtatacccaacagtatgcaccattatctaaaacagcatctagagcgcatgattatcgataaacatttatatgatgcatgaatgacttaatgaataaatgaatggatacactggcattgagtacctcagccacattctgataaccgctttttgctttatgttttattctatgtagttaaaggagaatttaagcaagttacaagcctccattctatcaagactaggcttactgcccacttactgttttagcaacaggcaacttaatgcatgttgaatcctgttttagcaacaggcaatttaatgcatgttgaatcctaactcttcttattccatgatttaatccatctttactaagaacagaaatctatttgtaactatgaaactgataaaatataagtataaaaatctgaactagctcagagtataaagtagctatttctcaaattataaaattaaaagtcttaaattctttttctccagatggataaagaaaaattaaagttggcttattatacaatgatatacatgtttatctccacattctcaactctgaagatattttaagatggatattccctaccctttgtgcatgaatgagtgtattttaagataggtataaatagatgcttgggctgctctgaacccttttcccttttaacctacaaactaaaattttccataccacactaaatctgtgcttcattatcacgtagaatatttcctttcaccaccttgctttcaatgttctcatttcaatgcacaatccaacttggccagccttctatcattcttttctcactacctccaaataacaatcctgatcataacaatagcagcttcatgtgtgtggagtgtctatattagctcattactcctcacagccctaactggttactataattgtttccactttacatacaaggaaacagacttaaagaagttactaagttttccagggtcacacagcaaagaagggagagaccaggaattcaaatactggtttatcagcactcaaaatcatgctgctattcttgcttcccaaattaaccacgtaatattgttaaaacaataaacatgatctgggctttccaaagcaagcatgacagaaagttcttaccacagctgagtaatgttcaatatgacatattgacaaattataagttatctggctggaattaaacaagtaggatgagcccctggaaaagaaaatgtctgtttgatgctaagtgctaaataaggctcaaacccagtatttctttctttctttctttctttttttttttttttttgagacggagtctctctctgtcatgcaggctggagtgcagcggtgcaatctcggctcactgcaacctccacctcccaggttcaagcaattctcctgcctcagcctcccgagtggctaggattacagaggcctgccaccacgcccagctaattttgtatttttagtagagacagggtttcaccatgttggccaggctggtctccaactcctgacctcgtgatctgcccgcctcggcctcccaaagtgctgggattacagacgtgagccaccgcgcctggcctaacccaacatttcttaatccatatcctaacaatttaactcatctatgaagctccccaatgttcaaaatacacaaccactttataccaattttcccttcttctaaactcagtctatcaatagttcctgcacttaacacaagctgcaacctatattctgaaagaacacaggccagaagtaactttctgaaaaaccaaaaatacattaagaatgtgaatatgttatgaaaatcaccagagcaaacaaaagcttctttatgcttcaaaataattttttagccaaaaatattctaatactagactggcactgctcaaaggtgggaatactgtgtctcattcactatctctgcactgatgcttagtacacggtttgccatctaactggtactaagctactgactaaaccaataccctaaaagaggctgtaaaattattgaattttaaaaaccaatattaacagtaataacttgcccattttgtatgcatagcaaatgacgaatataaactgttttccagtttttagatcaatataaatcagggaatgatgaagattagcccttaaattcccacagtagaaataactacactgttaggaactgtacttatgaacatcgagttgatcctgcccaaaaaaaaaatcgtttttaattatttatatgactagccaagcactaagaactatatatcacatttacaaaagagttacaattcacaataatctctactaaacagaagagaaaaaacagattagagagtttaaggagcttggtcaacatcatacagggagcaaggatcagatatgaatgcaaagcaaaaatctgtctacagcttgtgctcttcaccgctgttctattctgcattgtaaaaaatatccccacaaaattatattgtgtgaaaggcttaaaatgtcaaagagacattattctacttaaactaatcaataggcatagtcaatacattcaacacaagacaactcttctatcatacttgagaaaactaatggctatcatgatatatggtaagggccatgttgtctacctgagaaaaacaccaaaagaaactatgggaacagacaccaaaaaaaggatctatctataagccaaattcaagaaataattcgagcagcaactcctatgggggctggaagaggtaactgatcagggacgcaaaatcatttgagcatcatggcccagctgaaactggtgaccattacctgagtaacagaagcagtttgcgaagtgaacagcttcaggtttagataaggaaaaataagcacattgcaccctgtcactcctcttgaaagcaactagaaagcctgaacagagtaactgcagaagctatttgaggactctgaaaagtaaacagtagcaggtggatgagggaggaatagaattcaaaccaccaccacatcagcatatttaaacaagacccagagtctcctcctaacataacatccaaaaagtcggggatacaatccaaacttactctgcacaggaggaaccaggaaaacctcaattcccatagaaaaagaaaatcaagacaagccaatactgagatgacacaaaggtcagaattatctcacaaagactttaaaacagctattatacaaataatcctataaacaagcacacacacaatatacttgctatcactaattatcttccctttatctcacctctccaccagaacttctctatccaagattaccaatgacctcaatactgctaaatccaatggtcaatacttagatattacttcctctgtcagctgcaactgacaggtaattattcctgcttcccttctcttgctttccaggacaccatcttctcctggttttcttcttacctcacaggtggtttctttccagtctctacagctgttcttcctcttcttgcaaacttgtcaattctagagttccccaagactctgtcctttctcttatttatgctcacctcctaggcaagctcactttaaaagctacctttatgctaactgtagctcagatttcttccaaaatcccaacttgaaaatccagttgcctggttgttgtgctagactgttgtcaattctgcatcattaccaccttctatattcacctgtgtgacatagggaagccagaactacatttcctacaaaccccttcctgctacaactcagggttagagtcaactaataagggcaactcgtgcaagactggtaagataaaagagcacactaccctctggaggcagctgtaggctgatgtgctgggagaaaaaaataactgacctacttctgaaactaagacctagatagagcagctcctactaggaattcccagcagcttcggagaaactccaagaaccatccacttcaaccacagcagcagaggcttcaattctgagacctctgcccatctcagatgagctcctgggaagtacacactgtgaacagctgcttcctggaccttcaattctccaacccttccaacagtagtgaaggactataatcctgtgtatttaaaaaagtgtctagagcagcttctcttttcctgaacaattcctcatggatacactatgctggggaccagcttctagatcctcagagaagtgaaacatcagttaagcgaataaaaatgtccaagagacatttcaaagctcagatattgatctttctcctccaaaccttctttacacactcttctctatgtcagttcttggcaactctctccttccagttgtccaggccaaaaaacaatggatgtcatccttgtctcttttattcctcacactccatgttcaaccttgtcagcaaataatgtcagctcttcctggcaaatctgccaagaaactgtccactttgctccacatcctccaccatcaccacgacttgtgccatcatcaccattcactcaaatgaactcaacagccacctgacaggtcccctgcttctaaccttgctgctctggtgcctatcctcaacattgcagatgaagtcaaatctcaatctgattgcagatgaagtcaaatctcaatcagatgtcatcacttctctgctcaaaaccctaaatggctctccatcttatgtggataacttaaccatgttaagttgtctgactacaacatgtctgactacaacagacaaagaaatatgtcaaaaaaaaaaaccaaaaaacaaaaaacttgcttaagactataagcttttcaataagaacagttgctcaaagagttgaggatactgataacaacatcaatgtcagtcaaaaaaaggcaaatatttttgaatgattttccttggttgttgacgttgctcaactgtttattcaaggagtcaatgccaaccttgaagtaactaaaaaattagtctctaagaatagtctgtgtggaactacaaataatattttcaaagctgagaaaacactaatttagtacaatctgaagtggaatctactaagatgcatgataataactggtgatagtaaaaatatatggggagcagacaaatgatttgctgcacaaatttacaaaaattatgaaagtattatggttattcatcagcaagtactatgtagaaagtatttaaatctgtcaggtgttattggaccagtagcatccacagtgaacttcattagctcttgtagacttaaccattgtcagttccttgaatttgtcagaaatagaaactgagtatcttgacttggcctaccacacagcagttaaatggacagtggtaggttttattctaactttatgaccttagagtcaagactcaaatttttctaaaagagcctccttcagttaacactgttaccaaacactgaatagctctgcaatcaattttttctacagacttgatgtttcttaatggattcaatttaagtttacaaaggaaaacagtacttatatgaggaatttatactgtagtaaagtcatttcaatgacagctaacatttgaatcacaagttgcattaagcttctttatatacttctcgtatgtgaaagttaaaacaaaaagcaagatttcaattctgtgcaaatttgcagtggatatattttctgggttcaaactacattccagtagcatttttcaaactccgatgcaagtacaaagaaaatttacatatttcaaaatccatttaactgtgcaattgaggtgcttccatctaaccaccaataggaagtgattaatctgcaatgcaataacatgctagaaggcaattatcaaggagaatctaatagaattctataaatgccttctaagcaatgaatatgctcctgaactgctatcagtatttcgatgtatcctgtcaggattaagacatttttcaaagataaaatatgtaaaatctccttgcagattagcattaagagatgaacacttgtaattgatgttgataatagcaaacactaagttcaaactctaatttagccaaatgttatccacctcctcccctaaaaaaaaatccattcctctcattagacctgtatttttttaattatgctcaattgtttttattattttaattaataaataattgttaattttttttagatggagtctcattctgtcacccaggctggagtacagtggcatgatctcggctcactgcaacctccacctcccaggttcaagtgattcacctgcctcggcctcccgagtagctgcaactacaggcgcacgccaccacgcctggcaagtttctgtatttttagcagaaacggggtttcaccatgttggccaggctggtctttaactcctgacctcaagtgatctgcctccctccgcctcccaaagtgctgggattacaggcacgagccactgtgcccagcctcaattactgtttttatattttgaattcagtcgatgaaaatttgtggaaatttgttttctctcattatttaaatacctacataatattcttgttttgcctattcatctgcaaaacctaaaatattcactatctgcccctttacaaaaaagttcaccgatccttgttttagtcaactagattcccaggtcttccgcacactggtagagttaagacacgttttgtccagctttagctttctcagttgcttttccttttaaactaagtctgccattttacatttattgctgacaaatttcaccctatggattttaccacttcattaccacctgtcaaaatattttaaaaatctaaaattctaaaaatgaactgtctcccagtgtgactcctgttctttattcaaatccctgatagaaatgttagaacagatgtcaagtatgacacacttctggagacatcctcacctgtgtgtagaaattctaatttttcagtttcgtggtaaatgttactgtatgtggttacaacatatcttatatctaggagcaataataatttcttgaactccctagtaatgacagaaataataatttgctttgctagggcttatgcagtaaaggattaaccgccttgctcaaagaaaagtttggccctttgcccagatcctgggaggtaatctttaagctcttggaagctcgtccgataaagctgtctttgtttacctggggaccctgacccacagcaaacaccaggcttgacctttggatggggctggagagtaagctcacctatgattctccatcaaatggtcatttgacttttctgggttatttacttactcatctctaaagtaaaagctttggatcctaaatttagatatacccctaaaattctagattacgtaaagcaaagagtaaaaggggcacacatacacacacacgtaaaaaaaaaaagcagcagaaaagtttgctttccaataaaatggtcaaaaaggcaaactcataggatagatgtaaatcaaagacatcagctctttgccaaccacataatcaaccatgtactgtttaaaattaacccacatgttgacaacatgcacttaaactaagttatttctgctatctgatttctcaaggcaattccttaggatccaatactattttttccaaacagaaaacaaaacttgccacctaaactttgccatgacctaggcaaagtagattcaaagcttttttcctaccttggaattacaattagccccagcgtgaaattctgagagtgatatcttaaccagtctaggttttcacttttgacttctatgccactgctagattccatcatttcttatatctttgccccatcacactttgcctttaatagaagtcacaatttttctcaacaggaaagaagaaactttcttacagattgccccattttcactctcttaagttctctctgctccatatggagcagcttaccaagttcatcaaatctctgcagggactgctattatctgtagtctgtaatccctaaattacatgtaataatgctgacatcaagtatgaaccaatccagtgcagactccagaacacaatacgaatctgcctgatgctcatatctcaacaactgctcggcggccaccctgcttctcctgctttgctcaactaagggctcatcatgacagcacgatttagggattgtcttacaactcactatttacacatttctaatccaactgaggaaactacactcatttatggtactggtgtatcctacctaaaagtgacaccatctctcatagccacatgaatactaagatacgttaatactctacaaactttagctttctctaatgttcatagcatgttgaagcattccatgcccgtcagtctccagctcgctttttatgtaccaaaaatgtgtcttattctgtctttcggaaaggaggagaaactagggaaaaacattccaattgctggttgatacagttcaacttagaaaacagttgcatgtgtttgcattttacttggcagtttgagatgcattacatttaaagtaaaaatcctgtgattgggatgatgtttcccttgccaacacaaacctttagagtacaccagatgtgtacaatctaacaaaaagtgattcctccttttggttggactcctttctgataatgtgatgaaagctctagaattctctccccagggaaaaacagctcacatacacacacaattctgcttagaatttcaggggttcatggacctaagagacaatgttccctcatcaaagcaatcactaagatattccaggaaaaaaaaaattaagagcaaaaagatcttcatgaactcatcaccaaagaaaaaatctggaagccatcctggaattacgctggattccttctctctcagccttgccatttcacttacttagtcacgcctgtagatgaactcagaaacaggcttcacatcaatccctactctccatttcctcagttgtgcccttaagtccttcatttatatgtacaacataattaaaagaacatacagtctattattaaatagactgtatgttactaaattcgacctctgaactttatccctctcactttactaaataacagcaggtgagccatttccttaatgacaaaggttgggtgacttttccccttctaatgtggattactaccttccttactgatcttgtgcctctagtccagtcatcctcctaccatctaaatctgttcttgctgccctaggatgtaaaaaatttatatcagaatcaagtgcaaactgctttgatcctgcccagtatcgactgcatatccttctctacccgacccaacctatttctccacatgtgataaaaatattcagttccacaaaaccccagcctctcacacctccatgcctttgcacatgagtggaatccacttcccatcttccgctgaaaaatactttacaaagaggtcaccacatctagtccacagccagtttttacatggttcctggactaagaatgatttttacattattaaagcgttgaggagaggggggagggggaagaaaggaagaaaaaattagaggaaatgcgataggctgtatgtgtatatgcgacccccgaaggctgaagtttctactctccggcctttaagaggggaagtctgccgacccctgaggttgggcatcacaagggacttgccctccagattgcctgagcacgctaagagacaactgcacacatcatgctgcatgccagggaactataacagtctcactccccctcaagtctataccttcagggcttaataccgtaccaggcacaaaacagtattttttaaatggcgaacaaatgaattaactgaatgaaccagctcaagaactggtgaaatcacattaaatggaaaggacctgtgcctttagtagtaaaacactacttacgtctgttaaagatactattaacaacattagcaccttacatttgtataccactctacacagtaactgcacatataacctcaaaggctaagaccataaaaactacactttataaataaggacttgagaagcacagaaactaacttgccaaaagtcacatgactaaaggcagagccaatatttgaagttgggtcttgtttcttagataaaatgcattttctcttaaacagactacacaactacaatatctagacacttacacaatacctctctacaaaaatcacaatacctagacacttcaattactaatgcctgagattcaggagacagataaaatttaatttctgagccactatttaactgataattttcaagttaatgctactttctggggagaaaaaaatgaaatggacacccaaaataaacactaggctaaaaggtcccagaataaccacaagctaaaaattttctcttttccttaagaatcagtccttgggaaagcaacacaaaattaaacagcttaattaacaaatgccactgaaaggaaagcagctgcagtcacagcatgaactccttgcctgtcagctaagctaaaacaaactggcagttgaggcagtcacttgtctttaagcttcagtttgggtagaacagaatccaaaagctgataatgtacattaacacctcaacttcagccagaaaacaacacaagtgtttccagaggcagaaaatagaaactctattaactttttaaaaagcctaataatgttagtctaatctttttttcataactaaggtataacttaggcatagctggagtttaagtggctaggtacctaaaagtttctgagttgagaccaagattttagccaaattctactacaatataggtctatttaagacaacattaatttcaaagaattggtaacatacagaacacattttctgactacaatccaattctagaaatgtcacaagatacaatgaaaaaaagctcatttgtttgtaatttatcaaacactttaaaataaatcatgaatcatcaaaggaatcagtagaatttacaaaatatgtctaaatattaaacttctttattaaatagaacaataaatgctttatgggccaggtgtggtggctcctgcctgtaaatccagcactttgggaggccaaggcgggaagactgcttaagcccaggagctagagaccaagtttggcaacatagtgggaccctatctctaaagaaaatttaaaaattagccaggtgtggtaatgtgtacacctgctagtcccagaaactcagaaggctgaagcaggaggatcgcttgaacctgggaggtcaagactgcagtgtgcagcatgggcgcggtagctcacgtctgtaatcccagcactttgggaggccaaagtgggcagatcacgaggtcaggagatcgagaccatcctggccaacacggtgaaaccccatctctactaaaaatacaaaaaatagctgggcatggtggtgcacacctgtagtcccagctactcaggaggctgaggcaggagaactgcttgcacccaggaggcggaggttgcagtgagacgagacagcaccactcccctccagcctgggcgacagagcaagactgtccaaaaaaaaaaaaatactgcagtgagctgtgatcgtccaactggactccagcctaagtgacagaatgagactttgcctcaaaataataataataaatgctttatgaactaaataaaaatacttcacatcaaaacttagcccttggataaagagagattccttaaaaaaatcaaaacaataaaaagtactcatcataaaggaaaaaagaaataaagcttatgacattaaaattaagaactttagttccctacagtaaccaaaacagcatggtactggtaccaaatcagagatatagatcaatggaacagaacagagccctcagaaataatgccgcatgcatatctacaactatctgatctttgacaaatctgacaaaaacaagaaatggggaaaggattccctatttaataaatggtgctgggaaaactggctagccatatgtagaaagctgaatctggatcccttccttacaccttatacaaaaattaactcaacatggattaaagacttaaatgttagacctaaaaccataaaaaccctagaagaaaacctaggcaataccattcaggacataggcatgggcaaggacttcatgtctaaaacaccaaaagcaatggcaacaaaagccaaaacagacaaatgggatctaattaaattaaagagcttctgcacagcaaaagaaactatcatcagagtgaacaggcaacctacagaatgggagaaaatttttgcaatctactcatctgacaaagggctaatatccagaatctacaatgaactcaaacaaatttacaagaaaaaaatcaaatgaccccatcaacaagtgggcaaaggatatgaacagacacttctcaaaagaagacatttatgcagccaagagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaaccagaaataccatttgacccagccatcccattactgggtatatacccaaaggactataaatcatgctgctataaagacacatgcacacatgtttattgcggcactattcacaacagcagagacttggaaccaacccaaatgtccatcagtgatagactggattaagataatgtggcacacatacaccatggaatactatgcagccataaaaaaggatgagttcatgtcctttgtagggacatggatgaagctggaaaccatcattctcagcaaactatcgcaaggacaaaaaaaccaaacaccccatgttctcactcatatgtgggaattgaacaatgagaacacatggacacaggaaggggaacatcacacaccggggcctgttgtggggtggggggaggggggagggatagcattaggagatatacttaatgttaaatgacaagttaatgggtgcagcacaccaacatggcacatgtatacatatgtaacaaacctgcacgttgtgcacatgtaccctaaaccttaaagtattaaaaaaaagaaaaaaaaaaagaactttagctccaagacacctcacaggtaaaaaaaacaaaccacaaactggaagaaaatattcacaacacataatgataaaggattgcaatccacacatagaaagaacagctacaagtcaattaaaaaaaaaaaaaggccagaaacttaataggtccttcacagaagacaaaacagatagcaaatatattaaaagtggctcaacatcattactaataagggaagttcaaattaaagccacaataagatatgacacaacctccaaaatgacaaaactgaaaaagtcagacaaaataaactacagacaaggatgtggaacaacaggagtgatacagtttggctgtgtccccacccaaatctcatcttgaattgtagctcccacaattcctatgtgttgtggcagggaccggtgggaggtaactgaatcataaggcgggctctttcccgtgatgttctcgtgatactaagtttcatgagatctgatggttttataagggggagttcccttatacaagctctcttgactgctgccatccatgtacaatgtgactttgctcctccttgcctcctaccatgattgtggggcctccccagccatgtggaatgtaagtcaattaaatctctttcctttctaaattacccagtctcggatatgtctttatcagtagcgtgaaaacaaactaatacaaggagtcattatattagtggtgatataaattggtataactactttgggaagcaatttggcagtaactagtcaggttgaagactggccagccctataactcagcaatcacactcctagatacataggctatgcacatccatgtctatgagcaataagagtgttcacatttgtgtggcagtgtttgcagtacagcaagagactgcaagcaaaccaactgcccatcaattgtaggctagattacacaacagtgaaaatgaatgaaaactatcatacagcacctaagttttaaaatcagagtgcaggatgggaggaaaaaagaaaatcaagtcatataaagacatatagcatgatacccttagtataaagttcggccgggcacggtggctcacgcctgtaatcccagcactttgggaggccgaagcaggcggattggatcacgaggtcaggagatcgagaccatcctggctaacatggtgaaaccccgtctctactaaaaatagaaaaaattagccgggcatggtggtgggcgcctgtagtcccagctactcaggaggctgaggcaagagaatggtgtgaacccgggaggcggaggttgcagtgagctgaggtcacgccactgcacttcagcctgggcgacagagcgagacttcatctcaaaaatataaaaaataaaataaagttcaaaacagacaaaacacgaagaaatggcaaaaacaggtacttgtccttcaagtcgcctgcctgggactcttccaagtctacttttcctctttccggctctaaagcttttttttttttttttgagacagagtctcacactgtcgcctgggttggtgtgcagtggcgcaatcttggctcactgcaacctccacctcccaggttcaaacgattctcctgcctcagcctcctgagtagccaggattacaggtgcccgccaccatggccagctaattttttttttttttttgtatctttagtacagctggggtttcattatgttagccaggctggtctcgaactcttcacctcgtgatccgcccacctcggcctcccaaagtgctgggattacaggcatgagccaccgcacccagcctctaaagctttttaataaacttccactcctgctctggaaaaaaaaaaaaagaaaagaaaaagaaatggaaaaaaacaatatcattcaatgaccactgttttaaatgtcagggattcaacagggaacagagaaacattttgccctcagactttatgtcaccaccaagagagaaagaaactaaaaagtaagtaaaatacaaacagtaacagatggtgaaaagggcttgaaaagaaatgaaacactgagcggggccaaggaaggatgtcttcaggagaggtgacttaaggcttcacttacagagtggcaccggtgtgaggggtgggagtgggatgggacagaacctgtggggcaggagggaagggtatgtgatcagggaacacacactggcctttcaagggcatgggaaaatcccactgttgaagctgggcaggaggtacctaggagtttgctttgttatcaccctctacacgagaacagcaaactatgacccacaggccaatgtggccccacttgtttttgtacaacctgtgagctaaaaatggttttacatcgtatatggttaaagaaactaaaacaatgtttcacggcatgtgaaaattatagaaaattcagatttcagtgtctaaagttttactagacacagccagctcattcctttacatacagcccatggatgctgtagcactgtacagcagagctgagtacttgtgagaggtcacaggtggcctgcaaagcctagaatgtttactgtctagcccttcacgaagaaagtctgctagcccctgacctagggcataactagggacttaaccaaggctgacttgggtgtccttcctccaggttctcagagctcagagcattcttgaagaaggtagagattatctctaccttatattttacacatattcttttgtatttcttcagtttaatcattttttgaaaaagattagcatatttctttcataaatattgctctattaaagctccacgcttcaccaactcaataaaaaaaaaaaaaaaaaaatgactcagttaaaaacagacatgtactgctatcaggaacattaaaccaatacagcaaagcatagcaagctacagtttattttgattcaagtacagttttaagaaaagaaccttccaactaaaggctccaagtctgtggagagtccccaccgccttgcttagctcactggatcattaagatacacattggatcattaagatagatacacactgcatcattaagatagatacgggggctgggtgcggaggctcccgcctgtaatcccaacactttgggaggctgaggcgggcagatcacaaggtcaggagttcgagaccagcctgaccaacatggtgaaaccccatctctactaaaaatacagaaattagccagacatggtggcgggtgcctgtaatcccagctactcaggagactgaggcaggagaatcgcttgaacccgggaggcggaggttgcagtgagccgagatagcaccactgtactccagcctgggcaactgagcaagactcaatctccaaaaaaaaagaaagaaagaaagacacaggacagtcagctgcatcacccactcacagaagaaccttagaaaagcagcagagctatattcaattccttccctatcttttttaaagaaatgcatcatgaattatgtcacattttagcaggagttgtccaatgttagcgtacgttttcagaagcaagttacttcacaacttttaagtatgaaccagtacctttaaagagttaacaatacttattaaataataaccatggctgaaagtggtaatgaataaacagggaattcattacaacattgtttctgtatatgtttgaaaacttctacaaggttttcacattgaagctttgtatttttagttattaaatacgcatttaacagaaaagtcacagaattctcacttgaaagaattctatctttcaaaatccttagtacaaaatatagttttccatcatccttactagtggcaactaaaaaaagaaacaaacagatgcttattttaaaatctaggccgggtgtggtggctcacacctgcaatcccagcactttgggaggccaaggcaggcggatcttctgaggtcaggagtttgagaccagcctggccaacagagcaaaaccctgtctctactaaaaatgcaaaaattagccacacatggtgacaggtgcctgtaatcccagctactcggaaggctgaggcaggagaattgcttgaacccaggaggtgaaggttgcagtgagccaagatcatgcacttcagcctgggcaacagagtaagactccatctcaaaaaaaaaaaaaaaaaaaaaatctttgttaaggctttcatcaatgatctgagaaactgaaacgatattcacctaaaggaatactatgtagttgtattatcttaaagttttccaagtccttgttgaagccccaatacaaacacctacttctttaatgtgtaagaaaagcattataactggtaaacttgtccatgtgcctgccagtctttatgaagacggatggtgtattcctccagtacaagaaggctggttcatcactgtcctagagagagggaagtgaaggaaggaaggaaggaagaaggaaggaaggaaaggaggaaggagggaaggagggagggagagaagaagggagggagggagggaggtgcaattttacaaactgagcaaagatgcagggaagactcagcactttgaaaactggcaaacttttaatgtaaacatttacttttaataactgttacctttcataaagcgtttaataagaccaagcactgccgggcacggtggctcaggcctgtaatcccaacactttgggaggccaaggtgggtggatcacctgaagtcaggagttcaagaccagcctggccaagacggtaaaaccccgtctctactaaaaatacaaatatcagccgggtgtggtggcatgtgcctgtaatcccagctattcgggaggctgaggcagggcaattgcttgaacctgggaggcagaggttgcagtcagccgagatcatgccactccactccagcctggcagcctgggtgacacagcaagactctgtctcaaaaaaaaacaaaaaaaaaagactaagcattacataatcatgtagtacaatcacatgccacacaaggaaatagagattagaaaacttaacaaacaagcccaagatcatagagccaggattctgaccccaactccatgcccttaactaccgcaatcaacagtggttattcaactttcaaactaagactcagtgccaccttgcaacccacactttgaaaaccaatgcctagctactccaagtatggtccacagaccaccagccctggcatcacctgggaacttaggaaaaatgcaagtctgagcccttcccagacagactgaattggaacttaaaatataacgagatccctgggtggcatgtatgcacttaaacgctgagaagccttcatatagtgcctgcacacactctattttgaggtagtttctccaattcaaatacatatcctagaacggttaaagggagctttcatctcttctgcttgctgtgatcccaaaccaaaggtaaacatgtgctggcaagctaccccaggtggcgatgaaaagtggccctaacctttcctccacacccatcctcagtcccactccttcatctttaccgcccctcttgtacagagcctaaaccacagctcaacttactgacttatctgaacccttcctcctcctagagtaatagacaataagggaatgactccactcaacatcccccgagttccttgaaatgtgcccaggaactaccaagcatgaatctagtgcacggttaaattggcagaaagggacagctgggactacttcaggcatgtcctctgaccctaacaactgtggacacataatcaaaagattggtactctgtgagctagaatgagagatcccaacacaactgtaataacattatattaccagttaataggaaatactgtgcaaatggacagaatatcctgacatagcttttcatcttctttttttatttttttatttttgtgagatgcgggtttcagtctgtcactcaggctagagtgcagtggcatgatcataactcactgcagcctcaaccttccgggctcaagcaatactcccacctcagcctcctgagtacctgggactacaggtatgcaccaccatgcccaactaattttgttaaatttttgtagggacaaggtctcactatgatccccaggctggtctcaaactcctagactcaagtgatcctcccgcccaggcctcccaaagtgctcgaattacaggcattgagtcactgtgcctggcctcatgacatttttaaaaatctatggtttcagctacctctcttgatactagaaatcaaatttaagatgcttcaaaccaatctccacacggttctcatcaacatccaggcttttgcccatgtttttcttctccctagaaccttttcccccatccttcccctctccacttggctaattcctctccccacctggctaattcccattgttccctcaagagtgggtgctgtgacacccccgccagaaccccacagtgccctgcaactttgcacagcactatgactgcctaagggcagggatggcagggcaagtgcaatgggagacactgggtctaagacacagatcaacatataataaatgctttcacaaaatttctcagttaaaactgacatatttgtaagttaaaatatcaatacttaatagttatctactcagtgtgccacagattcacatttcaccacctaaatcagtctaagaatctacactgtaccttagggatagatttcacagtaagtctattaaaggaactcaatcatctgtctagctatatagattccaaaaaattcaaactttaaacagcaaggatacccatattagtggttttcaaatgcagatccacgtaccagtgcaagtccctgatgaggttttgatagtcaagccatatctatccactagaactttctgcaatgatgaaaatgttctataccagcgctgcccaatgtagtagccactagccacatgtggctaatgagcacttgaaatgggactagtgtaactgaggaatgggcctttcaacttcgcttaactgtaattaatttcaatttaattggccacatgtggctagcagttaccatatcaaacatcaggttcaggtctagactctggagtgaaataaaaaagaacgcgttttggcttcttaatttcaagcaatgttatttggtccaaccctccttctgaaaaagactaaaagaaaatatggacagaatatttttataatcttaaaagcaaccacaacctgacaagacaagaaataaataacaggcaaaaattgaagtgaaaccaggaagtcaaagagataagcacagaaactacctctgccctcagtgcacttgccaattctgaaaagtctcaactttcatttttaagacagtgcagagagggggagacaggaataaaagactgggtcctccaaaacatataacccaaaaccccactacagtaagcaagaacccaaaaggctacacacctccagagagtaaaccagtaatgaaccaactatccagcagaactagagctatgaggggtccaaacaatctcaagccttgaattcggtttaaggagatcccacactggctgacgcaaaagtaagtgttctctggaggaagcgaccctcattccaggcctcaaaagaatcctacaaatcatttggatccaaatcttataccataaatgaaaattaaatcataaacctaaaagtaaaatctaaaacttctaggagaaaaaaatcagaaaaacctttgtggcctaggatttggcaactcttaaatatgacacatacacaaaaacacaacccgtaaagcaacaaactcataaatgggacatcatcaaaacgtataatttatgctcttcaagccactgttaagaaaatgaaaaagccagccataacctgggagaaaaatatagtatgtatctgataaacaatttatatccagaacatatagagaactctcaaaacccaaaaaaatggaggaaaaaaacacctttttttaaaattttctaagacagagtctcattctgtctcccaggctggagtgcagtgacacaatctcggctgactgcaacctctgccgcccaggttcaagcaattctcccgtctcagcctcctgagtagctggaattacaagcgtccgccaccatgcccagctaatttttgtatttttagtagagatgggttttcgtcatgttggccaggctggtctccaactcttgaccttaagtgatccacctgcctcggcctcccaaagtgctgggattataggcatcagccacggtgcccagctaacaactttaaaatgcataaaagatttaaacacagagatatgcggatggcaaataaccatataagaagatgctcaacactatcagtcatttgggaaacgcaaattaaaaccacaatgaaattccattacacactgaattaaaatggctaaaatgtacaagactgacaataacgagtgttgccctaatgatgcagagcaaccagaactctcatccactgctggtgggaatgcaaaatggtacaaatctagaagatagtttggcactttaagaatttcaacaggccaggtgacgtggctcactcctatgaccccagcactttggaatgccaagactggaggattgcttgagcacaggagtttgacaccagcctgcgaaacatgactagacctcgtctctacaaaaatgtttttttaattagccatgtgtgatggtgagtgcctgtagttccagctactccagcgactgaggtcagaggatcacttgagcctgggaggttgaggctgcagtgagcagtgatcacaccactgcactccagcctggacaacagagtgagaccctgtctcaaaaaaaaaaaaaaaaaaagttaaacatacacctaccatatgattcagccattccagtcctagtccaaccattcccaagagatatgaaagtctacacccatacaaagccttgtacaaaaatattcagagatctataataatccagttctccacgaatagatgtagaccttcaatgtaatcccaaacaacatctggaagaattattttagaagttgacaagtaattctaaaacatatattgatctgcaaaaggtcaagaacagccaaggtactcttgaagaagagacaagtaggaagggttccacaatgagataagacttattataaagctataataacttagacagcttagtgcttgtggaatcaaagaatctaaaaacacagagtctacaagacacccacatggctgggcatggtggctcatgcctgtaatcccagcactttgggaggccaaggcaggcggatcacaaggtcaggagatggagaccatcctggctaacacagtaaaactccatctctactgaaaatacaaaaaaatagcagggcatggtggtgggcgcccgtagccccagctattcgggaggctgaggcaggagaatggcgtgaacccgggaggcggagcctgcagtgagccaagatcgtgccactgcactccagcctgggttgcagagcaagactccatcccaaaaaaaaaaaaaaaaaaaaaaagacacacacgtatacggacaagtgatttacaacaaaggtggcgctgcagagaagtagggaaaaagatactcttttcaataaatggtgttgggataactagatgtccacatattaaaatgaagttgatttaatcccttccttatactatacaccaaaatctattccaagtgaattatacagttaaagataaaatgcaaaattattaaacatttagaaaataacagaggaattacttcacagcctcagggtggggaagacaaaaaaaaggaggaactataaaggaaaagactgataaactggactacattaaacttaacttctgtttatccaaaaaacacttttgaggctgggcacagcggctcacacttgtaattccaacactttgggaagcaaaggcgggaggactggttgagctcaggagtttgagactagcctgggcaacataggaagaccctgtctctaaaaaaaaaaaaaaaaaaaaaaaaaaaatttaaaattagccagcagggtgatacacctgtattcccagctactcaggaggctgagggaggaggattgcttgagcccaagagtaggaggctgcagcgagctatgactgcaccactgcactccagcctgggaaacaaagcaagaccctatctcaaaaaaacaaacaaacaaaaaaactactgagactcagtgaaaccgcatgccacaaagcaggagacactggcaagatatataaaccaacaaaggacttggattctgaatatatacagaagctacaaattaatgaatttaaaaaaaaaaaaagaagacctaatagaaaaatacaggcacttggcaaaacagtaaatgcaaacggccagcaaatttattttaaaaagtgcaacctcggctgggcacggtggctcacacctgtaatcccagcactttgggaggccgaggcgggcggatcacctaaggagaggaattcgggaccaacctgaccaacatacagaaacctcatctctactaaaaatacaaaattagccgggtgtgatggtgcatgcctgtaatcccagctactcaggaggttgaggcaggagaatcgcttgaacccaggaggcggaggttgcggtgagccgaggttgcaccagtgcactccagtctgggcaacaagagcaaaactctttgtctcaaaaaaaaaaaaaaagagcaacctcattataatcagaaaaagagtatttaaaaccacaaggcggtacactatataaaccatcaaaaggggtgcagaggggagacaggttataagagcagagaagaggaaacagtgctgaagtaaccagagaaaatggtcaatgattggagcctaaccttttagtgacaagtaacagaagaatcacttatttactaacatttcctgaaaagctactacaggccaagcactcttaaaagtacatttaatggtcatcgcagaatataactgactataagttataactttaactctccttgaccaatttttttttttttttattttgagacagggtctccctctgtcacccaggttggagtgtagtggtgtgatcatggctcactgtagacttgacctcccaggcacaagcagtcctcccacctcatcctcctgaatagctgggactataggcatgtaccaccacacctggctaattattattattatattctttgggagagacaagatctcaccatgttgaccaggctagtctcaaactcctgggctcaagtgatcctcccaccctggcctcccaaagtgctggggttacaggcgtgagtcaacatgccaggccaacaaattgtctcaagaagaaattgttccaggtcgattttcccaccatctcatttctattatttttgctttcattgagctgcacagttgagtgaaagatcacagtaggaaattcatgtggaaacatccttctcattgtttttagattacattattttaattttgtttatccctactcttcttctctatcttgttaactttcatatacttaaataccctttacaacaaagactatacaataaagtcattttagtctttctaattgcctcccttcagatatttgatctttcctgaaactctttacggggctttcacatatctatattcctcaattatcaacatgctgaaaacccagagaatggacgggagactctttttcactccttacattatttactgaccacctataatgatattatgatcaagctgtgggggactcaaagatacctaacagataatacagaatcctcatctctgagctcacaacattctgtctgccaagttatgcgtctaattctgcataagatataacagatttaagcgacatcaccaacttcatccttgtggactgtctaatttttatttacccttttcttaggagaaaagagcaaaaggcaaaagaatgtattgaatttaggcaataattcaacaccaggaataaaaatcaattcacacaatacagcttcattagttaccccaagacttggcaatcaccctgaccctgttattatatgctagccaatttttcagcaccaaaacaaaaccaccagggagcttgtgccttaagcaccaacatgtacacacactctcctgatatttgccaaaagccacaagtccaggagccatacaaactgctatttcaatgtaaaattgttcattcaaattccaaaccaagattaaaaataattaatcagtattagcataaaacattcaaaatccctaacaaaagcagttttgagatctttccaagattttgaaaatcctaaaaaacatatttagattcctgaagtgagggcaatctccttagcaaatctaagtggtcaagaagacaacatacacatacctcaaattaagactaatttttgcctcctatgacttgcatttctttcaaaacaccctaaagcagtggttcacaaacattagcatgcatcaaagcaccaagatggcaagtttaaaaaccttgcgaggccaggcatggtggctcatgcctgtaaccccaacacttcagaaggccaaggtgggagaactgcttgagcccaggaattcaagaccagccctggcaacatggtaaatacccgtctctacaaagtatgcaaaaatcagctaggcgtagtggcatgcgcctgtagtcccagctactcaggaggatcacctgaggctgggaggtcgaagccgcagtgagctgtgatcgcgcactccagcaagacccggtctcaaagaaaaacaaaacaaaaaaaaatgaaacaacaggccaggcacagtggctcatgcccataatctcagcactttgggaggcagaggtgggcagatcacctgaggtcaggagtttgagaccagcctggccaacatggtgaaaccccgtctctaccaaaaatacaaaaattggccgggtgtggtggtgtgcgcctgtaatcatagctactcaagaggctgaggcaggagaattgcttgaacccgagaggcagaggttgcagtgagccaagactgcgccactgccctccagcctgggcaacagagtgagacttcatctcggaaaaaaaaaaaaaaaaaaatacaaaaattagctgggcgtggtggcatacccctgtagtcccagttacttgggaggcagaagcaggagaattgcttgaaccctagaggtagaggttgcagtgagctgagaaagtgccactgcactccagcctgtgccacagagcaagactccgtctcaaaaacaaaacaaaataaaaaagcttgctgaacaccaccctcagtgtttgattcaagaggccagaggtagggcctcagcacttgcatttctagcaagtttctagatgatagtgatgctacaattccgtcactactctgaaaaccactgaaagcccctggagcttactggaacgtgtgcgtgaacagtgtgaatgagttaccccctcacactatagcaagactatggtggaattcactgagaggcaaactgcaaaatctcagggagagattctgtacccaaatgttgacttccattacctgagtgaatgtattttgaactgtcactttcaaaatgttttatctgaacagcagcacagcagcaaaagactctgaacaaggtcaaggatgagcggcacagtgcataactcacacttcaacattaagaagacgtttgttcttttaaatggtttaggggcataatgttaaacctttgtaaagcatccaattaatccagttgattagcaaaaggtacattagagcttctggatcagtaataaaaacttccatcattttgtgtcacctcaaacaattttccatgtcttcagaacttaggatgagtcccaatcaattcctacaagattgatttctagaaaaaaagttccaaaattatgaaagagcagagcaatatttttttcctggcccaagtctgatagtagtaattttaaatacagtagacaaaggtgaaaaagataactccaagttcttccctggtatcaagccctatgtgagtctgagctcagatgatccgctggcctctgcctcccaaagtgctggaattacaggcatgcgccaccgtgcctggcccctatgtgatttttaagtgacgttctttaccagggcaaacaaaacagtaaacacctggctgatgcaagtaacagttctccaataatcaatacacctgggttctttcatttactcattcaataaatattactgtgtaagacactggtgattcaataatgtataaaacaaagtttatgccctcgtggagcttacattctcacaagacaacacacattttactacaaaatatgtaacacataaaactgttaagctctttcattggaccaacaaagacaaacatatagtgttttggtcaagagagacacagacacaacaagcacctacagttcacagcagaatccaaacccaaaatgcaggaattttaataagaatatgagggcaaaaaagagaccctaggcacagataacccacaaacatgacttttttttcttttttgagacagagtctcactatgtcgcccaggctggagtgcaatggtgcaatctcagctcactgcagcctcgacctcccagactcaagtgatcctcccacctcagcttcccaggtagctgggactacaggcacacgccaccacattcatctaatttttgcatctcttgtagagaccaagttttgccatgttgcccaggctggtcacaaactcctgggctcaagcgatctgtccacctcggcttcccaaagtggtggaattacaggtgtgagttaccgcaccccacccaaaggtatgatttttgtcatttatctgtttctgaaaaaagtgaatttatagtaaagaaaatgtatatcagtaagattcgggtaggatttcaattaaataaaatttaattaaacattgtaaggaaatactttcatgttcttaaaaacatgtaaactttgtagtgatgctactagtgtctctctgaggcttccaactgctaagggggaggacagtgccactaaggcaaaaacaactatttcctgcttttgtctacaaaccatttcattagagtatttatgcaaatcaagctacaattaacagcatttactaaaaagtttttaaaaacttaagatttgcagcaaccctgcatcgagcaagtcatcagtgccatttattcaacagcatgtgctcactttgagtctctgtgctacattttggtaattctcacaatatttcaaactttctcattattattacatctgttgtggtgatctgtgaacagggatctctttttatttttagaggcagggtctcactatgttgcccaggctgatcttgaactcctggcctcaagcaatcctcccaaaacaatggattacagatgtgaaccactgcacctggcctatgatcagtggtcttcgatgttactactgtagttgttttggggggaccatgacctgtacccacatgagatacacatttactctataaacatgtgcattcccactattccacttactgggcccctgtctcttctgctctcctccctctcctgtggcctgctattccctgagatacaaaaatactgcaattagaacaattactaattctataatgggccgaagtgggaggatcatctgaggtcaggagttcaagaccaacctgaccaacatggagaaaccccatctctactaaaaatacaaaattagcctggtgtggtggtacatgcctgtaatcccagctactcaggaggttgagtcaggagaatcgcctgaactgggaggcaaaggctgtggtgagctgagatctcgccattgcactccatcctgggcaacaagagtgaaactctgtctcaaaaaaaaaaaaaaaaggacgggcacgtggctcactcctataatcccagcactttgggaggccgaggtgggtggatcacaagataaggagatcaagaccatcctggccaacatgatgatgaaaccctgtctcaactaaaaatacaaaaaattagccaggcatggtggcacgtgcctgtagtcccagctactccagaggctgacgcaggcgaatcgcttgaacctgggaggcagaggttgcagtgagccgagatcgcaccactgcactccagcctggcgacagagcaagactccgtctcaaaaaaaaaaaaaaaaaagaaaagaaactctataatggcctcaaagtgttcaagtgaaaggaagagtcccgcctatctcactttaaatcgaaagctagaaatgattacgcttagtgagaaaaaacgtcaaaaaccaagatagggccgggcacagtggtgatgcctgtaatcctagcactttgggaaaaggtgggcggattgcctgagctcaggagtttgagaacagcctgcggaacacggcaaaaccccgtctctactaaaaaaacaaacaaacaaaagtagctggccatggtggtgcatgcctgtagtcccagctactcaggaggcagaaggtttcagtgagccaacattgcatcactgcactccagcctggggcacaaagcgagactctgtctcaaaataaataaataaaataaaataaaataaaaaagataggccaaaagcgaggcctcctgtgccaaacagccaagttgtgaatgcaaaggaaaagttattgaaggaaattaaaagtgctacttcagtgaacacgcaaatgataagaaagtaaaacagccttagccgggtgcagtggctcacacctgtaatcccagctactcagtaggccgacacccgagaaccacttcaacccgtgaggcggagggtgcagtcagccaagatcgcgccactgggtgacagagtgagactgtgtctcttaaaacaaaacaaaacaaaacaaaacaaaggaaaagaaaacagccttattgttgatatggagaaagttttagtggtccagatagatcaagccagccataacattcccttgacccaaggcctaacaaggcctaattcagagaaagctcctcctcttcaattctgtaaattgatgtgaggaagctacagaaaagctggaagctagcagaggttggttcgtgaggtggaaggaaaaaagccatctccacagcataaaagtgcaagatgaagcagcaagtgctggtggagaagctgcagcaagttatcgagaagatctagctaagatcactgatgaaggtggctacactaaacacattttaaatgaagaaaccaccttctattggaagatgccatctaggactttcatagccagagagatgaagccaatgcctggctttaaagcttcaaaggatgggctgactctcgttaggggctaaggcagctggtgatctcaagttgaagccaatgctcgtttcccattctgaaaatcccagggtccttaagaacgatgctaattctactctgcctgtgctctacaaatggaataacaaagcctggatgatagcatatctgtttacagcatgttttactgaatattttaagcccactgttgagatctactgctcagaaaaagattcctatcaaaatattactgttcattggccaagtacctgttgtccaagagctctgagagagatgtacaaagagatcaatgaggttttcatgcttgttaacaccacatccattctacagcccatagattaagaagacattttgacttttaagtcttaaatatatttcataagggtatagctgccatagatagtgattcctctgatagatctgggctaagtacatagaaaacatgctggaaaggattcaccattctagatgccattaacattcatgacacattggaggaggtgaaaatagcattatgaacaggagtttggaagaacttgcttccaaccgtcatggataactctgagggattcacgacttcagtagagaaagtaaatgcagatatggtagaaatagcaagagaactagaattagaagtggaacctgatgatgtgactgaattgctgcaatctcatgataaaacttgaacggataaggagttccttcttagggatgagcaaagaaagtggtttcctgaaatggaatctacccctggtgaagatgctgtgaacattgttgaaatgacaacaaaggatctagaatattgcatacactgattgataaagcaatggcagtgtttaggagtattgagtccaattttgaaagaagttctactgtggataaaatgctttcaaatagcatcacatactctggagaaatctttaatgaaagaacgagccaactgatgtggcaaacctaattgttgtcttattttaagaaactgcctgacatctcagccttcagcaaccaccaccctgatttgtcagcagccatcaccactgagggaagaccatccaccagcaaaaagattatgacttgctgaaggctcagatgatcaacagtatttgactacgtcatgtacattagctgggcacagtgactcatgcctgtaatcccagcactttgggaggccaaggtgggaggatcacttgagcccaggagttcacgaccaacttgtgcaacatagggagaccccatctctacgaaaaatgtaaaaattagctgggagtagtggtatgcacgtatagtgccagctactcaggaggctgaggtgggaggatcacttgagcccaggaggaccaggttgcagtgagctatgattgcaccactgcactccagcctgggtgacagaacaagaccttgtctcaaaaaaaagaaatgtacattgcttttttagacatgttactgcacacttactatagtgtaaacctaacttttatatgcactgggaaaccaatttgtgtgactcattttatcgcagtggtctagaaacagaccaagatatgcctatactacaggaactaaacttctcagatgtttttcaccagcaaaaaagaaaaattcacttcaaatatgatacaaacagtataacttttaatgttactgaaatttaaaacaagaattgatctaggtctaaatctacatcagtttagaatgcctaaactgaaaatgttaaatttcaaaactgaaactttataaacactttgaaatgcatcttttgtaactcaagataattttaattattttctaaaaattaagacatcataaaatacaaggggaaaaaggtttccataacctttagagatatgaactaagatcctacctctctaactcaaatcaacattcaggaaaggacagttttcaaaattattttttacattatagaatacaatataaataatttcatctacaggacctaatcttttttttttaaagaggctacctttaaaacaacaggatcttcaggccaggcgcagtggctcacgcctgtaatcccagcactttgggaggccaaggtgggcggatcatgaggtcaggagatcgagaccaccctggctaacacggcgaaaccccgtctctactaaaaaatacaaaaaattagccgggcgtggtggcgggcgcctgtagtcccagctacttgggaggctgaagcaggagaatggcatgaacccgggcagtggagcttgcagtgagccgagatcgcaccactgcactccagcctgggccacagggtgagactccgtctcaaaaaaaaaaaaaaaaaaactattttcttagacaatttctccaactccctagaaagaacagttatctgactagctggagaacatgattttgaggactgagggagtaagttatgtaatttccatcaagaagcatggtgcttttcagaaaacattttagtataaaacgttttaatgatcctcactgcctcctcacaatttcactgctggattcatggaacttcactcctaatctaacattattcactttcaatgggcttccagcctcaaataataaggctttttaagtcccatctcctctcagagtttgccccagtattctttgccccaaaccgtaaacatggagttttgatttccatgtctttatttaaccaatgacttgcttcttgatgcatcaccactgaatgatgtatgggtccttctaatcagcgtctacactgaagtcttaggtgattgtcggctcccttataaaggaagcatgtgttttaaataatctgtgcctgtgttcattattaaactagattatttgatagtgacctgaaattctttaaaggaaaaccttgtaatattgatcttgttgtttctgcagtttaataaacaagaaggttcaaaatgatggtaggttcagcctgtttttccccaccaaggataaccacaaatacaaaacacaaagatattgggacacaaacatccttaaaatgttccttgtttgaatatcatagggcttttctaattaattggctagtataactggatgaaaatattatctatactgtaccccaacaaaaatacgttgaatgctagtttacttttatgtgtcttgtaactagttcatccgtgtgcttgcatcgcactgctcataagttttcaaatatgggacggagtgctcaactctcgaagacatcattttcattacccgtttcccaaataaaatattaaggttgaggctctggtatttcatttcaaatagtactggtctgtttttccagccatgaaaacgtttacattctaagtaaaaatcctagcgatggttaagtcttaaatacaaatccccaaactcttgcactgccttcagctttcagcttgaatgtataaccagttcccataattactacaatattactattatcttagtctcattgccaaaaacccagctgcaggctaactatgcaagaatgagacactgttgaaatgactcggaaaaaaaaaaaaaaagaaactttaccctcactgaatttagctacaaaattctgcaattaaatgaaaccaattcacacacacacacacacacacacacacacacacacacaccccttcttctaagaaagaacaggatgccgctacacaaggaacccagagagaaattcggcaaacagttgcgcctaagccaccgcggcagagtcgggggctgggggcggggaagaggagaaaacttgggaagcacaatgactccagtgaggacttcagtgagggctccagggctcccgccaagaagcccacggggctctaccaaacttgagggtttgcgttcggggacacggcgggcttggggctcgggcaccggcaggccgctcggagcccacccttggctgcccgcgaggccgcgcccgggggacggaggtcgggccgtcgcgagcctccctctcgcgtccgggcgaaccctgccgacgtccctgcgatttccctcttcctcctcctgcctctccccttttgtttttcaggcattgggtccgctccggcggaggccggcccgtcctccccgcgcctctgtccgccctgcgcgcccccagagccccggcctcctcgtcttcctcaggcccctcggcctctccgcgcgcccggccttttcgaaagccgccccccccttcctcctcacgtctcccggactccccacgtcccccagcctttctgtcttccccgaaccccttggcctccccgcgcgcccccaaaacccccgacctcctcgagctcccggcctccccacgtccctcagcctcccagtcttccccaagcctcccgaccacccagcgccccgaacccccgcctcccagcgcgccccctgacctccttaagcctctcggcctccgcgagggcccccaacctcctcacggccaccggcctcccctcctcccagaacccgggccgggggcgcgggaggggccggtctccgccgcatccgccccgggactggttgggcggccccgctctgcccctccgccctcagggccgcggcccagcccacgaccgctgcacagaaggagcccgcccagcccccgacccgcgccccgcgcccggcgccccgcactcactcggaccgcggctcggcgccgtgaagcgaaggcagacgacgacggggcggcgctgggcgacagcagccgcgcttcctcccacgcctcacgccgcgggctcacagtggtccgggaccggcggcggcggcggcggcgcgggctcgcgccctcgaggccgtgctgcgtcggcgcgggcccgcgcgcgtgcgc

SEQ ID NO: 78 - DNA, 342932 bp, Homo sapiens; identical to SEQ ID NO: 77

SEQ ID NO: 79 - DNA, 342932 bp, Homo sapiens; identical to SEQ ID NO: 77

SEQ ID NO: 80 - DNA, 47554 bp, Homo sapiens
gggtaaagctcctcggcctcggcgtgctgcgcctccgcggctgccctgcgccaggtgagggctcgcggctcccggctgcggctcccggcgcgtggtggcgggctcggggcgtgcgtcgcggagaggacggggccggcgggcggttggcgctccgttcggtgcggggaggggcgtcacgccgggcgctgcgcggcctcggcgggcggcggcagcggcggccacggccgccgggctctcgggttgtctgtccccagttggagccggccggtgtcccggcggagagacgggcagtcgggttccctggcctcggggccaccccggctggggcggctggggcagagggacgatgtctactcgcgccccgatgcccgccgcccattctcgggaggatccgcccgcggtgactgctgagagggagtcgctgttggccgcggcgaaccggccggccgagcagccgcccccgcccgaatgtgagggcaaagaggcggcgagggaggagagggccgcggccgccactagcgctggggcgcggggagagccgtcgccggcgctggtgctgggacgcagcgtgccccaggcggctgtccccgtgaggcccctggcgctgcacctggcgcacaaggcgcgtgggcccgggggccctttcggcggggagccgccaccgccaccgccgccgccgtcgccgttgccgccgttgctgcgggatccgccggccgaggacgcccgggaagaggtggcagctggccctgcggaaaagcggcagccgccgctgctgccgcctaagggaaatccctggaccaaaaagcctccccagcacctgtccccagacacgacaggtccgccaccgcccccgctggaaaccctggaggcaggtctgtggttgctctgcgttgggcactggcagggtgcgggcaggggcgacttgcgggacttgccggcgcgtggcggcggtagcgggcaccaggcccgggtaacggcaggcctcccctccctgtcagtcggaggtaatttgttccaaggtgtcattcactctgcctatttacagacatgggcatctgggaagggagcggcaggaagaggtgggacctcaggttctccttgcctgatgggggcacggaggtggtagcttggcggcgcatccctgctggcgcggttgcgattgtgttttgtccccagtgttagtgacttgggaaagtagctaactttagatactgcagtgcttcgtatgggaaagttttggtagacttttttttttttttttttacataaaaggattgaagcaagtcagagcaaggggatttattcgtaagtggaagcgcgattgtagtcttttgtgaaataagatgaaaaaaggttttcaaaacactgctgagcagtcatattaaaaatgagactttaaatgtggtttttaaagtgctttatggggggaggggggagggatagcattaggagatatacctaatgttaaatgacgagttgatgggtgcagcacaccaacatggctgcacatgtatacatgtgtaacctgcacgttgtgcacatgtaccctaaaactttaagtataattaaaaaaaataaagtgctttaagttataagtgtgctggaaaataattgaaataggatagttgacatgcgagcgtggattgcacgttaggtaaatggttttctaacattgtcagctctccttccctttagaggagataagattatgccactatatttgaatgctgaccaatgctgtatggccgtcggtgctttattttgattgtagtaactgcaacttaagaaagtaaaaatgggccggcgcggtggctcacgcctgtaatcccagcactttgggaggccgaggcgggcggatcacctgaggtgaggagttcgagaccaggctggccaatatggcgaaaccccgtctctactagaaatacgatcattagccaggcgtggtggcgggcgcctgtaatctcacctacttgagaggctgaggcagggagaatcgcttgaacccgggaggtggaggttgcagtgagccgagatcgcgccactgcactccagcctggtcggcagagtgagacccactctcaaaaaaaaaaaaaaaaaaaaaaaaaaaaaagttaaaatggaaataaaaaccatgacaaaaagcagtatctggccgggcgcggtggctcacgcctgtaatcccagcactttgggaggccgaggcaggtggatcacctgaggtcaggagttcaagaccatcctgactaacatggagaaaccttgtctgtactataaatacaaaattaacctggcgtggtggcgcatgcctgtaatcccggctactggggaggctgaggcaggagaatcgcttgaacccgggaggcagaggttgcagtgagccgagatcgcgccactgcactccagcctgggcaacaggagcgaaactccgtctcaaaaaaaaacacaaaaaaacaaaaccgtatctttctaaattaagttgtaaatgacttgaactttttatatgcaaatgacagctgtttacttgcaagtcttcatttttatttaaaattaaaggttagcagcagaacaagaaatatttgagcgtgtttactggcttgtgaggatcaaatgcgatgaagaggtggtataaatgtaaggcgattggctgtgcgcggtggcacacgcctgtaatcccagcactttgggaggccgaggcgggtggatcacctgaggtcaggagttcgagatcagcctggccaacatggcgaaaccccgtctctactaaaaatacaaaaattagccggatatggtggtgcgtgcctgtaataccagctactcaggaggttgaggcaggagaatcgcttgaacccgggagacggaggttgcagtgagccaagactgagccactgtattccagcctgggtgacagagcaagactcagtctcaaaaaaaaaaaaaaaaaaagtacggtgattgttacaagcacccattatgttatgttaacatttcttcagaggaactctccaaagagggagatatgtgttgagttaattcattcatttgcctttgcacagaaatactcctcattaattgttgataaattttgacacttgcagaaaaaaagtttgctctggatttaatattggcataattccttcctcgctataaagagctgtttgtttactcctattactaactaaagagaacatggttaagtgaagacctcataaagtttttcttttttttcttttttaaagcccagtggcaagcactctaaaatttagcaaagaaagaaaaccctagtgaatcatcttatttgctgtttcacctctctacttctagacttacagacaattaagtgaattaccaagtaggaactctttgttgatcataaaaccagtatcatagattttaaaacttcgaagccatacatggtagtgtgtgcctgtagttttagctccctgggaggctgaggcaggaaaaatcagttttgcccaggagtttgaggctgtagtgtcctgtcatagtgcctgtgaatagccactgcattctagcctgggcaatatagcaagaccacgtttaaaataataatattaataataataataatgataatagaactttaaaaactgtcaaggtaagccttgggaactttaattgcaaatgacctgtgaaaaatatttaacagttaagctattggtgccttcattctccagtcttcactggagattaagaacactgtgatactagttgtatggtatggttcatggaaatttcagttttgctgttgtcttgtgtaggcaactctttctgtctttggatggaatccattctgcactggcaggaagaccatctttcagacctggcatagtgtagtaaccatggtctcttcccaacactgactctgcactgttctcccacaattaatttctttctttctttctttctttctttctttctttctttctttctttctttctttctttctttctctctctctctctctttcctttcttttcttttcttttcttttcttttcttttcttttcttttctttcttttttcaagagatggagtctctctgtgtttcccaggctggtcttgaactgctggcctcaggcgatcctcctgcttcccaaagtgcagggattacagacataatcaggctttctattttcttaagcaaatttacaacttcaggagtaaagaaacaggaccacagtctatttgcagttaaataacttaggtaacttagataaaagagattgtggtgtagaaacatactgttttgagagacttgggttctagtgcaggtattgttactaactggctagttgacttctggcaagatttctgggcattataaatgaataacatggatagactcatttcctctggttcataataccagagtgccacttataacctggctgccttggcttccatttatatatttatttaatattatttaattcatttaaataaatacattttacattagtttatttaaataggtagatagattgtcagtcttgctctattgcagtggtgagatcatagctcactgcagccttgacctcctggactcaagcaattcccctgccttggcatcccaagtagttgggatgacaggcacgcatgtcattccatggaattagccatgcccggctagttatttttaatttttttttgtagagacaggggccccctttgttgtccaggctggtcttgagctcttggggtcaagctatcctgcctcagcccccacaaagtgctgggactacaggtgtaagccaccctgcctggcggctttctattgtctattttctttctttcttctttttttttttttttttttttgttatattgagacagagtctcgctctgtcgcccaggctggagtgcagtggtgcaatctctgctcactgcaagctccgcctcccgggttcacactgttctcctgcctcaacctcctgagtagctgggactacaggcgcctgccaccatgcccggctgattttttgtattattttagtagagacgggatttcaccatcttagccaggatggtctcgatctgctgacctcgtgatccgccggcctcggcctcccaaagtgctaggattacaagcgtgagccactgcgcccggcctttttttttttttttttgagatggagtttcattcttgttgcccaggccggagtgcaatggtgtgatctctgctcaccgcaacctccacctcctgggttcccccgattctcctgcctcagccagccaagtagctgggataacaggcaagcggcaccatgcctggctaatttttatatttttagtacaggcagggtttctctatgttggtcaggctggtctcgacttcctgacctcaggtgatcctcccacctccacctcccaaagtgctgggatacaggtgtgaaccaccgtgcctggccgggctttctattttcttgccatttttttttttttttttgagacagagtcttgctctgtcacccaggcaggagtgcaatggcgcgatcttggctcactgcaaccccccacctcccaggttcgagcaattctcctgcctcagtctcctgagtagctgggactacaggcgcgcgcaaccatggttgcccggctaattatttttttttaatttttactagagatggggttttaccacgttggccaggctggtctcgagctcctgacctcagttgatgcgcccgcttcggcctcccaaagtgctgggattacaggggtgagccaccatggttgacctcaggctattttcttaagcaaatttgcaacttaagaagtaaagaaataggaccagaagttgtttaaagttcacagtgggtacctctaaatctattagttatctattagtgattgtataatttatactatataaattgtataattctacaaaacaggatgctctttgagagagagaattgtattgaaataacagacttaaatcaggtctatcctgctcaaacttggatttactgttactctgttaatgaggtaaaggaattccatccacagaattttgccaggaagtttattactacagttagaaacataggaaacacaggggagaatatttcaggacagaaattatgaattttctctacattacaacctgcacatctaagtgaaccagattcttgatgcctcggcccttgtgagaaattttcttccacttttaggatgattttgatcatgtgttgctgtttctagaaatccagatgaggcactcttcagccaaagttgctgcccacccaagaggccttttatcttgaaatttagtcatgagaccagaaggaacttctcccatctgtgtcctgacttggtattagttttattttggatacctcctttttttttttttctttttttgagatggcgccttgctctcgtcgctcaagctggagtgcaatggagcaatctcattgcaacctccatctcccgtgttcaagcgattcttctgcttcagccttccgagtagctaggattacaggcgctcgccaccatgcctgcataatttttgtttttgtttttgttttgagatggagtctcgctttgccacccaggctggactgcagtggcacaatctcggctcactgcaagctccgcctcccgggttcacgccattctcctgcctcagcctcccgagtagctgggactacaggcgcccgccaccttgcccggctaattttttgcatttttagtagagacggggtttcaccacgttagccaggatggtctcgatctcctgacctcgtgatccacccgcctcggcctcccaaagtgctgggattataggcgtgagccactgcgcccggccaataatttttgtatatttagtagagatggggtgtcaccatgttggccaggctgatcttgaattctggacctcagatgattgacccaccttggcctcccaaagtgatgggattgcagacatgagccaccacacccggcttttttttttttttaagagaccgagtctcactttgtcacccaggctagcgtaggagtacagtgacacaatcatagctcactgcagcctagaactcctgggcccaagggatcctcctgcctcagcttctcaagtagctaggactacaggcatgtgccaccatgcctggcaaattattttatttttgttttttaaatttaaaaatagagacagtatcttgccatgttgcctaggctggtctcagaactcttgaactcaagctatttttattttttttttgagacagggtctcactatattgcccaggcccagtcttgaattcttggcggcctcaaaggattccctgcctcagcctcccaaagtgctgctattacaggtgtgagcctggcctggcagattcctttttttccctcttttaaataatttattttaaacctattatatcacacagtatgttttatacactgacatataaccccctaacaagataaagcaaagacaaaaaagtttatcttattagaaggaagatacaccatcacttattctcttcaagcattattgcactttaacttttcttaacttgacaaagcattcatgaagcagtctgcagactagttttaacagataaataatacctgtaagcagacatgattgtcctaaattgtttattaggtatgaattttacaaactttacttatattggctgtaacggtggagctggagagtattgcgccttctccaagctccctggtgagaaccaccaatagtgtggtggcacttaaggccctttccaaggctatggctctttcggcctgcagatggcagcccatgcatcttcctatgcttgtggactggtttggtgatccattgggtgtcaggatttcttctgatagctttatggaatggatcaatgaggataacctcaaaaaacttgtatgtggaatcttcaccaacccagtgagaattcaggacttttagagccccacagtggcatccagcttgccgctttgcaatggactgaagactttgagcaaactttagctggttaacaccatgatggacaggcttgccataagttgcacccttaggaactgggtgctttcggccaccatggcgaacacgaatcctatatataacataaacttggttggccttgtagcccagctggtgcgctttatcaagccagatggggtggggagccctgtggagagcagagagctggtggtactgccagcaaccaactctcagaagaaagtgcattttctccatagctcctggatttacttgtatgcccccatcttggcttacctgatggctgctgctagacagaaggggcacggattcttttattaaaatcacaatatgggtttattaatcccttacttgtatttatggttgttttttgcctattaaacatcagcattctagtataatttccattcttttactcataacaatatgatgtttaaaaaatactgatttttttctgtcttttttattcttatttttctcgaaccctatgttcatcatcaacctcttttctcctactatttggttcatcaaccttattttctcctgtttggttcctagaaacctcaagtaagcttactgttgttaccctaatgaaataccattttaagtaagttatatagaaaaaatgcataaatatattctccttacaaaaatgaaaaactttgatgtcatcttaagataatttactgaggccgagcgcagtggctcacacccgtaatcccagcactttgggaggctgaggtgggcggatcatgaggtcgggaaatcgagaccatcctgtctaacacggtgaaaccctgtctctactaaaaatacaaaaaaaattagctgggcgtggtggcaggcacctgtagtcccagctacttgggaggctgaggcagcagaatggggtgaagccgggaggcggagcttgcagtgagcagagattgcaccactgcactccagcctgggtgacagagtgagactccgtctcaaaaaaaaaaagaagataatttactaaatctaaactccttttaaaaattgctgaggactgcccgggcacggtggctcatgcctgcaatccgagcactttgggaggctgaagtaggcagatcacctgaggtcaggagttcgagaccagcctggccaacatggtgaaaccctctctctactaaaaatacaaaaatcagctgagtgtggtggctggcacctgtaatcccagctacttgggaggctgaggtgggagaattgcttgaacccgggaggcggaggttgcactgagccaagatggtgccattgcatttcagcctgggcaacgagtgaaattccgtctcaaaaagaaaaaaggcttaggatgaccggctgtagtggctcatacctgtaatcctaacactctgggagaccaaggtgaccggggtttgaggacaggaatttgagatcagcctgggcaacatagtgaaaccctatctcaattaaaaaaaaaaatagctaaggagtggtcctaaatatggctgacatagttgatttagagatttacctgttgattatcttgatttttttcatttttgtatctagaagaaactgaacatttttatacatatgtcttatatccatgtgtgcctttctctagggtagatgctgagaagtagaattgttaggttatagggcattttttaagtttatgagtcactttttatttatttattttttaatgtttttatttttattttttattttttgagacagagtctcgctctgtcgcccaggctggagtgcagtggcgtgatcttggctcactgcaagctccacctcctgggttcatgccattctcctgccttagcctcctgagtagctgggactacaggcgcccgccaccacacccagctaattttttgtatttttaatggagacggagtttcactgtgttagccaggatggtctcgatctcctgacctcgtgatccgccacctcggcctcccaaagtgctgggattacaggcgtgagccaccgcactggcctttacaagttgctttttaaagtaactgtataaactgatactcccactattagagtttgagaattgtcttctttcacaattttttttttttttttttttgagacagtctcactctgtcgccaaggctggagggcagtggcactgtgtcggctcactgcaacctccgtctcctgggttcaagcaattcttctgcctcagcctcccgagtagctgggattacaggcgtctaccaccacgcccagttagtttttatatttttagtagagatggggtttcaccatgttggccaggctggtcttgaactcctgacctcaggtgatccacctgcctcagcctcccaaagtgctgggattacaggcatgagccaccgcgcctggccattctttcacattttaaaaagcactaatttttaccacattttcccttaaatatgataagatgtgaaatattgatatcatcagtgcattttcttaattaaaattttgccaaaagattatggtcataagaattaagctgagtgaaataggctctgctgtgttgtagcttttgtttaaagtatcctagcccttaaaaatatattattttctttaactatttacagttatttccttgtaggtcccagggtttaaggataacgttttattatttatttatttttactttatttatttatttgagatggagtctcgctctgttcctcaggctggagtgtggtggtgcgatctcggctcactgcaacctctacctcctgggttcaagcgattctcgtgcctcagcctccagagtagctaggataacaggcacccgctgctatgcctggctaatttttgtgttttttagtagagacggggttttgccatgttggccaggctgctctcaaactcctgacctcaggtaatctgcctgcgttggcctcccaaagtggtgggattataggcgtgagccactgtgcccggcctaagagtaacattttaaagatagtgaaataatgctcaaaaaagatgtactggtatatagtgtctgtcttactaatgatgtttgaaaaatggagatatgttttaaatttttaaatttaaaacaatttcctcaactggcttgctatttcagtcttaggtgttctctaatgacatgcagcatgatttcctccatgttaaaacatgagaaaatgaaaaatttcctttcttaggcttcttttacttgtaatctgtacgtatatataatttttttttttttaatcagagtctcactctgttgcccaggctggagtgcagtggtgcagtctcggctcactgcaactttcacctcctggattcaagtgattctcctgcctcagcctcctaagtagctgggattacaggcatgcgccaccacacctggttaatttttgtttttttagtagagatggggtttcgtcattttggccaggctggtcttgaactcctggcctcaagagatctgcctgccttggcctcccaaagctgtttggattacaggtgtgagccactgagcctggcctgtatatataaaattatatttaaaacctggtggacttctttccatgtcaatacatatacagctttgtctgatttctaaaagttatatagtattctgtgtattattacgtagagactgtttaaataggattatcaacaaagttgcactgaacatcctatatggacatctttgtaccttttcttgattcctagataatttcctgaaaatggaattcttttattaaaagttatatacattttagatgacagattacccttgaaagatatactaccttggctgggcgccgtggctcatgcctgtaatcctggcactttgggaggccgaggtgggcggattacttgaggtcaggagtttgagaccagcctggctaaaatggtgaaaccctgtctctcctaaaaatacaaaaaaattagccaggcatggtggcaggcgcctgtaatcccagctgcttgggaggctgaggcaggagaatggcttgaaccccggagggggaggttgcagtgagccaagattgcgccactgcactccagcctgggcgacagagtgagaagattccgtctcaaaaaaaaaaaaaaaaaaaaaaaaaaaaagaaagaaagaaagaaatactacctcatactcttaccaacagcaaacagcatgagagaaataaagagactctgtctcaaaaaaaaaaaagttgtatttgtaattttctcctgttatattgttgtcgtttttttttttttttttttttttttttttttttttttggacagagtctagctctgtcgccccagctggagtgcagtggtgcaatctaggctcactgcaacctccacctcccaggttcaagcgattctcctgcctcagccttctgagtagctgggactatgggcatgtgctaccacactgggctaatttttctatttttagtagagatggggtttcaccatgttggccaggctggtctcaaactcctgactccagtgatccgcccatcttggcctcccgaagtgctgggattacaggtgtgagccaccaggcccagcctatattctgttaatgagaggattgttctgtcagttcagtgtaatacgctgtgtttttttttgttttttgtggtggagttttgctcttgttgcccaggctggagtggaatggcaagatctcagcttaccgcatcctctgcctcccaggttcaagcgattctcctgcctcagcctcctgagtatctgggattacaggcatgtgccactgtgcccggctgattttgtatttttagtagagacggggtttctccatgttggtcaggccggtctcgaactcctgacctcaggtgatccacccacctcggcctcccaaagtgctgggattacaggcgtgagccaccccgcccggcaacactgttaatatttcttacttcttgatttggagactgaagatcaccttgaatctatgtgtcaaatggggttgattttttgctaggaatttaagtctcagaaccttggattttggttggaaatgatgattatactgatttactgaaattgacataatagttattttgttgaatttattgaatgaagtagttgtaaaaacaattctatatattttctttagaattcggttccctcaaaattataaaggcaggaaagctcaagacaaagaaatccaacaaggtatgtcttcataggaaatagttcttaactgtattgatttttgaaaattgaggctaagaactcttaggttattataagtgtatttttcttctaattgtattattggtattagattaaagttaatattatggaaaatcataacctttatccaaatctctatatatgcctttgttatcatgtataactcaatttaatgttattaaatagtggtgaaagttttatcataagattaagccattcttatttcaaaatgttctattgtttgcagaaactttttgattaatttggcagatgcctgcatataactgaatataaatgattatttaaaactcctttcacttttagaaaatgtttttttcctgcttaaaatttctaaaagtaatttcagacctaacacttatttgttacttcttaggctagtgatttcagtgatatggagaattggccaacaccaagtgaattagtgaacactggagtgagtattgttttaaagtttttttttttaaagaaaggaaaatgtattcatttcgacatgcagaattttattttacttaaaatgtaaagaattgtcatactgggggacagattttttttatttttttgagacagggtcttgctctgtctccaggctggagtgcagtggtgtgatcacagctcattgtagcctcaaactgctaggctcaggtgatcttcctacctcgacctccagagtagctgggactacaggcacgcaccactgtgcacagctaatttttgtatttttcatagagacaggattttgctggtctccaactcctgagctcaagtgatcctcctgcctcagcctcccaaaatgttgagattacagtatgagctaccattctggctgaggaacagatttaaaaacttgattcatcaagaagattacattttgttactttaatttgcagttattcttcgatgctgccagtaacattggtaatgaacttgttgtcttaagctttactcatgggaagcttaacctaacctattatttctttctttcttttctttttttttttttcctttgagatagggtctcactccattacccaggctggagtgcagtgatgtgatcacagctcactgcagccttggccttccaggctcaggtgatcctccacctttgcctcccaagtgactgggactacaggtgtgtgccaccacactgggagatttttaaactttttgtagagatgggggtttggtcatgttgcccaggctggtatcaaactcctgagctcaagcaattggctcgcctcagcctcccaaagtgctgggattataggcgttagccaccatacctcgcctattatttctttaataatgaagacatattataaattgtaatcaaatttttatatttgtataaaatcacatacattgataaagaggtgctgaaaacgtggcagctatccttttgatagtttacccgcttttcagataacctaatttaattcatcacatttccctcatctggttatattctttttttgagacagagtcttggtctgtcgcccaggctggagtacagtggtgggatttcagctcactgcaacctccgcctcccgggtttaagtgattctcctgcctcagcctcctgagtagctggtattacaggcacgcaccaccacatctggctaatttttgtatttttagtagagacagggtttcgccatgttggtctcgaactcctgacctcaggtgatccacccaccttggcctcccaaagtgctgggattacaggcgtgagccactgcgcccagcctcatctcgttgtattcttaagaggtaatcttatatttgagatttgcattttctagaattttatatatgtggaagcattgagtaggtactcttttttttcctggcttgtactcagcattattttgagatttacttgtgtgtcagcagttcattcttttttcttactgagtagtatggatgtaacacagtttgtccattcacctattgttaatggacatttggattaattttacgttttggttgatacaaataaaactgctatatgaacgtttgtgtagaaaatttttcattttttcttggatatgtaactaggttggatcacttagtagctacctgttttagctttttaagaaactgctgagtttgcacttctatcagcagtgtacatgaattccagttactccacatcttcactcactctcttttttgtgtgtgtgtgtgagaccgggtctcactttgtcacccaggctggagtacagtggcatgatctcagctcattgcagtcttgacctcctgggctcaagtgacccccccacctcagccccataagtagctgcgactataggcatgcaccaccacgcctggctaatttttttgtattttttgtagagatggggtttcgtcatgtgcccaggctggtctcaaactcctgagctcaagtgatctacctgccttggcttcccaaagtgctaggattacaggtgtgagccaccgaacccatctttactcaccgataatatggtcaagtttcaaaaaatattttagccattctaataaatgaggagtggtatcccattgcagttttaatttgcatttttctgatgaatgaatgcaataatcttttcatagatttgccatcagtgtatctttttgatgaagtatgtgatcaatctgcccatttaaaaaaatggaaggctgggtgcaatgggtcatgcgtgtatcgcagcactttgggaggctgaggacggtgaatcatttggggttaggagttcgagaccagcctgaccaacatggcgaaaccccctctctacttaaaaaaaaaaaagagttagccaggtgtggtgacatgtgcctgtaataccagctactagggaggctgaggcaggataattgcttgaacccaggaggtggaggctgcagtgagccgagatcgtgccactgcactccagcctgggcaacaaagtgagactctgtcctcccgcccccgcccctgcaaaaaaaaaaagtggtattgatttgttgttactgagttttgaaagttcatatgtatttgaggtaaaagttctttatcaaatacttagcaaatactttctcctagtctgcagctttacttttaactgtcttttgaaaagtaattttttgcctttgataacagtttttgtcatttgttttgcaattttaggttaggtatattgccacaaatttttgggtatgttagtgaaaatattaatggaaatcatttcattctgaaaacctttttgcagtttcagagcgtcctcagccaaggaaataaaaagccacaaaatagaaaagaaaaagaagagaaggttgaaaagagaagtaacagtgacagcaaagaaaaccgggaaacaaaattaaatggtcctggtgaaaacgtcagtgaggatgaggctcagtcaagtaatcaacgtaagagaggtcagtttgtccatatctttattttgattttagtttttgaagaaagttgtaatgaggaattacatttcattaactgatctctggtagtcaaaaatgtatagtttgtatttcttcaggataaacaatctgcagaggtaactcatttgcttttgtaacatttctgaactattagactttcctttttgtatgtaacttgtattctatgcaagaaaatggaatggagttccacttagaggtacagttgtagatacattcttggaaagttgtgtgataattattgttcttttagatctgcattggaactgctccctatatttagggagtactgtgaaaattaaatacatttttttcctaagagaaaagtgagaataggctgggcgcagtggctcacacctgtaatcctagcactctgggaggctgaggcaggcggaccacttgaggtcaggagacatggtgaaaccctgtctccactaaaaatacacaaaaaaattagccgaacatcgtgttgcgcacttgtagtcccagctactcgggaggctgaggcaggagaattgcttgaacccaggaggtggaggttgcagtgagccgaggtcgcgccattgcactccagcctgggcggcagtgcaagactgtctcaaaaaaaaaaaaaagtgagaataattttagtcaatcttttccctcatagcattcccctgtcaaaattacactttgaaggaatgaaaatattgtcttcatatccttttccattttcttttctgaacttttcgtgtgtctagggacagtttatgatttacatgctttgtaaatcagtgctcggagtcttcgtaaaagtgtcttcaggcgcttctaggcagaaaagggctttaaactgttaagttgtcagtgactgaagcaaggtgattttctgggagagtagcaggaggtgaggttagagacatagatagacaacgtccatggtatacagggccttggagttatgattccattttgaataccatgggaaaccattgaaccaagattctctggaggtgatatggcatgggagggaacatttaatggtaaagttgttgccaacttctttaacactttaacttttaccgtagactgatcacttacttgaatagtttgtcttttttttttttttttttaagagacagagtcttgctctgtcacccaggctggagtgcagtggcccagtcttgactcactgcaacctctgcctcccgggttctaggaattcttctgcctcagcctcctgagtagctgggattacaggcccatgctaccatgcccagctaactttttgtattttagtagagacggggtttcactgtgttgcccaggctggtcttgaaatcctgagctcaggcgatccacctgcctcggcctcccaaagtgctaggattacaggcatgagccaccgggcctggccgaatagtttgtctttttaataaataactaatccttagtgcaggatgagcattatattcacttgatacaatgaataaaggctaattgctcaaaaacagtgacaacaagacaaacaagtggttgttagaaaaatttcttcctgtttctttttttttaatttttaaatttaaaaatgtttttaaaattttgaaacagggtcttgctctgtcacccaggctggagttcagtggcatgctcgtggcccactgcagcctcgatgacctgggctcaagtgatcctcccacctcagcctcctgagtagctgggactacaggcatgtgccaccatgcctggctaatttttgtatttttttgtagagacagggttttgccatgttggccaggctggtcttgaactcctgggctcaagcgatccatctgcctcagcctcccaaagtgctgggattagaagtgtgcgccaccatgcctggcctcctcatttcttaactacttcgtcacttaactgttccctgcttcctacatacgtaagtagtgttcttgactgtctagaatccatacagatgacagatttgttatcctgatctaaaatttgtctttttttttttttttgagatggagtttcgctcttgttgccacgctggagtgcaatggcgcgatctccagctcactgcaacctctgcctcctgggttgaagcgattctcctgcctcagcctcccaagcagctgggattacaggcaccacacccagctaattttgtattttttttttttagtagagacgggtttctccatgttggtcagggtggtctcgagctcccaacctcaggtgatctgcccgccttggcttcccaaagtgctgggattacaggcgtgagccaccacgcctggcaatttgtctttaattgcttcaattaaaactggtcagtcaacagtaaaacccaggtgttttgtagttagaacaattggtataatcaagcttttaattgatctagagtacagatttttgactttaaaagaagggcttctttgtgtcaaggaatctcgttgacataatttatagtataagattaaaagcctttttagatgcatttatattcacttttcctcatttgatccatagtttgcaggatttataggatatcaatattgtagttgcacactaatatttatttttaaattgccttggcagttttttcattgccatgagtctttattttggtagaaaatttagattgggcagaatactgaacattttgaaacctgagctatggcattcatgaatagatgatcttcagaatttcactatagaataaccataaataattagttacattgtcatttagtcatcaagaaaagttaaactgcttgtgtttttttttccttaggaagatgcataatagctgtaaaatgttctgtcaagttaaacaaattttatacttatccctcttccctcttatattttgagaaacctcattcatttgtaaaaatcctgggtaaattaatattttaggcagtgatgtggaactaaaagtgctgcaaacctaaagcctaactttccaaagtatacattatagcgttttatcagatatatcccattctaaagcctaagaattttaaattaaacagatttttttttaaaaaagcctaagaatcaagtactaaacaggaatgttatgtatatatacttttttttttttttttttgagacagactctcgtctctgtcacccaggctagagtgcagtggcacgatctcggctcactgcaacctctgcctcccgggtttaaggaattctcctgtctcagcttcccgagtagctgggactacaggcatgtgccaccatgcctggctgatttttgtatttttagtagagatggggtttcaccatgtttgccaggctggttttgaactcctgaccttaggttatctgcccgcttcagcctcccaaagtgctaggattacaggcatgagccactgcgcccggccttttttttttttttttttttgagatatagatattggactgttaattgtcattgaagtattttggtctgaggtaggcttatgcagaggagaatgttttcatgttacttatattaacattgtttcttctacgaaatgacagattggtccaatgtgatgtaaggagttcagttgtgtgtttgggatttttgggcggctgggcgtcgagcttgaacgctttgatggctgcttttaggccaactatggggattgtactttttactctctttacaaggttttttcctagtgtctaaagagctgtccttctttagactaacagttaaatttacaaggggattgggggttctgtaggcaaatttaaagttgaactaagattctatcttggacaaccagctatcacccaggctggagtgcaatggcacgatctcggctcactgcaagctccgcttcccaggctcaagctattctcgtgcctcagcctcccgagtagctgggattactggcgtgtgccaccacacctggctaatttttgtgttttttagtagagacagggtttctccatgttggtcaggctggtcttgaactcctggcctcaagtcatccgcccaccgcggcctcccaaagtgctgggattacaggcatgagccaccgtgtctggcctctttacaaataatcttaaaatacacattaagtgtttcacttatttgattaaagttcagagtgctttcaaattgcaagggtttagtgaaaattgtacatttgtccttaaatgattttgttttcttcaagctaataagcacaagtgggtaccactccacttagatgttgtaagatcagagagtcaagaaagacctggatcccggaacagctcaagatgtcaacctgaagcaaataaaccaacacataacaataggagaaatgatacacgaagtaagttaccattctaagacaaaaatgactaaggaaagacttagtcttaatgctcgttattttagtaaccacatgtataaaccatttgagaataagttgaagacatcatgtccctttaaccccaaataccttcagggtatatttcataagaacaatataaccgtaatgcaattaacaacaatgaaacttaacattaatacaatgtgattgtccacaggcagatttttctcaataaagtcctttatagtcgtcccctcccctgctccaaggatccattctgggatcacccatttaatttaattttttttttctctttaggctccattaatctgtaacagttcttgcttttgtctttcatgacattgatttttttgaagattgtaggataatcgtattgtagatatcccttactttgggttttctaatgtttccttatgattggattggggttgtgaatttttggcaggagtactgtataagaaaatatatcattttcttctttttttttttttttaatttttattttttttattgatcattcttgggtgtttctcgcagagggggatttggcagggtcataggacaatagtggagggaaggtcggcagataaacaagtgaacaaaggtctctggttttcctaggcagaggaccctgcggccttccgcagtgtttgtgtccctgggtacttgagattagggagtggtgatgattcttaacgagcatgctgccttcaagcatctgtttaacaaaacacatcttgcaccgcccttaatccatttaaccctgagtggacacagcacatgtttcagagagcacagggttgggggtaaggtcatagatcaacaggatcccaaggcagaagaatttatcttagtacagaacaaaatgaaaagtctcccatgtctactactttccacacagacacggcaaccatccgatttctcaatcttttccccacctttcccccctttctattccacaaaaccgccattgtcatcctggcccgttctcaatgagctgttgggtacacctcccagacggggtggtggccgggcagaggggctcctcacctcccagtaggggcggctgggcagaggcgcccctcacctcccggacggggcggctggccgggcagggggctgaccccccccacctccctcccggacggagaggctggccaggcagaggggcgcctcacttcccagtaggggcggccgggcagaggcgcccctcacctcccggacggggcggctggcgggcagggggctgacccccccacctccctcccagacggggcggctggccgggcggggtgctgacccccccacctccctcccggacggggcggctggccaggtgggggggctgagcccccccacctccctcccggacagggtggctggcccggcagaggggctcctcacttcccagtaggggcggctgggcagaggcgcccctcacctcctggacggggcggctggccgggcggggggctgacccccccacctccctcccggacggggcggctgccgggcggagacgctcctcacttcccagacggggtggctgccgggcagaggggctcctcacttctcagacggggcggctgccgggtggaggggctcctcacttctcagacggggcggttgctgggcggagggtctcctcacttctcagacggggtggctgggcagaggtgctccccacatctcagacgatgggcggccgggcagagacgctcctcacttcccagatgggatggttgccgggaagaggcgctcctcacttcctagatgggatggcggccggcagagacgcttctcactttccagactgggcagccaggcagaggggctcctcacgtcccagacaatgggcggccaggcagagatgctcctcacttcccagacggggtggcggccgggcagaggctgcaatctcggcactttgggaggccaaggcaggcggctgggagatggaggttgtagcgagctgagatcacgccactgcactccagcctgggcaccattgagcactgagtgaaccagactccgtctgcaatcccggcacctccgggaggccgaggctggcggatcactcgcggttaggagctggagaccagcccggccagcacagcgaaaccccgtctccaccaaaaaagtacgaaaaccagtcaggcgtggtggcgcgcgcctgcaatcgcaggcactcggcaggctgaggcaggagaatcaggcagggaggttgcagtgagccgagatggcagcagtacagtccagcttcggctcggcatcagagggagaccgagagggagaggggagaggggagggggagagggagagggagagggagagcggaatttattctatcattttcttcttagcgaatcacatgggagtatgaccttgatttgtcccattattgaagatactaactttgattacccctgtaactttgattattagtttgattacaacattgattaatattaactttgattacccctgtaactttatttgattattagtttgattacaacattgattattattattattatttgttttttgtttgagatggagtctcgttctgttgcccaggttggagtgcagtggcgtgtgatctgggctcactgcaacctctgcctcccgggttcaagcaattcttctgtttcagcctcccaagtagctgggactacaggcacatgccaccacacccggctaatttttaaatttttagtagagatggggtttcaccatattggtcaggctgggctcgaactcttgacctcaggtgatccacccacctcgatgtcccaaagtgctgggttataggcttgagccactgcgactggccacaatgattattaaccttgattacttggttgaggtagtgtactctagacttttaaaaaatttttaagtttcttcagcttttttgtttaatttcttttctccctttgtaattactgtgtaatttgtggagagaggctttgagactgtggagataataattttctcagacttttcaaacaagccttagcttccttttttttttttttttttttttttaaataagtgatggggtctcattctgttgcccaggctggagtgcagtgggacagtcatagctcactgcagtcttgaactcttgggctcaagcgatcctcccacctcagcttcccaagtagctatgatgacaggtgcgtgccaccatgcccggctaattaaaaaaaaagttttctttagagacagtcttgcttcgttgcccgggctggtcttgaactcctagcctcaagcgattctcctgcctcggcctcccgaagtgttgggattacaagcatgagccaccgcacttagcttctccctctttattgccaaataatattctgttgaatgcatatagccctttgtcttttcatctgttgatggataagtggcttgtttatagtttttggtcttcatgaataacgctgatgaatagttgtttacaagtctttgtgtggaatgtatgtatttctcaaatgcctgtgagtgaattgattggtcatatagtagctgtatatttaacattataagaaactgctacttgtagcattttacatttccatcagcaactttttttctttttgctatgtgttaagtcccatgtctagtggaattcctgtattttggatttggctgattgctttgtcatggtattcttttttttttttttttttttttgagactgagtctcgctctgtcgcccaggctggagtgcagtggcgcgatctcggctcgctgcaagttccgcctccctggttcacgccattcacccactgagtagctgggactacaagcacctgccagcacgcccggctattttttttgtagtttttagtagagagggagtttcaccacattagccaggatggtcttgatctcctgacctcatgatccaccctctttggcctcccaaagtgctaggattacaggcgtgagccacctcgcccagccgctttgtcatagtattctttggcatttgcatgttcctttttttgagacagggtctcactctgtcttccaggctaagtgcaatggcatgatctcggctcactgcaaccttcacttcctaggctcaagcgattctcctgtcttagcctcctcagtagctgggactacaggcatgcacaacagtacctggctaattttgtatttttttgtagagatggggtttccccatgttgcccaggctggtctcaaactcttgggcccaagcgatcttccagcatcagcctcccaaagtgctgggattagaggtgtgagagccactgtacctggcctgcctgttccttttgtcttttctttttataactggcaataagaaggagctaggttgattagattcaggcttatttttttgcttggaatactgctgtgtgtatttcactttcagttgtgttaatattgagttagctcaggtgttaggttgatcagtccattataaattattccattagtctttttttttgagacaaagcctcactctgtcacccaggctggagtgcagtggcgcgattttggctcactgccttccaaagtgctgggattacaggtatgagccactgcaccctggcccattagtctttactgaatggttttactttcattaaaatcattggccagatactttttttttgtcttgagacagagtctcgcactattgcccaggctgggttctcctgcctcagcctcccgagtagctgggattacagacatgggccaccatgtctggctaatttttgtggttttagtagaggcagggtttcaccattttgggccaggctggtcacgaactcctgacctcaagtgatctgcctcccttggcctcccaaagtgctaggattacaggtgcgatccaccgcatccggcccagatacattttttcacagggattgctcagattttcagaaagcagaggataggatatgtggaaacaataggatgagcatttgtttttatagttttctgctgaaatctgataagtcatgtcctgtgaatggataagaaggcctaaggaaattttacagacttaatattagcattcaaaaattttaaatatacctatgtagaggtaaatgtattttgattaaaaaaatttccaatatattatgaaaaactttaaacatacaaaaaattgaaagaattgttcagtgaatacctgtctagccaccatctagattaataatttctctgtatttaattcattcatctgctgaatcccttgaaagtaacttggagatgttgacgctttatcactaatgtcctaagaaaatgcatcatctaagaaaatcacactagtttcctagtaccatctaaaatctagtcaatagttaatttttctcaattgtccacaaaatatgacttttaaattataaaactttagctaaatgcagtggtgcaagcctgtagtcccagctacttgggaggttgaggcaggaggattgcttgagcctgcgaatttggggctgtagtgcacaatgatcatacatgtgtgggggggagcatatatatatatatgcatatgtataaaacttgtctatagaaaaattgactttttttctattgtttttcaaaatgtcattttaagtttttattctaaaagtaatggattctcataatttcattaatttttttcttattaaatattgaatatataagaaaatagacaaagttatacagaacaacaatataatgagctgagtatggtggcactcacctgtagtcccagctacttggtaggctgaggtaaggaggattgcttgagagcccaagagttccaggctgcagtgagctatgatcatgccactgcagcctgggtgacagagtgagaccccatctctaaaatcaataataatgatgatgatgatgatgaacagtggaaactcaccctgtttaagaaatgtatgttactattacttttaaacttcgctttgtgcactctgcaatttcatcccattgtctcggaaaaaatgagcttaagtgcattggtttctttcatgttttgaaatcgccatgcaatgtgactttatcaacattctttggcaggaatttttgtttttttaattcagcctacttttctttagattaatgcatgttggttgtattactgtaagtcttttcctgctgaaaggctgtttcactatttgataaaatctgtactaacggtgggtatttggattgtttccagtttttttgatattaaggtactaccacgaacattttaatgcatgttttccagcacacaagtacaagaggctctctatggtaattttttcagactgcagactacactctgtgagtgggttatgaaatcagtatattggttcatgatcaggtttttaaaaacctagagtgcttcacatagtaaatttttaaatgatatgtgtttataaaattttttgtaagtgtacttgtatgtaaaataaataaggcttacttacagattaaggcagaaatgtttgaaaaagtggctggacgcagtggtgcacacctgtaatcccaacactttgggagcgggaggtggcttgatctgggagggggaggtgggtggatcgcttgagctcaggagtttgagaccagcctgggcaacatagtgagaactcatctctgttaaaaaaaaggaaatgtttgaaaaagactgttttaggtctaagcattgaggatggaactatgggatctagggtaatgttctcagtgagggtgatttttttttccccaaagagtcatttggcattgtctggagatatttgttactggttgtcacaactgagggagtgagtgggtgctactggcatctagtgggtggtggtcatggatgatgccaaacatcctgtagtccacagaacaggcccccacaccagagtctaaagtgctaaggttgtaaaaccttgtctctaggatttgcatatcttcacattaattagattattccaagttgattttcaaagtagatatacctattttcaacctcattagcaatatatgaatgttctacctgttttttgagacagaatctcactctgttacctaggctagagtgcagtggcgaggtctcggctcactgcaacctctgcctcccaggttcaggtgattctcctgccctagcctcccgagtagctgggattaccggcgcccaccactatgtctggctaatttttgtatttttagtagagatggggttttgccatgtcggccaggctggtctcgaactcctgacctcaagtgatccacccacctcagcctcccaaagtgctgggattacaggtgtgagccaccgcacccggctaatgttctacctttttaaactttgtcaacatttcatattagagacattaaaatatttgttgtactggggtaaagagcctttcattgtcttaatttgcatttcttacagtccataaggctgaacactgttttcgtttttcttttttttttattctgagacggagtcttgttctatgcccaggctggagtgcagtggcagggtcttggctcactgcaacctccgcctcccaggttcaaacaatttttctgcctcagcctactgagtagctgggattacaggcactccaccaccacgcctggctaattttttgtatttttggtagaggcagggtttcgccatgtttcccaggctggtcttgaactcctgagttcaagcaatttgcctgtctcagcctaccaaagtgctggtattacaagtgtgagccaccacaccgggcctctttttttttttttttggagagggaatctcgctctgtagcccaggctggagtgcagtggtgcaatcttggctcaatgcaacccctgcctcccgagttcaagtgattctcctccttcagcctcccgagtagctgggattacaggtgtgtgctatggcacccggataatttttgtatttttagtagaggcggtatttcagtatgtcagccaggctggtctccagcttctgacctcagttgatccgccccccttggcctcccaaagtgctgggattgccggcctgagccaccgcgcccggccttgtatgattattgacccattggtaggcaccgttttctgtatttattgtccacttgcatttttttaccttgcttgtattttagatatttttcccattgagtggttgtgtctgtgtgtgttgcatgagagagagtcgtatgagttcttacatgtactctagatagaatttctatatttcgcttcagatatcttttctcaatttgttttgtgttttcatttcctttttactttataaggaatgtcatttacttaaatagaaccatccttaaatatttcgtgagaaatgttttttagcagttttatgtagtacaaacttagtagtcttggaacttcttgaatctttaacagcacaatcttaataaaactatctctttacctttctagtatgttattttacttgttagaatgtattcttcatgtgtcagtaccttttaggctctgttttatgctagagatatttttgataaattcttattggatctcttcagtttgtatccatctgaaaaatgcctggctactgttcattagttacaaagtggaagaaggtggctattatgttttcataaagacaatcatgttattttacttggcaaatcgaagtatataaaaatatttttatttttaaaaggttggaagcgagatagagaaaaaagggatgatcaagatgacgtttccagtgtgagaagtgagggtggtaatatccgaggttcctttagaggtcgaggaagaggccgaggacggggaagaggacgaggcagaggaaatcctcgatgtatgacataatttttgtttcgttaaattagataaactttgaaaaaaatagagcaactatcctctattatgttttaactaattttctttgtctgataatagatggttttatgtttgttaacctttgaagttcttcactttatccgtagtaactatttttttctaatatgtgattacctttctttttctttattcacatcaagtgaactttgattattcatatggttatcaagaacatggtgaaaggactgatcaaccatttcaaacagaacttaataccagtatgatgtattactatgatgatggtacaggtgtacaggtgtatcctgtggaagaagcattgcttaaagagtatattaagcgtcaaatgtaagtggatgtttgatgtaagcagacgggatagcaaaatctgttgcaatatgaactttaatgtcattgataatgaatatgctataatttttttttttttttgagacagagtctcactctgttgcccaggctggagtgtagtggtacgatcttggctcactgcaacctctgcctcctgggttcaagtgattgttccgcctcagcctcctgggtagttgggattacaggcacatgccaccacacctggctaatttttgtagttctggtagagaacgggttttgccatgttgaccaggctggtattgaactcccggcctcagctgatctgcccaccttggcctctcaaagtgctgggattataggcgtgagccaccatgcctggctgtttataacatttttaaagctacttatttgtaaaggttggaaaatgttaaaaattattttgattatatatttttagggaatgtgattaaagtaggtgtttttaaaattttatatttggtttatgttgtttatataagtctcctggcttctatagtatttagatatttttctccttaaaggagattaggtaaaatgttattgcataatatgaataaatataagactgtaaagcttctctatatatacttgaaactgaacaagtaaaatttggcttattatttgccaataggtgtttatattagaatttgcaaattaacataaataaaaaatggtggtatcttttgattttcttcttagcaattgacttctgaattcttaagttttttttatcttctaagtttttctttgtgacacaattaaatggggactaccttatattttagttcagatttcttactctagttctcatagtagttgctttctgggtactgaatgtgaagtcaggagaatattagttctattttctgaaagaaaaaacaaaccctatgcatattagtattgtataggatattttgcttatttatatagtatgtttttatagaggcaagagaaaaatgttgccaagtaatttgcataaccaatttgttaaaacttgaaatttttctctccttacaaggtgaaggaaaagggctatttttgaaagggcataggcatttaaaaatcatctgtttttccaaaataaaatagactctactctgttactagaaaatttctttatcatcatcagccaggcaccttcctgggttgccttcatggtggatccaatttgcttacagtgtggagcaacttgtttatattgttcttgcttcttttgttacagttgatgcaaacactgaagaaaagggcctttttgtgggcagaaagtgcttgacatgtggctgtcaacttcataccactattactgtcttttttgtaacttttgctgccaagtcccttctgagacctgacagtggacatgcaactccatgtcaggataatcggcctccagtgtgctcatacaagtgagggaggagcagagctacttcagtgttgacaaaatttctgatcatgcagtgtagaatccagagcctctaaggtaggacttgatgatgtccctaggacactgagcaaaatgtcagacatggcattggtcatgcctctttttttgttgttgttctagcagtagggattttggcaaatgttagtagagcactaggtttagtgtggcttgttattattattaccattctttgattagtggagatgtggctttgaaggagtcgtgctttttactttgtattatttggtttctaatatatagataggctgattgattgaggttttgattttctttttgagaagtcactaaaagttttcctggccaggtgcggtggctcacgcctgtaatcctagcactttgggaggccgaggcgggcggatcacgaggtcaggagatcgagaccatcttggctaacacagtgaaaccccgtctctactaaaaatacaaaaaattagccgggcgcggtggcgggcgcctgtagtcccagctactctggaggctgaggcaggagaatggtgtgaacctgggaggcagagcgtgcagtgagccgagatagtgccactgcagtccggcctgggcaaaagagccagactctgtctcaaaaaagaaagaaaaaaaaatgttttcctgacacctgtggaaaaatgatgcaaaatgtatcgtacagtatgaggcctaaacgtattcaaaatggttgaggggttttttttaaacttttttttttttttttttgaaatggagttttgctctcgttgtgcaggctggagtgcaatggcacgatctcggctcactgcaacgtccgcctcccaggttcaagcaattctcctgcctcagcctcccgagtggctgtgattacaggcatatgccaccacgcccagctaatttttgtagttttagtagagacggggtttcatcttgttggtcaggctggtctcaaactcctgtcctcaggtgatccacccacatcagcttcccagagtgctgggattacaggcgtgaaccaccgtgcctgacctttttttttttaaaaacattttaaaaactttttattgcagtctacttttttttaactttttaaaaatttttttgagatgctaatttttgtatttttattagagacaaggtttcaccacgttggtcaggctggtctcgaactcctgaccttgtgatccgccgtcctcggcctcccaaagtgctgggattacaggcgtgagccaccacacctggcctacttgtttttaacattttaagtgaaaacttgtattaattgtttgtgatgtcagcattaaaatgtaaagatcttgattatttctagctgtgataatctctcttggcactcagatgacagcactctgatagatttgtagatctttagaggttttttccttttttctttttctttttcttttttttttttttttttgagacattgtctcactctgtcgcccaggatggagtacagtggcgcaatctcggctcacctcaacctctgcctcccgggttcaagttcaagcaattctcctgccttagcctctcgaatagctgggattagaggcacgtgacactgcgcccagctaatttttgtatttttagtagagacagggttttgccatgttgccccatctggtctcgaatgcctgagctcaaagtgcctggccaggacagtttgttattgatttagggaagttcacatctcacagctaagaacagttgtaacttgtgactaaattaaatgtcttaatgtctgaaattttagaattttttttttcttttgaaatggagttttgctgttgtcacccaggctgcagtgcaatggtgcaatcttggctcactgcaacctccgcctcccgagtccaagcgattctcctgcctcagcctccccagtagctgggattacaggcacgcaacaccatggccgactaattttgtatttttagtaaagtcggggttccaccatgttggtcaggctggtctcggattcctgacctcaggtgatctgcctgccatggcctctcaaagtgtggaaatgacagacgtgagccaccgtgccctgcatgaaattttagaattttaacacatgtattatgtatctgccacatgccagacactatgaataaggcttttgaggtgtaacaaccatcagaatcttcattgctttaagacttcagtgtttaaaattttttcctttagtgtttaaaaagagtaaatgaggccagggcatggtggctcactcctgtaatcccagcactttgagaggctgaggcaggtggatcatctgaggtcaggagttcgagaccaggctggccaacatagtgaaaccccgtctctactaagaatacaaaaattagccgggcatggtggcacacacctgtagtcccagctactcaggagggtgaggcaggagaatcgcttgaacctgtgaggcggaggtcgcagtgagccgagatcatgccatcccactccagcctgggcaataagagtgaaactccatctcaaaaaaaaaaaaaaaaaaaaaagtaaatgatttactagtgttactgagtgagatgtcagtagtatttcagtagtctttgagagagctttgcactctgacaattgggtaaatatcaaactattaaaggaaaatttggatatttacattcttaaaataagttgatttattttcttccccttcagtaaaaggtagctgaaaacaagtttccagttatagatgcctttttttcaaagatagaatttggcccatatacttcaagggcatctttagtcactgagttttataccccaaaatgtgagctggtttgttttctcataacttgtattccatgtttgaaaactttctctgtgatttggaaatagtgtgggattattaaactgtaggccccatcatcattgatgttatgtatttcttttgtatcattcttctctatattttcccgtttgtcttcttctctgtctttaaaatcctcatactctcatttacatatatggaggctataatttttttttttttttttttgagacggagtctcgctctgttgcccaggctggagtgcagtggcacgatctcagctcactgcaagctccgcctcccgggttcacaccattctcctgcctcagcctcccacgtagctggcactacaggcgcccgccaccttgcccggctaattttttgtatttttagtagagacagggtttcaccgtgttagccaggatggtctcgatcttctgacctcgtgatccgcccgcctcggcctcccaaagtgctgggattacaggcgtgagccaccgcgcccggcctatggaggctataatttaaacatgtatttctctctctttaacctttcctatggtgtggataaacatgtatttctcaaaggctattattaaatgtattgtgaatattatctttatatcttgggatttgtagttactgatcatactgacagttcatccatttacatttctctcggaaaggttaagtgggtttgtgtttttcaagagaagataaaacatctaatcatcttctatatttttgcttccatgtgcctcatggtgtcaaggatattccttctttagctatattctgttcacccttaatgtctttcttttttttttttctgtttgagatggagtctcgctctgtcgcccaggctggagtgcagtggtgtaatcttggctcactgaaagctccgcctcccaggttcacgccattctcctgcctcaacctcccgagtagctgggactacaggcgcctgccaccacacccggctaattttttgtatttttagtagagacggagtttcaccatgttagccaggatggtctcgatctcctgaccttgtgatctgcccgcctcagcctcccaaagtgctgggattacaggcgtgagccaccatgcctggctaacgtcttttattattgtttttagacagtcttgctctcgcccaggctggagtatagtggcaccatccctgttcactgcaacctctgcctcctgggtgcaattgattctcctgcctcagcttcccgagtagctgggattacaggcacccgccaccatgcccagctagtttttgtattttagtagagatggggtttccccatattggttacgctggtcttaaactcctgacctcaagcgatccacccacctcagcctccgaaggtgctggggttacaggcgtgagccacctcaccgggccacccttaatgtcttatggtctgtctatcaaagaaagaagcatggagaacttgaatcgttcaaaatatatatgtgcacatatgcctgtgtgttcactaagttttttttgttttgttttgtttttttttgagatggagttttgctcttgttgcccaggctggagtgcaatgacgcgatcttggctcactgcaatgtttgctgcccgggttcaagggattctcctgcctcagcctcctgagtagctgggattacaggcatgcgctaccacacccggataattttgtgtttttagtagagacaggttttctgcatgttggtcaggctgatcttgaactgccgacctcaggggatccacccatctcagcctccccaagtgctgggattacaggcatcagccaccgcgcctggccatgttcactgagtttttaactaagaattgtgctggttactaggcttcagaagtattaaacatggcagtactttgtcaacttagaaaacaaaatgaactacttttctgtatgtgaatttgacaaaggatatttccagtataccactcttctcagcgactgggaaaaaggtggaaggcattatgctaacatgggattagctttgttatctaatgcttaaatgaaacaagtagaagtggctttgtaaagattttcatctaattaactcattaaaaaaaattattgaactattttaaggtaaaatgagcagcttaattctttatatttagtgaaactgatctaaatagaagttattaattttttggaaaataatattttaagtttaagagaaattattaattcagtagagttttttgctatcttatatgtttaccctatctgtgttgtattagagctatacatattgttaaccaaattacaatattttcatgttaatgattggttttcacagttaatgtgggagcaatagaaatatttatttcctactaaataaatggatgaaattctgatttctcttttcagtgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggtaattgctcatttgatgaacaatttgtactttctgctcaaatttcctttgtacctaaaacttctctgaaaaacagagtactaaaaacagacaatctgtagttgcttgaggctcagacagcattccatgatgtttttctattttgtaaaaccttcataaatgtctaaccttggaaacccctgaaagtattgctaacgatgttactgtgtattttctccttcccctccccctcaattagtcaacctattttaaacctgatccttcaaactttaacccttttgaacacccttggtccttaaaacttcttcagggctgggcgtggcggctcgcacctgggtgatagagtacaacggcgcaatcaaacacaaatttcttcaggttactgtaaaaaagcatgtgttcctgtatatgtatgtgtatatatatatatatatatattttttttttttttttttttttttttttaagacagtgtctcactctgttgcccaggctggagtgcagtggcatgatatcggctcaccacaacatctgcctcttgggttcaagcgattctcctgcctcagccttctgagtagctgggactacaagcacgcaccatcatgcccggctaatttttgtatttttattagagacttggcttcactatcttggccaggctggtctcgaactcctgaccttgtgatccgcccaccttcgcctcccaaaatgctaggattacaggtgtgagccagcactcccagccgttcccacttattgaaaggctaatttcaaatagtccttctggctgggcatggtggctcatgcctgtaatcccagcactttggggaaaaaaaaaatctctcatctggtctgtttctagaaatgctttcaacatctttttttttctagccaatttctttccctacacacaacccttggtaaccacaatcactaatctgctttttctttttttctttctttttttttttttttgagacagagtctcattctgttgcccagtatggagtgcagtggcacaatcttggctcactgcaacttctgcctcccaggttcaaggattttcctgcctcagcctcccaagtagctgggataactggagtgtgccaccatacccagctaatttttgtatttttagtagagacagggtttcccaatgttggccaggttgtagccttttgtttctgatttttcacttagtattgtgcttttgagattcacctatgttgcatgtagcagtagtttgttctttcatattgctgactagtattccatggtatggatataccacagtttatccattcacttgttggtggacattcagattatttatggttttggagagtgtgagtaaagcatgaagatctttatagggatatatatatacacacacacacacacacacatatatatttctgttggataaatatctagtattgtgattgctggaaagtatagtaagtatatgcctatctttataagaaaatgccaacctattgtccaaagtggctttaccattttgcattcccacgattatctataggacttgttcctcagccttatcattgcatatattgtcagttttttgaataatagatatatagtggtttctcattgtgggttttttatttttttgggacaaagtttcagttttgctcttgttgcccaggctggagtggagtgcaatgccatgatcttggctcactgcaacctccacctcccggattcaagcaattctcctgcctcagcctcccaagtatctgggattacaggcgcctgccaccacactcagctaatttttaaatatttttaatagagacgagatttcaccatgttggccaggctggtctcgaactcctgactttcaggcgatccatccgccttggcctcccaaagtgccgggattacaggcatgagctaccgcgcgcctggcctgattgtgtttttttgtttgttttttgagacagagtctctctctgtcgcccatgctggagtgttctggtgcgatcttggctcactgcaacctccacctcctgggttcaagtgattctcctgcctcagcctcccaagtagctggtactacaggcgcacgccaccaagcctatctaacttttgtgtttttagtagggatgggggtttcaccatgttggccaggatggtcttgatcttttgaccttatgatctgcccgcctcagcctcccaaagtgctgggattacaggcgtgagccaccacgcctggactcattgtggttttaatttgcatttcactaatgattaaagttgttagcagtttttcatgtgcttttttgtctgcataccttattagtggaaatgtctgttcagattttttattcattattattgaagtgttttttaaaagataattgtatgagttcttcattctggatacaagtccattatgtattttgcaaatattttttcctagtttttgtcttttcattttcttttcttttctttttttttttgttttttgtttttgtttttgagacagagtcttgctctgtcacccaggttggagtgtaatggtgtgatctcagctcactgcaacctgcgtttcctgggttcaagcgagtctcctgcctcagcctcccgagtagctgggattacaggcgcctgccaccatgcctggctaatttttgtattttttagtagagacagggtttcaccatgttggtcaggctggtctcgaacttctatctcaggtgatccacctgcctcggcctcccaaagtgctgggattacaggaatgagccaccgcgcctggcttcatttcttaacaggcttctttgaatagcaagtttttgaacacgtgtgcttcgtgttttaaaaatcaactacagggctgggcgcggtggctcatgcctgtaatcccagcactttgggaggccaaggccgatggatcacttgaggtcaggagtttgacaccagcttggtcaacatggtcaaactctgtctctactaaaatacaaaaattagctggacatggtgacgtgcctgtaatcccagctatttgggaggctgagacaggagaattgattttactatagtaaagtccatgttttgaaaataacataaaataatgatttgttggtgtataattaatgattcttggtttcatgaaaataattactgtaagcaatgtcattattgcatttgtttatagataagtatataaggtttctatatattgtaattaacagagaaaattagtttttttttttttttgcaaaatttgctcttagagcaaatattatgattcatagtagaatgagtttatttatttacttatttatttattttcattttttagtagagatggagtttcaccacgttggccaggttggtctcgaactcctggcctcaagtgatcttcctgcctcagcttcccaaagtgctgggattacaggcatgagctaccgccgccggcattagaatgagtttattaactgctgccattgtgctatagcaaagtgctgtagccaactcagctgccgttttttatgaagttgttgccattttttccctgtctacttctgtacgaatgtagttgtaattttattattgtatgcctttttggtctgtttgtagtcccattaaatcctcaagcacaattttaagatcattgacattttgtttttacaacctacagcagtaaggaaggatttttaaaaggaagctttgagctactgttatggttagcactgatacagtagctaatgatacagtaaaaaataataccactattgaaaagcagaaacacataagcatagcaatttagaagaacataagtctgcattcacttaacattcattatgcacctaccatttgtaatagtaggaaaggtgttctttttctgttgagaaagtaaggcttcattaggcattgtagtgttaacatatcaagatcatggacctatgaatatgtcccttgtagctctgtgactattgtcagtgtcctgagacagtaatatatatttcctagggttgtcatgaggatgaattgtgttaatgaaagtatctggcaaatgtagtaagctctaaataagtaagcatttgctattattgttagtcttaaacgatgtcgttctgttgataactcctttatcttcatgcatttcattttaaccagcttcttcccatatgtatttgaatatgctcaagtttttcctttcttgaaaaactctcaagagaagcaaaataatttagctgatacccgtatctgccctggttgagtatgcaaacgcaaaccaaacttgttgaatctgattcttctccgctcatttattttttagcttactgcattctcgatgtcttccccataattgaaagctttttgtgtcttccatttgttagagcaaattgatcttggttctatagcttaccagttgtataactaagcaattaacgtaatatcttcatgcttcaattttcttgttaaaatatagcaaataatacttaagctataatagagtatgaggatttagaggaataattaatataatatcagcctcagaactgtgcctgctactttcatctcaaaccttgttttctaaattgtctgaacttgtggttcctcaaaacttgtgctcttttctttttatctccaggtctttgcacattcaagtctttctcttactaccaggcagtaagaatgcaacatctatgtattccggcattggtagttattcatagtagtaggtctgtatcattaagaaaagaaccaaaattaatagctaagtcagttaaaacctcagatactggaaaatactgatgtacccagtaactcattgtttaggagttcaggattaccaaggcttggttttataactcgatgtttcttctaggtctttaccttaattttgtgcatggtgtaatttttatatgatccttttatggcctgagtgatgaatgtttcactttatgtgttcttcatttcccttttaaatttattatttctaaataggaaataaattacacaaaattcaaaactcaaaagggtatatggttatcttccagtgattgtccaaggaaaaaaaaggtatatggtaaaaatttttttttccccatttttccaccaacaatgaatgaattacctgccttggtagtggtcagtgttacttctttcttgtgtcttcctcctgagatagtttgtttatgtaagagaatactatgataccttactacatacaatgtttgttatgccccttcctctttttttttttttttttttgagacagagtctcactctgtcacccaggttggagtgcggtggcatgatcttggctcactacaacctctgcctcctaggttcaagcgattcttccgcctcagcctcctgagtagctgggattacaagcgcctgccaccacgcctggctaatttttgtattttagtagagacgggtttttgccatgttggccaggctggtctggaactcctgacctcaggtgatccgcccgtctcggcctcccaaagtgctgggattacaggtgtgagccaccatgcctggcctcctctttttttattttttataaaaaacatgtgttggaagaggctttagtagctgtacataaagaactttgagcttttcatcccacaagtttttctttaaatattttcttttaaattgaggcataatttatacattattattattttatttatttatttatttagagatggagtctcatgatctgcctgcctcagcctcccaaagtgctgggattacaggtgtgagccaccgtgcctggcctttatacattatatattgtaactcataagattagagatgattttttttcctatgtatacggtcaggtaactgccatccagattaagatacagaacattttcaagacccaggcaagctgctttctgtaccctcctagtcagtaccactgctttcccttttaagaggcctctctcctgtttttgaacttcacataaatggtgttatgacttttatatctgattttatttctgaagttatttctgtgagatttattcatattggtgtatagcagttgtttactttctgttttttggtagtttttccattgtatgaatataacagttaatcaatctttcttttcttgctttcttccttttttttgagaccgctctcactctatggcccaggctggagttgtactgacctgatctcagctcactgcaacttccacctcccagtttcaagcgattctcctgcctcagcctcccgagtagctgggattacaggcacccaccaccaagcctggctaagtttttgtatttttggtagagacagggtttcaccatgttggccaggctggtcttgaactcctgatctcaggtgatccactcacctcggcctcccaaagtgctgggattacaggcttgagccaccgtgcccggcaacagttaatttttctatgctcctattgatagacatatttgggttctttccactttgggtctttgatgctactgtgaacgttgtcatagatatttctgggtgaacataagcatttattttcctgggaaactggtgggtaacagggcataaatgtgtgattaccttttgtagatactgctaagcatttttttaaagtatcaaaccaatcaaaaccaccactattgggagtttgacttgcttcacattctaaccaacactactagcagtctttttccacaactttactttggaaaatttaaacatatgggaaagtttcaaggagttttttttttgttttttttttacattcagggatagataatacatggtaaaatacagcgatcttagatgttcactgtgagttttgaaaattaaacataagcattaccccaggcaagatgtagaatactttcattattctaaaaacttccttcatggctctttctagtcagtgtcacacagcctctccaacaacttttctgattttcatatcatagattagattagtctgttcttggcatttgtgtaaattgatttcttctgtctctgagttcttttcattggtagtttttgacattcatccatgttgttgcaatggtctggatgctgggcatactgtttgctactggggtgtcattgcttctaggtctttcagtggacaaaatgaggaaaatatatgttgggaaaaatacactgattttactcatctaaagctttcaccataggattctttcctatctttctccattttatatttcagactcccttctcaaaggagtttcatttaaaataagtcctaattgtaatttaaaggaatccccaattatggccaggcgtggtgtttcacacctgtaatcctgcattttgggaggccgaggcgggtggatcatgaggtcaggagttcaagaccagcctggccaacttggtgaaaccccgtctctactaaaagtacaaaaaaattagccgggtgtggtagtgggtgcctgtaatcccagctactccgaaggctgaggcagagaattgcttgaacttgggaggcggaggttgcagtgagccaagttgacaacactgcactgtagcctgggtgacagagtgagactccgtctcaaaaaataaaaataataataataaaaaaagaaatgcccagttatggaaaatataacttgagagttaagtaccatactaatattaagagcaagagtaggttcttttttcaaaatctgttcatttctgaatggataatgttcttttttttttttgagatggaatcttgctctgtctccaggctggagtccagtggcgccatctcggctcactgcaacctccagctccctggttcaagtgattctcctgcctctgcctcccaagtagctgggattacaggcacatgccaccatgcccagctaatttctgtatttttagtagagatgaggtttcaccatattggccaagatggtctcaatctcctgacctcgtgatccacccgccccggtctcccaaagtgttgggattacaggcatgagcacctggcccggttaatgttcttaattatatacagcatgttctccagctaaaatgtagtgggctttaatttttataagttaatgtacatataactttatattgtttttatattatacattttgtatttatcctaatttctaaaaggtgagtactcctgtatttcagtgagaagttaaaccaataaggatttagtttgtatcttgaagaaattttggcctagttttgttttatccttgtagtacatattggggaggcacctttgcctaatggctaagacttttagttgtagatagatagtggtttgagtcctggtgttgtctcatactagatctgtgatctttgattaagtttatttctttgagcctcagtttcctcatctatatgtaggggtgataccttctttatgaggtattgtgaggaatcatgagtacatgtagtacttattattcaataaattgtggtaattattacaataataaaatgcctacattttatttggtaatattttaatggaagacaaggaaatatgagagagaagaaaatagtaaaagtcaatttgcttctagctgattcagtattccttaaatgactgttctaattgtgaaaaatatatcatctgaagttaaataagtgggagatcaggatatttgttaccttacaggtgcaaatgattttaaaacttgtgttctatgtggttaacttatggattttttagaatcttaactgcaaattagtttgctaatttcaggttttcaaatttttaggttcttagaagtatagcacagacagtgaaatagctcataattttaatagctcaatttctgttaataggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacaggtaacatcttttcttctagagcaaacgatgtaacagtgggttatttggtccaatttacttacttatttatttattttcagtttatttagatttgataggaaaattaaagctaactgaaagacttttgagtcccattttgtattcatattgcctcactcacagagttacaaattaaataaggatttaagaattatgaggaaagctgtcttatgtttcttgttcttaaattatatgtgtactttgtcatgtatggagtttctatcttttatttttactaaataactatagatatgtatcgttttcccctgtaaaattggaatagtatgattggattattctaaaaaggtcttatactcaagagtggggtagtcttcctttaattttgttaccaatacgctttaatcttgtcttggaaagataaaatgacctgcattctaaattagaattggggttctgtttaatttggttgtgtttagaatttccaaaagatttaatgttaataattttttcctggatcatttttaagacattccctcttgggaaaaaatgtgtgcttaaacttttttcagtcagggtgatgatcttctgaagctcttggatgtcatttgatcggaatatgcagtggaataggtgactcactgaaatgcctttataaatactggaacaaatcctgctgcaaaaatgaaagcgatcagactgtcttctgttcaagaatgtctattcccacctcttggtggaggaagttgggccaacactgcagtggagataaccacctttgcgataatgagagacagaccagaggactgctactctttttataggagctgcctatttctgtgtaattggcctgggctgcatgggctgcttttattcatggtgggaaagttaattattattattctggaaataccgcaagattatgttttctgtttccagggttatgtacttgtgtccagatgaataaagcagaaaaagaggggattgagtagcatttcccagattcttaagtactttgctattcgatttgcctttcagtgtagtgtacattgtaaaactcagatattgtcatgatgtttcacttggacataagacttattaatgtggtcacttaaggggtaaggaatttaagaactggatgaggttatttcttcctttactcttcaaaatgtatttttgatacatcagtatgagaggacgtcccatcaacaaagcatcgatgatggacagtctcacactatttttatcatatgtttctttgtcagccttctgcttctaatcccagtaagcaacttggacaggcattttaaaagctgaagaaaagtgacattattttagctagtggtttttaatttattttttgttaagatataatgggtgattatataagttagatttatttatgatatcaacttgggtccaagatgatagttttagctagcttatgaacattgggttcacaaggcattgggtaagttagataaaatagcatatactttctctgcagggtaggtaagataggtcagtcaagttggtaatgcctgtccattaaccatttatgcatactaataaaattataagaataaaatca

SEQ ID NO: 81 - DNA, 61005 bp, Homo sapiens
gggtaaagctcctcggcctcggcgtgctgcgcctccgcggctgccctgcgccaggtgagggctcgcggctcccggctgcggctcccggcgcgtggtggcgggctcggggcgtgcgtcgcggagaggacggggccggcgggcggttggcgctccgttcggtgcggggaggggcgtcacgccgggcgctgcgcggcctcggcgggcggcggcagcggcggccacggccgccgggctctcgggttgtctgtccccagttggagccggccggtgtcccggcggagagacgggcagtcgggttccctggcctcggggccaccccggctggggcggctggggcagagggacgatgtctactcgcgccccgatgcccgccgcccattctcgggaggatccgcccgcggtgactgctgagagggagtcgctgttggccgcggcgaaccggccggccgagcagccgcccccgcccgaatgtgagggcaaagaggcggcgagggaggagagggccgcggccgccactagcgctggggcgcggggagagccgtcgccggcgctggtgctgggacgcagcgtgccccaggcggctgtccccgtgaggcccctggcgctgcacctggcgcacaaggcgcgtgggcccgggggccctttcggcggggagccgccaccgccaccgccgccgccgtcgccgttgccgccgttgctgcgggatccgccggccgaggacgcccgggaagaggtggcagctggccctgcggaaaagcggcagccgccgctgctgccgcctaagggaaatccctggaccaaaaagcctccccagcacctgtccccagacacgacaggtccgccaccgcccccgctggaaaccctggaggcaggtctgtggttgctctgcgttgggcactggcagggtgcgggcaggggcgacttgcgggacttgccggcgcgtggcggcggtagcgggcaccaggcccgggtaacggcaggcctcccctccctgtcagtcggaggtaatttgttccaaggtgtcattcactctgcctatttacagacatgggcatctgggaagggagcggcaggaagaggtgggacctcaggttctccttgcctgatgggggcacggaggtggtagcttggcggcgcatccctgctggcgcggttgcgattgtgttttgtccccagtgttagtgacttgggaaagtagctaactttagatactgcagtgcttcgtatgggaaagttttggtagacttttttttttttttttttacataaaaggattgaagcaagtcagagcaaggggatttattcgtaagtggaagcgcgattgtagtcttttgtgaaataagatgaaaaaaggttttcaaaacactgctgagcagtcatattaaaaatgagactttaaatgtggtttttaaagtgctttatggggggaggggggagggatagcattaggagatatacctaatgttaaatgacgagttgatgggtgcagcacaccaacatggctgcacatgtatacatgtgtaacctgcacgttgtgcacatgtaccctaaaactttaagtataattaaaaaaaataaagtgctttaagttataagtgtgctggaaaataattgaaataggatagttgacatgcgagcgtggattgcacgttaggtaaatggttttctaacattgtcagctctccttccctttagaggagataagattatgccactatatttgaatgctgaccaatgctgtatggccgtcggtgctttattttgattgtagtaactgcaacttaagaaagtaaaaatgggccggcgcggtggctcacgcctgtaatcccagcactttgggaggccgaggcgggcggatcacctgaggtgaggagttcgagaccaggctggccaatatggcgaaaccccgtctctactagaaatacgatcattagccaggcgtggtggcgggcgcctgtaatctcacctacttgagaggctgaggcagggagaatcgcttgaacccgggaggtggaggttgcagtgagccgagatcgcgccactgcactccagcctggtcggcagagtgagacccactctcaaaaaaaaaaaaaaaaaaaaaaaaaaaaaagttaaaatggaaataaaaaccatgacaaaaagcagtatctggccgggcgcggtggctcacgcctgtaatcccagcactttgggaggccgaggcaggtggatcacctgaggtcaggagttcaagaccatcctgactaacatggagaaaccttgtctgtactataaatacaaaattaacctggcgtggtggcgcatgcctgtaatcccggctactggggaggctgaggcaggagaatcgcttgaacccgggaggcagaggttgcagtgagccgagatcgcgccactgcactccagcctgggcaacaggagcgaaactccgtctcaaaaaaaaacacaaaaaaacaaaaccgtatctttctaaattaagttgtaaatgacttgaactttttatatgcaaatgacagctgtttacttgcaagtcttcatttttatttaaaattaaaggttagcagcagaacaagaaatatttgagcgtgtttactggcttgtgaggatcaaatgcgatgaagaggtggtataaatgtaaggcgattggctgtgcgcggtggcacacgcctgtaatcccagcactttgggaggccgaggcgggtggatcacctgaggtcaggagttcgagatcagcctggccaacatggcgaaaccccgtctctactaaaaatacaaaaattagccggatatggtggtgcgtgcctgtaataccagctactcaggaggttgaggcaggagaatcgcttgaacccgggagacggaggttgcagtgagccaagactgagccactgtattccagcctgggtgacagagcaagactcagtctcaaaaaaaaaaaaaaaaaaagtacggtgattgttacaagcacccattatgttatgttaacatttcttcagaggaactctccaaagagggagatatgtgttgagttaattcattcatttgcctttgcacagaaatactcctcattaattgttgataaattttgacacttgcagaaaaaaagtttgctctggatttaatattggcataattccttcctcgctataaagagctgtttgtttactcctattactaactaaagagaacatggttaagtgaagacctcataaagtttttcttttttttcttttttaaagcccagtggcaagcactctaaaatttagcaaagaaagaaaaccctagtgaatcatcttatttgctgtttcacctctctacttctagacttacagacaattaagtgaattaccaagtaggaactctttgttgatcataaaaccagtatcatagattttaaaacttcgaagccatacatggtagtgtgtgcctgtagttttagctccctgggaggctgaggcaggaaaaatcagttttgcccaggagtttgaggctgtagtgtcctgtcatagtgcctgtgaatagccactgcattctagcctgggcaatatagcaagaccacgtttaaaataataatattaataataataataatgataatagaactttaaaaactgtcaaggtaagccttgggaactttaattgcaaatgacctgtgaaaaatatttaacagttaagctattggtgccttcattctccagtcttcactggagattaagaacactgtgatactagttgtatggtatggttcatggaaatttcagttttgctgttgtcttgtgtaggcaactctttctgtctttggatggaatccattctgcactggcaggaagaccatctttcagacctggcatagtgtagtaaccatggtctcttcccaacactgactctgcactgttctcccacaattaatttctttctttctttctttctttctttctttctttctttctttctttctttctttctttctttctctctctctctctctttcctttcttttcttttcttttcttttcttttcttttcttttcttttctttcttttttcaagagatggagtctctctgtgtttcccaggctggtcttgaactgctggcctcaggcgatcctcctgcttcccaaagtgcagggattacagacataatcaggctttctattttcttaagcaaatttacaacttcaggagtaaagaaacaggaccacagtctatttgcagttaaataacttaggtaacttagataaaagagattgtggtgtagaaacatactgttttgagagacttgggttctagtgcaggtattgttactaactggctagttgacttctggcaagatttctgggcattataaatgaataacatggatagactcatttcctctggttcataataccagagtgccacttataacctggctgccttggcttccatttatatatttatttaatattatttaattcatttaaataaatacattttacattagtttatttaaataggtagatagattgtcagtcttgctctattgcagtggtgagatcatagctcactgcagccttgacctcctggactcaagcaattcccctgccttggcatcccaagtagttgggatgacaggcacgcatgtcattccatggaattagccatgcccggctagttatttttaatttttttttgtagagacaggggccccctttgttgtccaggctggtcttgagctcttggggtcaagctatcctgcctcagcccccacaaagtgctgggactacaggtgtaagccaccctgcctggcggctttctattgtctattttctttctttcttctttttttttttttttttttttgttatattgagacagagtctcgctctgtcgcccaggctggagtgcagtggtgcaatctctgctcactgcaagctccgcctcccgggttcacactgttctcctgcctcaacctcctgagtagctgggactacaggcgcctgccaccatgcccggctgattttttgtattattttagtagagacgggatttcaccatcttagccaggatggtctcgatctgctgacctcgtgatccgccggcctcggcctcccaaagtgctaggattacaagcgtgagccactgcgcccggcctttttttttttttttttgagatggagtttcattcttgttgcccaggccggagtgcaatggtgtgatctctgctcaccgcaacctccacctcctgggttcccccgattctcctgcctcagccagccaagtagctgggataacaggcaagcggcaccatgcctggctaatttttatatttttagtacaggcagggtttctctatgttggtcaggctggtctcgacttcctgacctcaggtgatcctcccacctccacctcccaaagtgctgggatacaggtgtgaaccaccgtgcctggccgggctttctattttcttgccatttttttttttttttttgagacagagtcttgctctgtcacccaggcaggagtgcaatggcgcgatcttggctcactgcaaccccccacctcccaggttcgagcaattctcctgcctcagtctcctgagtagctgggactacaggcgcgcgcaaccatggttgcccggctaattatttttttttaatttttactagagatggggttttaccacgttggccaggctggtctcgagctcctgacctcagttgatgcgcccgcttcggcctcccaaagtgctgggattacaggggtgagccaccatggttgacctcaggctattttcttaagcaaatttgcaacttaagaagtaaagaaataggaccagaagttgtttaaagttcacagtgggtacctctaaatctattagttatctattagtgattgtataatttatactatataaattgtataattctacaaaacaggatgctctttgagagagagaattgtattgaaataacagacttaaatcaggtctatcctgctcaaacttggatttactgttactctgttaatgaggtaaaggaattccatccacagaattttgccaggaagtttattactacagttagaaacataggaaacacaggggagaatatttcaggacagaaattatgaattttctctacattacaacctgcacatctaagtgaaccagattcttgatgcctcggcccttgtgagaaattttcttccacttttaggatgattttgatcatgtgttgctgtttctagaaatccagatgaggcactcttcagccaaagttgctgcccacccaagaggccttttatcttgaaatttagtcatgagaccagaaggaacttctcccatctgtgtcctgacttggtattagttttattttggatacctcctttttttttttttctttttttgagatggcgccttgctctcgtcgctcaagctggagtgcaatggagcaatctcattgcaacctccatctcccgtgttcaagcgattcttctgcttcagccttccgagtagctaggattacaggcgctcgccaccatgcctgcataatttttgtttttgtttttgttttgagatggagtctcgctttgccacccaggctggactgcagtggcacaatctcggctcactgcaagctccgcctcccgggttcacgccattctcctgcctcagcctcccgagtagctgggactacaggcgcccgccaccttgcccggctaattttttgcatttttagtagagacggggtttcaccacgttagccaggatggtctcgatctcctgacctcgtgatccacccgcctcggcctcccaaagtgctgggattataggcgtgagccactgcgcccggccaataatttttgtatatttagtagagatggggtgtcaccatgttggccaggctgatcttgaattctggacctcagatgattgacccaccttggcctcccaaagtgatgggattgcagacatgagccaccacacccggcttttttttttttttaagagaccgagtctcactttgtcacccaggctagcgtaggagtacagtgacacaatcatagctcactgcagcctagaactcctgggcccaagggatcctcctgcctcagcttctcaagtagctaggactacaggcatgtgccaccatgcctggcaaattattttatttttgttttttaaatttaaaaatagagacagtatcttgccatgttgcctaggctggtctcagaactcttgaactcaagctatttttattttttttttgagacagggtctcactatattgcccaggcccagtcttgaattcttggcggcctcaaaggattccctgcctcagcctcccaaagtgctgctattacaggtgtgagcctggcctggcagattcctttttttccctcttttaaataatttattttaaacctattatatcacacagtatgttttatacactgacatataaccccctaacaagataaagcaaagacaaaaaagtttatcttattagaaggaagatacaccatcacttattctcttcaagcattattgcactttaacttttcttaacttgacaaagcattcatgaagcagtctgcagactagttttaacagataaataatacctgtaagcagacatgattgtcctaaattgtttattaggtatgaattttacaaactttacttatattggctgtaacggtggagctggagagtattgcgccttctccaagctccctggtgagaaccaccaatagtgtggtggcacttaaggccctttccaaggctatggctctttcggcctgcagatggcagcccatgcatcttcctatgcttgtggactggtttggtgatccattgggtgtcaggatttcttctgatagctttatggaatggatcaatgaggataacctcaaaaaacttgtatgtggaatcttcaccaacccagtgagaattcaggacttttagagccccacagtggcatccagcttgccgctttgcaatggactgaagactttgagcaaactttagctggttaacaccatgatggacaggcttgccataagttgcacccttaggaactgggtgctttcggccaccatggcgaacacgaatcctatatataacataaacttggttggccttgtagcccagctggtgcgctttatcaagccagatggggtggggagccctgtggagagcagagagctggtggtactgccagcaaccaactctcagaagaaagtgcattttctccatagctcctggatttacttgtatgcccccatcttggcttacctgatggctgctgctagacagaaggggcacggattcttttattaaaatcacaatatgggtttattaatcccttacttgtatttatggttgttttttgcctattaaacatcagcattctagtataatttccattcttttactcataacaatatgatgtttaaaaaatactgatttttttctgtcttttttattcttatttttctcgaaccctatgttcatcatcaacctcttttctcctactatttggttcatcaaccttattttctcctgtttggttcctagaaacctcaagtaagcttactgttgttaccctaatgaaataccattttaagtaagttatatagaaaaaatgcataaatatattctccttacaaaaatgaaaaactttgatgtcatcttaagataatttactgaggccgagcgcagtggctcacacccgtaatcccagcactttgggaggctgaggtgggcggatcatgaggtcgggaaatcgagaccatcctgtctaacacggtgaaaccctgtctctactaaaaatacaaaaaaaattagctgggcgtggtggcaggcacctgtagtcccagctacttgggaggctgaggcagcagaatggggtgaagccgggaggcggagcttgcagtgagcagagattgcaccactgcactccagcctgggtgacagagtgagactccgtctcaaaaaaaaaaagaagataatttactaaatctaaactccttttaaaaattgctgaggactgcccgggcacggtggctcatgcctgcaatccgagcactttgggaggctgaagtaggcagatcacctgaggtcaggagttcgagaccagcctggccaacatggtgaaaccctctctctactaaaaatacaaaaatcagctgagtgtggtggctggcacctgtaatcccagctacttgggaggctgaggtgggagaattgcttgaacccgggaggcggaggttgcactgagccaagatggtgccattgcatttcagcctgggcaacgagtgaaattccgtctcaaaaagaaaaaaggcttaggatgaccggctgtagtggctcatacctgtaatcctaacactctgggagaccaaggtgaccggggtttgaggacaggaatttgagatcagcctgggcaacatagtgaaaccctatctcaattaaaaaaaaaaatagctaaggagtggtcctaaatatggctgacatagttgatttagagatttacctgttgattatcttgatttttttcatttttgtatctagaagaaactgaacatttttatacatatgtcttatatccatgtgtgcctttctctagggtagatgctgagaagtagaattgttaggttatagggcattttttaagtttatgagtcactttttatttatttattttttaatgtttttatttttattttttattttttgagacagagtctcgctctgtcgcccaggctggagtgcagtggcgtgatcttggctcactgcaagctccacctcctgggttcatgccattctcctgccttagcctcctgagtagctgggactacaggcgcccgccaccacacccagctaattttttgtatttttaatggagacggagtttcactgtgttagccaggatggtctcgatctcctgacctcgtgatccgccacctcggcctcccaaagtgctgggattacaggcgtgagccaccgcactggcctttacaagttgctttttaaagtaactgtataaactgatactcccactattagagtttgagaattgtcttctttcacaattttttttttttttttttttgagacagtctcactctgtcgccaaggctggagggcagtggcactgtgtcggctcactgcaacctccgtctcctgggttcaagcaattcttctgcctcagcctcccgagtagctgggattacaggcgtctaccaccacgcccagttagtttttatatttttagtagagatggggtttcaccatgttggccaggctggtcttgaactcctgacctcaggtgatccacctgcctcagcctcccaaagtgctgggattacaggcatgagccaccgcgcctggccattctttcacattttaaaaagcactaatttttaccacattttcccttaaatatgataagatgtgaaatattgatatcatcagtgcattttcttaattaaaattttgccaaaagattatggtcataagaattaagctgagtgaaataggctctgctgtgttgtagcttttgtttaaagtatcctagcccttaaaaatatattattttctttaactatttacagttatttccttgtaggtcccagggtttaaggataacgttttattatttatttatttttactttatttatttatttgagatggagtctcgctctgttcctcaggctggagtgtggtggtgcgatctcggctcactgcaacctctacctcctgggttcaagcgattctcgtgcctcagcctccagagtagctaggataacaggcacccgctgctatgcctggctaatttttgtgttttttagtagagacggggttttgccatgttggccaggctgctctcaaactcctgacctcaggtaatctgcctgcgttggcctcccaaagtggtgggattataggcgtgagccactgtgcccggcctaagagtaacattttaaagatagtgaaataatgctcaaaaaagatgtactggtatatagtgtctgtcttactaatgatgtttgaaaaatggagatatgttttaaatttttaaatttaaaacaatttcctcaactggcttgctatttcagtcttaggtgttctctaatgacatgcagcatgatttcctccatgttaaaacatgagaaaatgaaaaatttcctttcttaggcttcttttacttgtaatctgtacgtatatataatttttttttttttaatcagagtctcactctgttgcccaggctggagtgcagtggtgcagtctcggctcactgcaactttcacctcctggattcaagtgattctcctgcctcagcctcctaagtagctgggattacaggcatgcgccaccacacctggttaatttttgtttttttagtagagatggggtttcgtcattttggccaggctggtcttgaactcctggcctcaagagatctgcctgccttggcctcccaaagctgtttggattacaggtgtgagccactgagcctggcctgtatatataaaattatatttaaaacctggtggacttctttccatgtcaatacatatacagctttgtctgatttctaaaagttatatagtattctgtgtattattacgtagagactgtttaaataggattatcaacaaagttgcactgaacatcctatatggacatctttgtaccttttcttgattcctagataatttcctgaaaatggaattcttttattaaaagttatatacattttagatgacagattacccttgaaagatatactaccttggctgggcgccgtggctcatgcctgtaatcctggcactttgggaggccgaggtgggcggattacttgaggtcaggagtttgagaccagcctggctaaaatggtgaaaccctgtctctcctaaaaatacaaaaaaattagccaggcatggtggcaggcgcctgtaatcccagctgcttgggaggctgaggcaggagaatggcttgaaccccggagggggaggttgcagtgagccaagattgcgccactgcactccagcctgggcgacagagtgagaagattccgtctcaaaaaaaaaaaaaaaaaaaaaaaaaaaaagaaagaaagaaagaaatactacctcatactcttaccaacagcaaacagcatgagagaaataaagagactctgtctcaaaaaaaaaaaagttgtatttgtaattttctcctgttatattgttgtcgtttttttttttttttttttttttttttttttttttttggacagagtctagctctgtcgccccagctggagtgcagtggtgcaatctaggctcactgcaacctccacctcccaggttcaagcgattctcctgcctcagccttctgagtagctgggactatgggcatgtgctaccacactgggctaatttttctatttttagtagagatggggtttcaccatgttggccaggctggtctcaaactcctgactccagtgatccgcccatcttggcctcccgaagtgctgggattacaggtgtgagccaccaggcccagcctatattctgttaatgagaggattgttctgtcagttcagtgtaatacgctgtgtttttttttgttttttgtggtggagttttgctcttgttgcccaggctggagtggaatggcaagatctcagcttaccgcatcctctgcctcccaggttcaagcgattctcctgcctcagcctcctgagtatctgggattacaggcatgtgccactgtgcccggctgattttgtatttttagtagagacggggtttctccatgttggtcaggccggtctcgaactcctgacctcaggtgatccacccacctcggcctcccaaagtgctgggattacaggcgtgagccaccccgcccggcaacactgttaatatttcttacttcttgatttggagactgaagatcaccttgaatctatgtgtcaaatggggttgattttttgctaggaatttaagtctcagaaccttggattttggttggaaatgatgattatactgatttactgaaattgacataatagttattttgttgaatttattgaatgaagtagttgtaaaaacaattctatatattttctttagaattcggttccctcaaaattataaaggcaggaaagctcaagacaaagaaatccaacaaggtatgtcttcataggaaatagttcttaactgtattgatttttgaaaattgaggctaagaactcttaggttattataagtgtatttttcttctaattgtattattggtattagattaaagttaatattatggaaaatcataacctttatccaaatctctatatatgcctttgttatcatgtataactcaatttaatgttattaaatagtggtgaaagttttatcataagattaagccattcttatttcaaaatgttctattgtttgcagaaactttttgattaatttggcagatgcctgcatataactgaatataaatgattatttaaaactcctttcacttttagaaaatgtttttttcctgcttaaaatttctaaaagtaatttcagacctaacacttatttgttacttcttaggctagtgatttcagtgatatggagaattggccaacaccaagtgaattagtgaacactggagtgagtattgttttaaagtttttttttttaaagaaaggaaaatgtattcatttcgacatgcagaattttattttacttaaaatgtaaagaattgtcatactgggggacagattttttttatttttttgagacagggtcttgctctgtctccaggctggagtgcagtggtgtgatcacagctcattgtagcctcaaactgctaggctcaggtgatcttcctacctcgacctccagagtagctgggactacaggcacgcaccactgtgcacagctaatttttgtatttttcatagagacaggattttgctggtctccaactcctgagctcaagtgatcctcctgcctcagcctcccaaaatgttgagattacagtatgagctaccattctggctgaggaacagatttaaaaacttgattcatcaagaagattacattttgttactttaatttgcagttattcttcgatgctgccagtaacattggtaatgaacttgttgtcttaagctttactcatgggaagcttaacctaacctattatttctttctttcttttctttttttttttttcctttgagatagggtctcactccattacccaggctggagtgcagtgatgtgatcacagctcactgcagccttggccttccaggctcaggtgatcctccacctttgcctcccaagtgactgggactacaggtgtgtgccaccacactgggagatttttaaactttttgtagagatgggggtttggtcatgttgcccaggctggtatcaaactcctgagctcaagcaattggctcgcctcagcctcccaaagtgctgggattataggcgttagccaccatacctcgcctattatttctttaataatgaagacatattataaattgtaatcaaatttttatatttgtataaaatcacatacattgataaagaggtgctgaaaacgtggcagctatccttttgatagtttacccgcttttcagataacctaatttaattcatcacatttccctcatctggttatattctttttttgagacagagtcttggtctgtcgcccaggctggagtacagtggtgggatttcagctcactgcaacctccgcctcccgggtttaagtgattctcctgcctcagcctcctgagtagctggtattacaggcacgcaccaccacatctggctaatttttgtatttttagtagagacagggtttcgccatgttggtctcgaactcctgacctcaggtgatccacccaccttggcctcccaaagtgctgggattacaggcgtgagccactgcgcccagcctcatctcgttgtattcttaagaggtaatcttatatttgagatttgcattttctagaattttatatatgtggaagcattgagtaggtactcttttttttcctggcttgtactcagcattattttgagatttacttgtgtgtcagcagttcattcttttttcttactgagtagtatggatgtaacacagtttgtccattcacctattgttaatggacatttggattaattttacgttttggttgatacaaataaaactgctatatgaacgtttgtgtagaaaatttttcattttttcttggatatgtaactaggttggatcacttagtagctacctgttttagctttttaagaaactgctgagtttgcacttctatcagcagtgtacatgaattccagttactccacatcttcactcactctcttttttgtgtgtgtgtgtgagaccgggtctcactttgtcacccaggctggagtacagtggcatgatctcagctcattgcagtcttgacctcctgggctcaagtgacccccccacctcagccccataagtagctgcgactataggcatgcaccaccacgcctggctaatttttttgtattttttgtagagatggggtttcgtcatgtgcccaggctggtctcaaactcctgagctcaagtgatctacctgccttggcttcccaaagtgctaggattacaggtgtgagccaccgaacccatctttactcaccgataatatggtcaagtttcaaaaaatattttagccattctaataaatgaggagtggtatcccattgcagttttaatttgcatttttctgatgaatgaatgcaataatcttttcatagatttgccatcagtgtatctttttgatgaagtatgtgatcaatctgcccatttaaaaaaatggaaggctgggtgcaatgggtcatgcgtgtatcgcagcactttgggaggctgaggacggtgaatcatttggggttaggagttcgagaccagcctgaccaacatggcgaaaccccctctctacttaaaaaaaaaaaagagttagccaggtgtggtgacatgtgcctgtaataccagctactagggaggctgaggcaggataattgcttgaacccaggaggtggaggctgcagtgagccgagatcgtgccactgcactccagcctgggcaacaaagtgagactctgtcctcccgcccccgcccctgcaaaaaaaaaaagtggtattgatttgttgttactgagttttgaaagttcatatgtatttgaggtaaaagttctttatcaaatacttagcaaatactttctcctagtctgcagctttacttttaactgtcttttgaaaagtaattttttgcctttgataacagtttttgtcatttgttttgcaattttaggttaggtatattgccacaaatttttgggtatgttagtgaaaatattaatggaaatcatttcattctgaaaacctttttgcagtttcagagcgtcctcagccaaggaaataaaaagccacaaaatagaaaagaaaaagaagagaaggttgaaaagagaagtaacagtgacagcaaagaaaaccgggaaacaaaattaaatggtcctggtgaaaacgtcagtgaggatgaggctcagtcaagtaatcaacgtaagagaggtcagtttgtccatatctttattttgattttagtttttgaagaaagttgtaatgaggaattacatttcattaactgatctctggtagtcaaaaatgtatagtttgtatttcttcaggataaacaatctgcagaggtaactcatttgcttttgtaacatttctgaactattagactttcctttttgtatgtaacttgtattctatgcaagaaaatggaatggagttccacttagaggtacagttgtagatacattcttggaaagttgtgtgataattattgttcttttagatctgcattggaactgctccctatatttagggagtactgtgaaaattaaatacatttttttcctaagagaaaagtgagaataggctgggcgcagtggctcacacctgtaatcctagcactctgggaggctgaggcaggcggaccacttgaggtcaggagacatggtgaaaccctgtctccactaaaaatacacaaaaaaattagccgaacatcgtgttgcgcacttgtagtcccagctactcgggaggctgaggcaggagaattgcttgaacccaggaggtggaggttgcagtgagccgaggtcgcgccattgcactccagcctgggcggcagtgcaagactgtctcaaaaaaaaaaaaaagtgagaataattttagtcaatcttttccctcatagcattcccctgtcaaaattacactttgaaggaatgaaaatattgtcttcatatccttttccattttcttttctgaacttttcgtgtgtctagggacagtttatgatttacatgctttgtaaatcagtgctcggagtcttcgtaaaagtgtcttcaggcgcttctaggcagaaaagggctttaaactgttaagttgtcagtgactgaagcaaggtgattttctgggagagtagcaggaggtgaggttagagacatagatagacaacgtccatggtatacagggccttggagttatgattccattttgaataccatgggaaaccattgaaccaagattctctggaggtgatatggcatgggagggaacatttaatggtaaagttgttgccaacttctttaacactttaacttttaccgtagactgatcacttacttgaatagtttgtcttttttttttttttttttaagagacagagtcttgctctgtcacccaggctggagtgcagtggcccagtcttgactcactgcaacctctgcctcccgggttctaggaattcttctgcctcagcctcctgagtagctgggattacaggcccatgctaccatgcccagctaactttttgtattttagtagagacggggtttcactgtgttgcccaggctggtcttgaaatcctgagctcaggcgatccacctgcctcggcctcccaaagtgctaggattacaggcatgagccaccgggcctggccgaatagtttgtctttttaataaataactaatccttagtgcaggatgagcattatattcacttgatacaatgaataaaggctaattgctcaaaaacagtgacaacaagacaaacaagtggttgttagaaaaatttcttcctgtttctttttttttaatttttaaatttaaaaatgtttttaaaattttgaaacagggtcttgctctgtcacccaggctggagttcagtggcatgctcgtggcccactgcagcctcgatgacctgggctcaagtgatcctcccacctcagcctcctgagtagctgggactacaggcatgtgccaccatgcctggctaatttttgtatttttttgtagagacagggttttgccatgttggccaggctggtcttgaactcctgggctcaagcgatccatctgcctcagcctcccaaagtgctgggattagaagtgtgcgccaccatgcctggcctcctcatttcttaactacttcgtcacttaactgttccctgcttcctacatacgtaagtagtgttcttgactgtctagaatccatacagatgacagatttgttatcctgatctaaaatttgtctttttttttttttttgagatggagtttcgctcttgttgccacgctggagtgcaatggcgcgatctccagctcactgcaacctctgcctcctgggttgaagcgattctcctgcctcagcctcccaagcagctgggattacaggcaccacacccagctaattttgtattttttttttttagtagagacgggtttctccatgttggtcagggtggtctcgagctcccaacctcaggtgatctgcccgccttggcttcccaaagtgctgggattacaggcgtgagccaccacgcctggcaatttgtctttaattgcttcaattaaaactggtcagtcaacagtaaaacccaggtgttttgtagttagaacaattggtataatcaagcttttaattgatctagagtacagatttttgactttaaaagaagggcttctttgtgtcaaggaatctcgttgacataatttatagtataagattaaaagcctttttagatgcatttatattcacttttcctcatttgatccatagtttgcaggatttataggatatcaatattgtagttgcacactaatatttatttttaaattgccttggcagttttttcattgccatgagtctttattttggtagaaaatttagattgggcagaatactgaacattttgaaacctgagctatggcattcatgaatagatgatcttcagaatttcactatagaataaccataaataattagttacattgtcatttagtcatcaagaaaagttaaactgcttgtgtttttttttccttaggaagatgcataatagctgtaaaatgttctgtcaagttaaacaaattttatacttatccctcttccctcttatattttgagaaacctcattcatttgtaaaaatcctgggtaaattaatattttaggcagtgatgtggaactaaaagtgctgcaaacctaaagcctaactttccaaagtatacattatagcgttttatcagatatatcccattctaaagcctaagaattttaaattaaacagatttttttttaaaaaagcctaagaatcaagtactaaacaggaatgttatgtatatatacttttttttttttttttttgagacagactctcgtctctgtcacccaggctagagtgcagtggcacgatctcggctcactgcaacctctgcctcccgggtttaaggaattctcctgtctcagcttcccgagtagctgggactacaggcatgtgccaccatgcctggctgatttttgtatttttagtagagatggggtttcaccatgtttgccaggctggttttgaactcctgaccttaggttatctgcccgcttcagcctcccaaagtgctaggattacaggcatgagccactgcgcccggccttttttttttttttttttttgagatatagatattggactgttaattgtcattgaagtattttggtctgaggtaggcttatgcagaggagaatgttttcatgttacttatattaacattgtttcttctacgaaatgacagattggtccaatgtgatgtaaggagttcagttgtgtgtttgggatttttgggcggctgggcgtcgagcttgaacgctttgatggctgcttttaggccaactatggggattgtactttttactctctttacaaggttttttcctagtgtctaaagagctgtccttctttagactaacagttaaatttacaaggggattgggggttctgtaggcaaatttaaagttgaactaagattctatcttggacaaccagctatcacccaggctggagtgcaatggcacgatctcggctcactgcaagctccgcttcccaggctcaagctattctcgtgcctcagcctcccgagtagctgggattactggcgtgtgccaccacacctggctaatttttgtgttttttagtagagacagggtttctccatgttggtcaggctggtcttgaactcctggcctcaagtcatccgcccaccgcggcctcccaaagtgctgggattacaggcatgagccaccgtgtctggcctctttacaaataatcttaaaatacacattaagtgtttcacttatttgattaaagttcagagtgctttcaaattgcaagggtttagtgaaaattgtacatttgtccttaaatgattttgttttcttcaagctaataagcacaagtgggtaccactccacttagatgttgtaagatcagagagtcaagaaagacctggatcccggaacagctcaagatgtcaacctgaagcaaataaaccaacacataacaataggagaaatgatacacgaagtaagttaccattctaagacaaaaatgactaaggaaagacttagtcttaatgctcgttattttagtaaccacatgtataaaccatttgagaataagttgaagacatcatgtccctttaaccccaaataccttcagggtatatttcataagaacaatataaccgtaatgcaattaacaacaatgaaacttaacattaatacaatgtgattgtccacaggcagatttttctcaataaagtcctttatagtcgtcccctcccctgctccaaggatccattctgggatcacccatttaatttaattttttttttctctttaggctccattaatctgtaacagttcttgcttttgtctttcatgacattgatttttttgaagattgtaggataatcgtattgtagatatcccttactttgggttttctaatgtttccttatgattggattggggttgtgaatttttggcaggagtactgtataagaaaatatatcattttcttctttttttttttttttaatttttattttttttattgatcattcttgggtgtttctcgcagagggggatttggcagggtcataggacaatagtggagggaaggtcggcagataaacaagtgaacaaaggtctctggttttcctaggcagaggaccctgcggccttccgcagtgtttgtgtccctgggtacttgagattagggagtggtgatgattcttaacgagcatgctgccttcaagcatctgtttaacaaaacacatcttgcaccgcccttaatccatttaaccctgagtggacacagcacatgtttcagagagcacagggttgggggtaaggtcatagatcaacaggatcccaaggcagaagaatttatcttagtacagaacaaaatgaaaagtctcccatgtctactactttccacacagacacggcaaccatccgatttctcaatcttttccccacctttcccccctttctattccacaaaaccgccattgtcatcctggcccgttctcaatgagctgttgggtacacctcccagacggggtggtggccgggcagaggggctcctcacctcccagtaggggcggctgggcagaggcgcccctcacctcccggacggggcggctggccgggcagggggctgaccccccccacctccctcccggacggagaggctggccaggcagaggggcgcctcacttcccagtaggggcggccgggcagaggcgcccctcacctcccggacggggcggctggcgggcagggggctgacccccccacctccctcccagacggggcggctggccgggcggggtgctgacccccccacctccctcccggacggggcggctggccaggtgggggggctgagcccccccacctccctcccggacagggtggctggcccggcagaggggctcctcacttcccagtaggggcggctgggcagaggcgcccctcacctcctggacggggcggctggccgggcggggggctgacccccccacctccctcccggacggggcggctgccgggcggagacgctcctcacttcccagacggggtggctgccgggcagaggggctcctcacttctcagacggggcggctgccgggtggaggggctcctcacttctcagacggggcggttgctgggcggagggtctcctcacttctcagacggggtggctgggcagaggtgctccccacatctcagacgatgggcggccgggcagagacgctcctcacttcccagatgggatggttgccgggaagaggcgctcctcacttcctagatgggatggcggccggcagagacgcttctcactttccagactgggcagccaggcagaggggctcctcacgtcccagacaatgggcggccaggcagagatgctcctcacttcccagacggggtggcggccgggcagaggctgcaatctcggcactttgggaggccaaggcaggcggctgggagatggaggttgtagcgagctgagatcacgccactgcactccagcctgggcaccattgagcactgagtgaaccagactccgtctgcaatcccggcacctccgggaggccgaggctggcggatcactcgcggttaggagctggagaccagcccggccagcacagcgaaaccccgtctccaccaaaaaagtacgaaaaccagtcaggcgtggtggcgcgcgcctgcaatcgcaggcactcggcaggctgaggcaggagaatcaggcagggaggttgcagtgagccgagatggcagcagtacagtccagcttcggctcggcatcagagggagaccgagagggagaggggagaggggagggggagagggagagggagagggagagcggaatttattctatcattttcttcttagcgaatcacatgggagtatgaccttgatttgtcccattattgaagatactaactttgattacccctgtaactttgattattagtttgattacaacattgattaatattaactttgattacccctgtaactttatttgattattagtttgattacaacattgattattattattattatttgttttttgtttgagatggagtctcgttctgttgcccaggttggagtgcagtggcgtgtgatctgggctcactgcaacctctgcctcccgggttcaagcaattcttctgtttcagcctcccaagtagctgggactacaggcacatgccaccacacccggctaatttttaaatttttagtagagatggggtttcaccatattggtcaggctgggctcgaactcttgacctcaggtgatccacccacctcgatgtcccaaagtgctgggttataggcttgagccactgcgactggccacaatgattattaaccttgattacttggttgaggtagtgtactctagacttttaaaaaatttttaagtttcttcagcttttttgtttaatttcttttctccctttgtaattactgtgtaatttgtggagagaggctttgagactgtggagataataattttctcagacttttcaaacaagccttagcttccttttttttttttttttttttttttaaataagtgatggggtctcattctgttgcccaggctggagtgcagtgggacagtcatagctcactgcagtcttgaactcttgggctcaagcgatcctcccacctcagcttcccaagtagctatgatgacaggtgcgtgccaccatgcccggctaattaaaaaaaaagttttctttagagacagtcttgcttcgttgcccgggctggtcttgaactcctagcctcaagcgattctcctgcctcggcctcccgaagtgttgggattacaagcatgagccaccgcacttagcttctccctctttattgccaaataatattctgttgaatgcatatagccctttgtcttttcatctgttgatggataagtggcttgtttatagtttttggtcttcatgaataacgctgatgaatagttgtttacaagtctttgtgtggaatgtatgtatttctcaaatgcctgtgagtgaattgattggtcatatagtagctgtatatttaacattataagaaactgctacttgtagcattttacatttccatcagcaactttttttctttttgctatgtgttaagtcccatgtctagtggaattcctgtattttggatttggctgattgctttgtcatggtattcttttttttttttttttttttttgagactgagtctcgctctgtcgcccaggctggagtgcagtggcgcgatctcggctcgctgcaagttccgcctccctggttcacgccattcacccactgagtagctgggactacaagcacctgccagcacgcccggctattttttttgtagtttttagtagagagggagtttcaccacattagccaggatggtcttgatctcctgacctcatgatccaccctctttggcctcccaaagtgctaggattacaggcgtgagccacctcgcccagccgctttgtcatagtattctttggcatttgcatgttcctttttttgagacagggtctcactctgtcttccaggctaagtgcaatggcatgatctcggctcactgcaaccttcacttcctaggctcaagcgattctcctgtcttagcctcctcagtagctgggactacaggcatgcacaacagtacctggctaattttgtatttttttgtagagatggggtttccccatgttgcccaggctggtctcaaactcttgggcccaagcgatcttccagcatcagcctcccaaagtgctgggattagaggtgtgagagccactgtacctggcctgcctgttccttttgtcttttctttttataactggcaataagaaggagctaggttgattagattcaggcttatttttttgcttggaatactgctgtgtgtatttcactttcagttgtgttaatattgagttagctcaggtgttaggttgatcagtccattataaattattccattagtctttttttttgagacaaagcctcactctgtcacccaggctggagtgcagtggcgcgattttggctcactgccttccaaagtgctgggattacaggtatgagccactgcaccctggcccattagtctttactgaatggttttactttcattaaaatcattggccagatactttttttttgtcttgagacagagtctcgcactattgcccaggctgggttctcctgcctcagcctcccgagtagctgggattacagacatgggccaccatgtctggctaatttttgtggttttagtagaggcagggtttcaccattttgggccaggctggtcacgaactcctgacctcaagtgatctgcctcccttggcctcccaaagtgctaggattacaggtgcgatccaccgcatccggcccagatacattttttcacagggattgctcagattttcagaaagcagaggataggatatgtggaaacaataggatgagcatttgtttttatagttttctgctgaaatctgataagtcatgtcctgtgaatggataagaaggcctaaggaaattttacagacttaatattagcattcaaaaattttaaatatacctatgtagaggtaaatgtattttgattaaaaaaatttccaatatattatgaaaaactttaaacatacaaaaaattgaaagaattgttcagtgaatacctgtctagccaccatctagattaataatttctctgtatttaattcattcatctgctgaatcccttgaaagtaacttggagatgttgacgctttatcactaatgtcctaagaaaatgcatcatctaagaaaatcacactagtttcctagtaccatctaaaatctagtcaatagttaatttttctcaattgtccacaaaatatgacttttaaattataaaactttagctaaatgcagtggtgcaagcctgtagtcccagctacttgggaggttgaggcaggaggattgcttgagcctgcgaatttggggctgtagtgcacaatgatcatacatgtgtgggggggagcatatatatatatatgcatatgtataaaacttgtctatagaaaaattgactttttttctattgtttttcaaaatgtcattttaagtttttattctaaaagtaatggattctcataatttcattaatttttttcttattaaatattgaatatataagaaaatagacaaagttatacagaacaacaatataatgagctgagtatggtggcactcacctgtagtcccagctacttggtaggctgaggtaaggaggattgcttgagagcccaagagttccaggctgcagtgagctatgatcatgccactgcagcctgggtgacagagtgagaccccatctctaaaatcaataataatgatgatgatgatgatgaacagtggaaactcaccctgtttaagaaatgtatgttactattacttttaaacttcgctttgtgcactctgcaatttcatcccattgtctcggaaaaaatgagcttaagtgcattggtttctttcatgttttgaaatcgccatgcaatgtgactttatcaacattctttggcaggaatttttgtttttttaattcagcctacttttctttagattaatgcatgttggttgtattactgtaagtcttttcctgctgaaaggctgtttcactatttgataaaatctgtactaacggtgggtatttggattgtttccagtttttttgatattaaggtactaccacgaacattttaatgcatgttttccagcacacaagtacaagaggctctctatggtaattttttcagactgcagactacactctgtgagtgggttatgaaatcagtatattggttcatgatcaggtttttaaaaacctagagtgcttcacatagtaaatttttaaatgatatgtgtttataaaattttttgtaagtgtacttgtatgtaaaataaataaggcttacttacagattaaggcagaaatgtttgaaaaagtggctggacgcagtggtgcacacctgtaatcccaacactttgggagcgggaggtggcttgatctgggagggggaggtgggtggatcgcttgagctcaggagtttgagaccagcctgggcaacatagtgagaactcatctctgttaaaaaaaaggaaatgtttgaaaaagactgttttaggtctaagcattgaggatggaactatgggatctagggtaatgttctcagtgagggtgatttttttttccccaaagagtcatttggcattgtctggagatatttgttactggttgtcacaactgagggagtgagtgggtgctactggcatctagtgggtggtggtcatggatgatgccaaacatcctgtagtccacagaacaggcccccacaccagagtctaaagtgctaaggttgtaaaaccttgtctctaggatttgcatatcttcacattaattagattattccaagttgattttcaaagtagatatacctattttcaacctcattagcaatatatgaatgttctacctgttttttgagacagaatctcactctgttacctaggctagagtgcagtggcgaggtctcggctcactgcaacctctgcctcccaggttcaggtgattctcctgccctagcctcccgagtagctgggattaccggcgcccaccactatgtctggctaatttttgtatttttagtagagatggggttttgccatgtcggccaggctggtctcgaactcctgacctcaagtgatccacccacctcagcctcccaaagtgctgggattacaggtgtgagccaccgcacccggctaatgttctacctttttaaactttgtcaacatttcatattagagacattaaaatatttgttgtactggggtaaagagcctttcattgtcttaatttgcatttcttacagtccataaggctgaacactgttttcgtttttcttttttttttattctgagacggagtcttgttctatgcccaggctggagtgcagtggcagggtcttggctcactgcaacctccgcctcccaggttcaaacaatttttctgcctcagcctactgagtagctgggattacaggcactccaccaccacgcctggctaattttttgtatttttggtagaggcagggtttcgccatgtttcccaggctggtcttgaactcctgagttcaagcaatttgcctgtctcagcctaccaaagtgctggtattacaagtgtgagccaccacaccgggcctctttttttttttttttggagagggaatctcgctctgtagcccaggctggagtgcagtggtgcaatcttggctcaatgcaacccctgcctcccgagttcaagtgattctcctccttcagcctcccgagtagctgggattacaggtgtgtgctatggcacccggataatttttgtatttttagtagaggcggtatttcagtatgtcagccaggctggtctccagcttctgacctcagttgatccgccccccttggcctcccaaagtgctgggattgccggcctgagccaccgcgcccggccttgtatgattattgacccattggtaggcaccgttttctgtatttattgtccacttgcatttttttaccttgcttgtattttagatatttttcccattgagtggttgtgtctgtgtgtgttgcatgagagagagtcgtatgagttcttacatgtactctagatagaatttctatatttcgcttcagatatcttttctcaatttgttttgtgttttcatttcctttttactttataaggaatgtcatttacttaaatagaaccatccttaaatatttcgtgagaaatgttttttagcagttttatgtagtacaaacttagtagtcttggaacttcttgaatctttaacagcacaatcttaataaaactatctctttacctttctagtatgttattttacttgttagaatgtattcttcatgtgtcagtaccttttaggctctgttttatgctagagatatttttgataaattcttattggatctcttcagtttgtatccatctgaaaaatgcctggctactgttcattagttacaaagtggaagaaggtggctattatgttttcataaagacaatcatgttattttacttggcaaatcgaagtatataaaaatatttttatttttaaaaggttggaagcgagatagagaaaaaagggatgatcaagatgacgtttccagtgtgagaagtgagggtggtaatatccgaggttcctttagaggtcgaggaagaggccgaggacggggaagaggacgaggcagaggaaatcctcgatgtatgacataatttttgtttcgttaaattagataaactttgaaaaaaatagagcaactatcctctattatgttttaactaattttctttgtctgataatagatggttttatgtttgttaacctttgaagttcttcactttatccgtagtaactatttttttctaatatgtgattacctttctttttctttattcacatcaagtgaactttgattattcatatggttatcaagaacatggtgaaaggactgatcaaccatttcaaacagaacttaataccagtatgatgtattactatgatgatggtacaggtgtacaggtgtatcctgtggaagaagcattgcttaaagagtatattaagcgtcaaatgtaagtggatgtttgatgtaagcagacgggatagcaaaatctgttgcaatatgaactttaatgtcattgataatgaatatgctataatttttttttttttttgagacagagtctcactctgttgcccaggctggagtgtagtggtacgatcttggctcactgcaacctctgcctcctgggttcaagtgattgttccgcctcagcctcctgggtagttgggattacaggcacatgccaccacacctggctaatttttgtagttctggtagagaacgggttttgccatgttgaccaggctggtattgaactcccggcctcagctgatctgcccaccttggcctctcaaagtgctgggattataggcgtgagccaccatgcctggctgtttataacatttttaaagctacttatttgtaaaggttggaaaatgttaaaaattattttgattatatatttttagggaatgtgattaaagtaggtgtttttaaaattttatatttggtttatgttgtttatataagtctcctggcttctatagtatttagatatttttctccttaaaggagattaggtaaaatgttattgcataatatgaataaatataagactgtaaagcttctctatatatacttgaaactgaacaagtaaaatttggcttattatttgccaataggtgtttatattagaatttgcaaattaacataaataaaaaatggtggtatcttttgattttcttcttagcaattgacttctgaattcttaagttttttttatcttctaagtttttctttgtgacacaattaaatggggactaccttatattttagttcagatttcttactctagttctcatagtagttgctttctgggtactgaatgtgaagtcaggagaatattagttctattttctgaaagaaaaaacaaaccctatgcatattagtattgtataggatattttgcttatttatatagtatgtttttatagaggcaagagaaaaatgttgccaagtaatttgcataaccaatttgttaaaacttgaaatttttctctccttacaaggtgaaggaaaagggctatttttgaaagggcataggcatttaaaaatcatctgtttttccaaaataaaatagactctactctgttactagaaaatttctttatcatcatcagccaggcaccttcctgggttgccttcatggtggatccaatttgcttacagtgtggagcaacttgtttatattgttcttgcttcttttgttacagttgatgcaaacactgaagaaaagggcctttttgtgggcagaaagtgcttgacatgtggctgtcaacttcataccactattactgtcttttttgtaacttttgctgccaagtcccttctgagacctgacagtggacatgcaactccatgtcaggataatcggcctccagtgtgctcatacaagtgagggaggagcagagctacttcagtgttgacaaaatttctgatcatgcagtgtagaatccagagcctctaaggtaggacttgatgatgtccctaggacactgagcaaaatgtcagacatggcattggtcatgcctctttttttgttgttgttctagcagtagggattttggcaaatgttagtagagcactaggtttagtgtggcttgttattattattaccattctttgattagtggagatgtggctttgaaggagtcgtgctttttactttgtattatttggtttctaatatatagataggctgattgattgaggttttgattttctttttgagaagtcactaaaagttttcctggccaggtgcggtggctcacgcctgtaatcctagcactttgggaggccgaggcgggcggatcacgaggtcaggagatcgagaccatcttggctaacacagtgaaaccccgtctctactaaaaatacaaaaaattagccgggcgcggtggcgggcgcctgtagtcccagctactctggaggctgaggcaggagaatggtgtgaacctgggaggcagagcgtgcagtgagccgagatagtgccactgcagtccggcctgggcaaaagagccagactctgtctcaaaaaagaaagaaaaaaaaatgttttcctgacacctgtggaaaaatgatgcaaaatgtatcgtacagtatgaggcctaaacgtattcaaaatggttgaggggttttttttaaacttttttttttttttttttgaaatggagttttgctctcgttgtgcaggctggagtgcaatggcacgatctcggctcactgcaacgtccgcctcccaggttcaagcaattctcctgcctcagcctcccgagtggctgtgattacaggcatatgccaccacgcccagctaatttttgtagttttagtagagacggggtttcatcttgttggtcaggctggtctcaaactcctgtcctcaggtgatccacccacatcagcttcccagagtgctgggattacaggcgtgaaccaccgtgcctgacctttttttttttaaaaacattttaaaaactttttattgcagtctacttttttttaactttttaaaaatttttttgagatgctaatttttgtatttttattagagacaaggtttcaccacgttggtcaggctggtctcgaactcctgaccttgtgatccgccgtcctcggcctcccaaagtgctgggattacaggcgtgagccaccacacctggcctacttgtttttaacattttaagtgaaaacttgtattaattgtttgtgatgtcagcattaaaatgtaaagatcttgattatttctagctgtgataatctctcttggcactcagatgacagcactctgatagatttgtagatctttagaggttttttccttttttctttttctttttcttttttttttttttttttgagacattgtctcactctgtcgcccaggatggagtacagtggcgcaatctcggctcacctcaacctctgcctcccgggttcaagttcaagcaattctcctgccttagcctctcgaatagctgggattagaggcacgtgacactgcgcccagctaatttttgtatttttagtagagacagggttttgccatgttgccccatctggtctcgaatgcctgagctcaaagtgcctggccaggacagtttgttattgatttagggaagttcacatctcacagctaagaacagttgtaacttgtgactaaattaaatgtcttaatgtctgaaattttagaattttttttttcttttgaaatggagttttgctgttgtcacccaggctgcagtgcaatggtgcaatcttggctcactgcaacctccgcctcccgagtccaagcgattctcctgcctcagcctccccagtagctgggattacaggcacgcaacaccatggccgactaattttgtatttttagtaaagtcggggttccaccatgttggtcaggctggtctcggattcctgacctcaggtgatctgcctgccatggcctctcaaagtgtggaaatgacagacgtgagccaccgtgccctgcatgaaattttagaattttaacacatgtattatgtatctgccacatgccagacactatgaataaggcttttgaggtgtaacaaccatcagaatcttcattgctttaagacttcagtgtttaaaattttttcctttagtgtttaaaaagagtaaatgaggccagggcatggtggctcactcctgtaatcccagcactttgagaggctgaggcaggtggatcatctgaggtcaggagttcgagaccaggctggccaacatagtgaaaccccgtctctactaagaatacaaaaattagccgggcatggtggcacacacctgtagtcccagctactcaggagggtgaggcaggagaatcgcttgaacctgtgaggcggaggtcgcagtgagccgagatcatgccatcccactccagcctgggcaataagagtgaaactccatctcaaaaaaaaaaaaaaaaaaaaaagtaaatgatttactagtgttactgagtgagatgtcagtagtatttcagtagtctttgagagagctttgcactctgacaattgggtaaatatcaaactattaaaggaaaatttggatatttacattcttaaaataagttgatttattttcttccccttcagtaaaaggtagctgaaaacaagtttccagttatagatgcctttttttcaaagatagaatttggcccatatacttcaagggcatctttagtcactgagttttataccccaaaatgtgagctggtttgttttctcataacttgtattccatgtttgaaaactttctctgtgatttggaaatagtgtgggattattaaactgtaggccccatcatcattgatgttatgtatttcttttgtatcattcttctctatattttcccgtttgtcttcttctctgtctttaaaatcctcatactctcatttacatatatggaggctataatttttttttttttttttttgagacggagtctcgctctgttgcccaggctggagtgcagtggcacgatctcagctcactgcaagctccgcctcccgggttcacaccattctcctgcctcagcctcccacgtagctggcactacaggcgcccgccaccttgcccggctaattttttgtatttttagtagagacagggtttcaccgtgttagccaggatggtctcgatcttctgacctcgtgatccgcccgcctcggcctcccaaagtgctgggattacaggcgtgagccaccgcgcccggcctatggaggctataatttaaacatgtatttctctctctttaacctttcctatggtgtggataaacatgtatttctcaaaggctattattaaatgtattgtgaatattatctttatatcttgggatttgtagttactgatcatactgacagttcatccatttacatttctctcggaaaggttaagtgggtttgtgtttttcaagagaagataaaacatctaatcatcttctatatttttgcttccatgtgcctcatggtgtcaaggatattccttctttagctatattctgttcacccttaatgtctttcttttttttttttctgtttgagatggagtctcgctctgtcgcccaggctggagtgcagtggtgtaatcttggctcactgaaagctccgcctcccaggttcacgccattctcctgcctcaacctcccgagtagctgggactacaggcgcctgccaccacacccggctaattttttgtatttttagtagagacggagtttcaccatgttagccaggatggtctcgatctcctgaccttgtgatctgcccgcctcagcctcccaaagtgctgggattacaggcgtgagccaccatgcctggctaacgtcttttattattgtttttagacagtcttgctctcgcccaggctggagtatagtggcaccatccctgttcactgcaacctctgcctcctgggtgcaattgattctcctgcctcagcttcccgagtagctgggattacaggcacccgccaccatgcccagctagtttttgtattttagtagagatggggtttccccatattggttacgctggtcttaaactcctgacctcaagcgatccacccacctcagcctccgaaggtgctggggttacaggcgtgagccacctcaccgggccacccttaatgtcttatggtctgtctatcaaagaaagaagcatggagaacttgaatcgttcaaaatatatatgtgcacatatgcctgtgtgttcactaagttttttttgttttgttttgtttttttttgagatggagttttgctcttgttgcccaggctggagtgcaatgacgcgatcttggctcactgcaatgtttgctgcccgggttcaagggattctcctgcctcagcctcctgagtagctgggattacaggcatgcgctaccacacccggataattttgtgtttttagtagagacaggttttctgcatgttggtcaggctgatcttgaactgccgacctcaggggatccacccatctcagcctccccaagtgctgggattacaggcatcagccaccgcgcctggccatgttcactgagtttttaactaagaattgtgctggttactaggcttcagaagtattaaacatggcagtactttgtcaacttagaaaacaaaatgaactacttttctgtatgtgaatttgacaaaggatatttccagtataccactcttctcagcgactgggaaaaaggtggaaggcattatgctaacatgggattagctttgttatctaatgcttaaatgaaacaagtagaagtggctttgtaaagattttcatctaattaactcattaaaaaaaattattgaactattttaaggtaaaatgagcagcttaattctttatatttagtgaaactgatctaaatagaagttattaattttttggaaaataatattttaagtttaagagaaattattaattcagtagagttttttgctatcttatatgtttaccctatctgtgttgtattagagctatacatattgttaaccaaattacaatattttcatgttaatgattggttttcacagttaatgtgggagcaatagaaatatttatttcctactaaataaatggatgaaattctgatttctcttttcagtgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggtaattgctcatttgatgaacaatttgtactttctgctcaaatttcctttgtacctaaaacttctctgaaaaacagagtactaaaaacagacaatctgtagttgcttgaggctcagacagcattccatgatgtttttctattttgtaaaaccttcataaatgtctaaccttggaaacccctgaaagtattgctaacgatgttactgtgtattttctccttcccctccccctcaattagtcaacctattttaaacctgatccttcaaactttaacccttttgaacacccttggtccttaaaacttcttcagggctgggcgtggcggctcgcacctgggtgatagagtacaacggcgcaatcaaacacaaatttcttcaggttactgtaaaaaagcatgtgttcctgtatatgtatgtgtatatatatatatatatatattttttttttttttttttttttttttttaagacagtgtctcactctgttgcccaggctggagtgcagtggcatgatatcggctcaccacaacatctgcctcttgggttcaagcgattctcctgcctcagccttctgagtagctgggactacaagcacgcaccatcatgcccggctaatttttgtatttttattagagacttggcttcactatcttggccaggctggtctcgaactcctgaccttgtgatccgcccaccttcgcctcccaaaatgctaggattacaggtgtgagccagcactcccagccgttcccacttattgaaaggctaatttcaaatagtccttctggctgggcatggtggctcatgcctgtaatcccagcactttggggaaaaaaaaaatctctcatctggtctgtttctagaaatgctttcaacatctttttttttctagccaatttctttccctacacacaacccttggtaaccacaatcactaatctgctttttctttttttctttctttttttttttttttgagacagagtctcattctgttgcccagtatggagtgcagtggcacaatcttggctcactgcaacttctgcctcccaggttcaaggattttcctgcctcagcctcccaagtagctgggataactggagtgtgccaccatacccagctaatttttgtatttttagtagagacagggtttcccaatgttggccaggttgtagccttttgtttctgatttttcacttagtattgtgcttttgagattcacctatgttgcatgtagcagtagtttgttctttcatattgctgactagtattccatggtatggatataccacagtttatccattcacttgttggtggacattcagattatttatggttttggagagtgtgagtaaagcatgaagatctttatagggatatatatatacacacacacacacacacacatatatatttctgttggataaatatctagtattgtgattgctggaaagtatagtaagtatatgcctatctttataagaaaatgccaacctattgtccaaagtggctttaccattttgcattcccacgattatctataggacttgttcctcagccttatcattgcatatattgtcagttttttgaataatagatatatagtggtttctcattgtgggttttttatttttttgggacaaagtttcagttttgctcttgttgcccaggctggagtggagtgcaatgccatgatcttggctcactgcaacctccacctcccggattcaagcaattctcctgcctcagcctcccaagtatctgggattacaggcgcctgccaccacactcagctaatttttaaatatttttaatagagacgagatttcaccatgttggccaggctggtctcgaactcctgactttcaggcgatccatccgccttggcctcccaaagtgccgggattacaggcatgagctaccgcgcgcctggcctgattgtgtttttttgtttgttttttgagacagagtctctctctgtcgcccatgctggagtgttctggtgcgatcttggctcactgcaacctccacctcctgggttcaagtgattctcctgcctcagcctcccaagtagctggtactacaggcgcacgccaccaagcctatctaacttttgtgtttttagtagggatgggggtttcaccatgttggccaggatggtcttgatcttttgaccttatgatctgcccgcctcagcctcccaaagtgctgggattacaggcgtgagccaccacgcctggactcattgtggttttaatttgcatttcactaatgattaaagttgttagcagtttttcatgtgcttttttgtctgcataccttattagtggaaatgtctgttcagattttttattcattattattgaagtgttttttaaaagataattgtatgagttcttcattctggatacaagtccattatgtattttgcaaatattttttcctagtttttgtcttttcattttcttttcttttctttttttttttgttttttgtttttgtttttgagacagagtcttgctctgtcacccaggttggagtgtaatggtgtgatctcagctcactgcaacctgcgtttcctgggttcaagcgagtctcctgcctcagcctcccgagtagctgggattacaggcgcctgccaccatgcctggctaatttttgtattttttagtagagacagggtttcaccatgttggtcaggctggtctcgaacttctatctcaggtgatccacctgcctcggcctcccaaagtgctgggattacaggaatgagccaccgcgcctggcttcatttcttaacaggcttctttgaatagcaagtttttgaacacgtgtgcttcgtgttttaaaaatcaactacagggctgggcgcggtggctcatgcctgtaatcccagcactttgggaggccaaggccgatggatcacttgaggtcaggagtttgacaccagcttggtcaacatggtcaaactctgtctctactaaaatacaaaaattagctggacatggtgacgtgcctgtaatcccagctatttgggaggctgagacaggagaattgattttactatagtaaagtccatgttttgaaaataacataaaataatgatttgttggtgtataattaatgattcttggtttcatgaaaataattactgtaagcaatgtcattattgcatttgtttatagataagtatataaggtttctatatattgtaattaacagagaaaattagtttttttttttttttgcaaaatttgctcttagagcaaatattatgattcatagtagaatgagtttatttatttacttatttatttattttcattttttagtagagatggagtttcaccacgttggccaggttggtctcgaactcctggcctcaagtgatcttcctgcctcagcttcccaaagtgctgggattacaggcatgagctaccgccgccggcattagaatgagtttattaactgctgccattgtgctatagcaaagtgctgtagccaactcagctgccgttttttatgaagttgttgccattttttccctgtctacttctgtacgaatgtagttgtaattttattattgtatgcctttttggtctgtttgtagtcccattaaatcctcaagcacaattttaagatcattgacattttgtttttacaacctacagcagtaaggaaggatttttaaaaggaagctttgagctactgttatggttagcactgatacagtagctaatgatacagtaaaaaataataccactattgaaaagcagaaacacataagcatagcaatttagaagaacataagtctgcattcacttaacattcattatgcacctaccatttgtaatagtaggaaaggtgttctttttctgttgagaaagtaaggcttcattaggcattgtagtgttaacatatcaagatcatggacctatgaatatgtcccttgtagctctgtgactattgtcagtgtcctgagacagtaatatatatttcctagggttgtcatgaggatgaattgtgttaatgaaagtatctggcaaatgtagtaagctctaaataagtaagcatttgctattattgttagtcttaaacgatgtcgttctgttgataactcctttatcttcatgcatttcattttaaccagcttcttcccatatgtatttgaatatgctcaagtttttcctttcttgaaaaactctcaagagaagcaaaataatttagctgatacccgtatctgccctggttgagtatgcaaacgcaaaccaaacttgttgaatctgattcttctccgctcatttattttttagcttactgcattctcgatgtcttccccataattgaaagctttttgtgtcttccatttgttagagcaaattgatcttggttctatagcttaccagttgtataactaagcaattaacgtaatatcttcatgcttcaattttcttgttaaaatatagcaaataatacttaagctataatagagtatgaggatttagaggaataattaatataatatcagcctcagaactgtgcctgctactttcatctcaaaccttgttttctaaattgtctgaacttgtggttcctcaaaacttgtgctcttttctttttatctccaggtctttgcacattcaagtctttctcttactaccaggcagtaagaatgcaacatctatgtattccggcattggtagttattcatagtagtaggtctgtatcattaagaaaagaaccaaaattaatagctaagtcagttaaaacctcagatactggaaaatactgatgtacccagtaactcattgtttaggagttcaggattaccaaggcttggttttataactcgatgtttcttctaggtctttaccttaattttgtgcatggtgtaatttttatatgatccttttatggcctgagtgatgaatgtttcactttatgtgttcttcatttcccttttaaatttattatttctaaataggaaataaattacacaaaattcaaaactcaaaagggtatatggttatcttccagtgattgtccaaggaaaaaaaaggtatatggtaaaaatttttttttccccatttttccaccaacaatgaatgaattacctgccttggtagtggtcagtgttacttctttcttgtgtcttcctcctgagatagtttgtttatgtaagagaatactatgataccttactacatacaatgtttgttatgccccttcctctttttttttttttttttttgagacagagtctcactctgtcacccaggttggagtgcggtggcatgatcttggctcactacaacctctgcctcctaggttcaagcgattcttccgcctcagcctcctgagtagctgggattacaagcgcctgccaccacgcctggctaatttttgtattttagtagagacgggtttttgccatgttggccaggctggtctggaactcctgacctcaggtgatccgcccgtctcggcctcccaaagtgctgggattacaggtgtgagccaccatgcctggcctcctctttttttattttttataaaaaacatgtgttggaagaggctttagtagctgtacataaagaactttgagcttttcatcccacaagtttttctttaaatattttcttttaaattgaggcataatttatacattattattattttatttatttatttatttagagatggagtctcatgatctgcctgcctcagcctcccaaagtgctgggattacaggtgtgagccaccgtgcctggcctttatacattatatattgtaactcataagattagagatgattttttttcctatgtatacggtcaggtaactgccatccagattaagatacagaacattttcaagacccaggcaagctgctttctgtaccctcctagtcagtaccactgctttcccttttaagaggcctctctcctgtttttgaacttcacataaatggtgttatgacttttatatctgattttatttctgaagttatttctgtgagatttattcatattggtgtatagcagttgtttactttctgttttttggtagtttttccattgtatgaatataacagttaatcaatctttcttttcttgctttcttccttttttttgagaccgctctcactctatggcccaggctggagttgtactgacctgatctcagctcactgcaacttccacctcccagtttcaagcgattctcctgcctcagcctcccgagtagctgggattacaggcacccaccaccaagcctggctaagtttttgtatttttggtagagacagggtttcaccatgttggccaggctggtcttgaactcctgatctcaggtgatccactcacctcggcctcccaaagtgctgggattacaggcttgagccaccgtgcccggcaacagttaatttttctatgctcctattgatagacatatttgggttctttccactttgggtctttgatgctactgtgaacgttgtcatagatatttctgggtgaacataagcatttattttcctgggaaactggtgggtaacagggcataaatgtgtgattaccttttgtagatactgctaagcatttttttaaagtatcaaaccaatcaaaaccaccactattgggagtttgacttgcttcacattctaaccaacactactagcagtctttttccacaactttactttggaaaatttaaacatatgggaaagtttcaaggagttttttttttgttttttttttacattcagggatagataatacatggtaaaatacagcgatcttagatgttcactgtgagttttgaaaattaaacataagcattaccccaggcaagatgtagaatactttcattattctaaaaacttccttcatggctctttctagtcagtgtcacacagcctctccaacaacttttctgattttcatatcatagattagattagtctgttcttggcatttgtgtaaattgatttcttctgtctctgagttcttttcattggtagtttttgacattcatccatgttgttgcaatggtctggatgctgggcatactgtttgctactggggtgtcattgcttctaggtctttcagtggacaaaatgaggaaaatatatgttgggaaaaatacactgattttactcatctaaagctttcaccataggattctttcctatctttctccattttatatttcagactcccttctcaaaggagtttcatttaaaataagtcctaattgtaatttaaaggaatccccaattatggccaggcgtggtgtttcacacctgtaatcctgcattttgggaggccgaggcgggtggatcatgaggtcaggagttcaagaccagcctggccaacttggtgaaaccccgtctctactaaaagtacaaaaaaattagccgggtgtggtagtgggtgcctgtaatcccagctactccgaaggctgaggcagagaattgcttgaacttgggaggcggaggttgcagtgagccaagttgacaacactgcactgtagcctgggtgacagagtgagactccgtctcaaaaaataaaaataataataataaaaaaagaaatgcccagttatggaaaatataacttgagagttaagtaccatactaatattaagagcaagagtaggttcttttttcaaaatctgttcatttctgaatggataatgttcttttttttttttgagatggaatcttgctctgtctccaggctggagtccagtggcgccatctcggctcactgcaacctccagctccctggttcaagtgattctcctgcctctgcctcccaagtagctgggattacaggcacatgccaccatgcccagctaatttctgtatttttagtagagatgaggtttcaccatattggccaagatggtctcaatctcctgacctcgtgatccacccgccccggtctcccaaagtgttgggattacaggcatgagcacctggcccggttaatgttcttaattatatacagcatgttctccagctaaaatgtagtgggctttaatttttataagttaatgtacatataactttatattgtttttatattatacattttgtatttatcctaatttctaaaaggtgagtactcctgtatttcagtgagaagttaaaccaataaggatttagtttgtatcttgaagaaattttggcctagttttgttttatccttgtagtacatattggggaggcacctttgcctaatggctaagacttttagttgtagatagatagtggtttgagtcctggtgttgtctcatactagatctgtgatctttgattaagtttatttctttgagcctcagtttcctcatctatatgtaggggtgataccttctttatgaggtattgtgaggaatcatgagtacatgtagtacttattattcaataaattgtggtaattattacaataataaaatgcctacattttatttggtaatattttaatggaagacaaggaaatatgagagagaagaaaatagtaaaagtcaatttgcttctagctgattcagtattccttaaatgactgttctaattgtgaaaaatatatcatctgaagttaaataagtgggagatcaggatatttgttaccttacaggtgcaaatgattttaaaacttgtgttctatgtggttaacttatggattttttagaatcttaactgcaaattagtttgctaatttcaggttttcaaatttttaggttcttagaagtatagcacagacagtgaaatagctcataattttaatagctcaatttctgttaataggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacaggtaacatcttttcttctagagcaaacgatgtaacagtgggttatttggtccaatttacttacttatttatttattttcagtttatttagatttgataggaaaattaaagctaactgaaagacttttgagtcccattttgtattcatattgcctcactcacagagttacaaattaaataaggatttaagaattatgaggaaagctgtcttatgtttcttgttcttaaattatatgtgtactttgtcatgtatggagtttctatcttttatttttactaaataactatagatatgtatcgttttcccctgtaaaattggaatagtatgattggattattctaaaaaggtcttatactcaagagtggggtagtcttcctttaattttgttaccaatacgctttaatcttgtcttggaaagataaaatgacctgcattctaaattagaattggggttctgtttaatttggttgtgtttagaatttccaaaagatttaatgttaataattttttcctggatcatttttaagacattccctcttgggaaaaaatgtgtgcttaaacttttttcagtcagggtgatgatcttctgaagctcttggatgtcatttgatcggaatatgcagtggaataggtgactcactgaaatgcctttataaatactggaacaaatcctgctgcaaaaatgaaagcgatcagactgtcttctgttcaagaatgtctattcccacctcttggtggaggaagttgggccaacactgcagtggagataaccacctttgcgataatgagagacagaccagaggactgctactctttttataggagctgcctatttctgtgtaattggcctgggctgcatgggctgcttttattcatggtgggaaagttaattattattattctggaaataccgcaagattatgttttctgtttccagggttatgtacttgtgtccagatgaataaagcagaaaaagaggggattgagtagcatttcccagattcttaagtactttgctattcgatttgcctttcagtgtagtgtacattgtaaaactcagatattgtcatgatgtttcacttggacataagacttattaatgtggtcacttaaggggtaaggaatttaagaactggatgaggttatttcttcctttactcttcaaaatgtatttttgatacatcagtatgagaggacgtcccatcaacaaagcatcgatgatggacagtctcacactatttttatcatatgtttctttgtcagccttctgcttctaatcccagtaagcaacttggacaggcattttaaaagctgaagaaaagtgacattattttagctagtggtttttaatttattttttgttaagatataatgggtgattatataagttagatttatttatgatatcaacttgggtccaagatgatagttttagctagcttatgaacattgggttcacaaggcattgggtaagttagataaaatagcatatactttctctgcagggtaggtaagataggtcagtcaagttggtaatgcctgtccattaaccatttatgcatactaataaaattataagaataaaatcataatgttgtacatttttgtgttttttaatatacactcagatgcatgcacatacatattgtctgaaacaagccagtatatattaaaatgtcataaattttaggttatttagattacatatcagaaactagatggttaatgaagaaatataggaagatggagggttcttagaattatgctgattcacattaggtcataggaataaatatgtaaatcacctctttccatgaattcccaaatttctgaccttaataatttcctagtgataagaaagcctagtttctttaagtcaatggagagtagtatgtcaccaaaaatttgaagtggaaatagagataagaagcatagactgtgcttatatgtatctatgagtagagaaaagtagtgaaactgtatatcattttaatctcaaatttgaagaccttaaaattttaacaacataactctttatgatttctgagggatttgtatggtaaaatattctaacataattggtcttcttcatcaaagagattaaaatttctattttttttcctatctggaggttgaattttctaataggggttgaactgagcagaagtctacctttatgcaccagaaaacattgattatgggaatggtaagattacttctgaaacataggttttgcagttttatggatattgttagtattttactattaactcttaaatgaaaggatttcattcatcagaattgaaaggtcaggtacctgacaatgttgggtttttttctttttttaaattttaataatcttcacaagggcactgtaatgtagtgtttttctttcttttcttttttttttccccttgactcttagcaccactcaatgaaaattttaaaaagtgccacacataaaatatataatccttttttcaggaaacctttttaattacccagaactgtgatcctcccaaggtacaaaaaaaaaatcataccagagatgaaatgtatatggtgatttatctttggagagttcagttgatattttttttgttgttgttgagacggagcctcactctgtcgctcaggctggagtacagtggcgcagtctcggctcactgcaacttccgcctcctggattcaagcaattctcttgcctcagcctcccgagtagctgagattacaggtgtgtgccaccacgcttggcttatttttgtatttttagtagagatggagtttcaccatgttggtcaggcttgtctcgaactcctgaccttgtgatcagcccacctcggcctcctaaaatgggattacaggcgtgagccactgtgcccggccactgataattttcagttaataaaagcagcaaagataaattttctgtgttcttacaaattaaaacaagtattaaatatatgtatctaaattttttttgtttctaagtagtttaatatcaggtaatctaagtcatttaaactcattttgtcttggaagattagggtttactattacccttaatccgttcagatgtatagtttgaagtcttttcattattaaaaaaaaaaagatttgggaggccgaggcgggcggatcacgaggtcaggagatcgagaccatcccggctaaaaaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaagatgcagcagaccacacagagcatatatgtaaattaattatgaggttaacacctttacgagtcttattctaagaattgtacgttttcttgtcttacccaaattctttagtgttttaatgtcatttcatttctaagcatatgtgttggcgaatatattgaaatactttacttcccagtagaagtatttaagcataattcaagcttaaataacatttagagataattttataagaagcatctgagtgtgggggtgtacacctgtagcccagctacttgggaggttaagtttggaggatacttgagcccaggagttccaaggccagactgggtgacataccaaaaactcataatttttttttttttttttttaagagatggtgtcttgctccgttgcccaggctggagtgcaatggcacgatctctgctcactgcagactccgcctcccaggttcaagcaattctcctgcctcagcctcccgggtagctgggactacaggtgtgtgctgccacgcccggctatttttttgtatttttagtagagacggggtttcaccatgttggtcaggctggtctcgaactcctgacttcaggtgatcacctgtctcggccccccaaagtgctgggattataggcatgagccaccaagcccagctcttcatctacttttaaggctttatttaatatgaacattgataattcatagtattagaaatagagttctctgggccaggtgcagtagctcatgcctataatcgcagcgctttagagattgaggtgagaggattgcttgaggccaggagttcaaggccagcctgggtaacaaagtgagacccagtctacaaaatacatgtatttttatgttgactgggtgtggtggtgtgcatgtgtagtactagttattcagcaggctgagttgagaggattacttgagcgcaggagtttgaggctgtagtgagctatgatcatggcactgtacagctgtaaggggccctgtctcttttttttgttttgtttttgagacaaagtcttgttcttgtcccccaggctggagtgcagtggctcactgcaacctccgcctcctgggttcaagtgattttcctgcctcatcctcccaagtagctgggattacaggtgcctaccaccacgcctggctaatttttgtattttttttttttttagtagagacggggtttcaccagttggccaggctggtcttgaactcctgacctcagatgatctgcctgcctcggcctcccaaagtgctgggattataggcatgagccactgtgcccatcctctgtctcttaaaaaaagtttcatgtatggttcattaaaaagaaaaaaaaaagtgttctctggagttaatatttttcccattcctataactagacaattaatgttcatccaaagcttgtatttcacttgtactttttttgtgaatgaattggtgatatatgtagtgttaataaagttacagagcaccactgtccaataaaaatgtgagccatgtatataactctaaaaattttagtattcttaaaattataaaacatgaaattaattttaatattttaaatagatattttaatttaacttaatagatccaaatgttatatgctcagtgtaaaaattaatggcactatttttttttagcggggttgggagtacctggtctttaatacctggtgtgtattttactcttgtcctgagcatgtttcaggactagccacatttgaagtgatagataactgcatatagctaatgcttactctatttttttttttttttttttttttttgagatggagtcttgctgtgtctcccaggctggagtgcaatggcgtgatctcagctcactgcaacctctgcctccttggttcaagggattcttctgtctcagcctcccaagtagttgggattacaggcacccaccaccacgcccggctagtttttgtattttcagtagggatggggttttgccatgttggtcaggctggtctccaactcctgaccttaggtgatccgcccacctcggccccccaaagtgctgggattacaggcatgagccaccacgcccagctgtgcctactgtattgaacagcacagttctagagcttttcctgttatgaaacaatatatagtcttttataaataatacagtaatctagtagttgagtcctggttgagtccatgtgtccaaggggaagatattaaagctatctgattttactctcatctatgtctagcatgtagatgaatgtaaaatcttgaaatactcttcttaaacccattcttgaaatgtgcctttcatttagtaaatattaaacaaaagattgctggtgttaatttatttcagctttctgcatttaacatttaacttctcaatattttcagtgaattgacttagaggagttaatgatgttaagaattttatggtatacatttttgaaaaataaattttattgtgtatatttgaggcttacaacataatgttacagagtacattttttgaagacaccttgtgttcaaagcaagttcatattgcatcttcagatctaaacatgaatataacttaaaatatttaaatattctttgacttttgaaaaaatatttataaaagaagccatttgattttttttctttttcttttctttttttctttttttttttttttgagacagagagttgctctgtcgcccaggctggagcgcagatcttagctcactgcaacctctgccttgcggattcaagcaattctctgcctcatcctcctgagtagtgggaattacaggtgctcaccaccaggcctggctaatttttttgtatttttagtagacacggagtttcaccatcttggccaggctggtcttgaactcctgaccttgtgatccacccgcctcagcctcccaaactgctgggattgtaggtgtgagccactgcgcctggctgcaatttgaattttatcattttgattaaaaataaacctacagaagtgtactgtatagaaagaccttttaagttccaacaatttttaaatgcttttaatgttattgccagggctgtgtgcgttagtgatgtgacatttactcttttttttttttttttttttttgagatggagtttcgcttttgttgcccaggctggagtgcaatagcgccatctcggctcactgcaacctccacctcccaggttcaagcgattctcctgcgtcagcctcctgagtagctgggattacaggcatgtgccaccacgcccggctaattttgtatttttagtagagatagggtttctccgtgttggtcaggccagtcgacacttcactctttaaagtatttcagtatgagccaaagtagtaaatgactacactgcatttattgcagtagacaaaccttgctgagccaaggaaatgtgaaaagtaggagtaataatggctttagtatagaccctagtagaacaagagactaattttaccttgaataagatgtgcatttagcttaactatggcttaatagcaactgagatgccataatttccttataatttatagattttaatctaagatttttcagagaacttgacttcctaatagttgtactgtcataattaggaagtgactcacattgatatttttgagaagtttacatgaatgtagtggtctgtgtaagacttggtgacatgctttaattattcagtggcttcacttttgagtaaatcttatgagcccttcaggtttgaaaatcactggaaagcttacagttgagactgatcatgtttttgtgaaaaaatatcaagccccagttaaggaaaaaatgaagtgtattttgtaagtaagaaaagccattatcattttaactatagaactaacttaaaattttagagtctgccccaaattctccaagaattggaagcccattgagcccaaagaaaaacagtgaaacaagtattcttcaagcaatgtctagaggtttgtctaccagtttgcctgacttggactcagaaccttggatagaagttaaaaaaagacatcagccagccccagtgaaattgagggtaagttgttacagactgagtgaagtgtgacataccctgggtggagtataaggtcagtgcactttatgtttgttaggtacatatgtaaaatttggaaaagtttagcacaattttaactttgtaattgttggccttcagtagacacttatgggttattctatgaggaaaataagttgtatcaatttttaaaatgttatttatttttttttttttgagatggagtcttgccctattgcccaggctggagtgcagtggcgcgatcttggctcactgccacctctgcctcccaggttcaagcgattctcctgccctggcctcctgagtagctgggattataggcgcgagccaccatgcccagctaatttttgtatttgtagtagagacggggtttcaccatgttggtcaggctggtcttgaactcctgacctcatgatccgcccgcctcgtcctcccaaagtgctgggattagaggcatgagccactgcacccggccttaaagtatattttttatttctgaacatgatttaagaattttggaggctgggcacagtggctcattcctgtaatcacaacacttcgggaggccaaggcaggaagattgcttgagcgcaggagttcggggccccctgggcaacatagggtgaccctgtctctacaaataattcataaagttagctaatgctaattttttggtggaatgtgcctgtggtctcagctactcaggaggctgagacaggaggaacacttgagctcaggaggtcaagactgcagtgagccatgatcacaccactgcactccagggagggtgacaaagtgagaccctgtctcaaaaaaaagaattttgtcttggtttttctacttgtgactaattttaacttgaataatatttcagttttttatgaagttgaaaaaatatgacttttattttttgagacagagtctcgctctgtcgcccaggctggggtgctgttgctgccatgttggctcactgcagcctttgcctgctgggttcgagagagtcttgtgcctcagccacctgacttactgggattacagggtcactccaccatgcccaactatttttttgtgtgtttctggtagagacgggattacaccatattgtccaggctggtctcaaactcctgtcctcaaataatttggctgccttggcctcccagagtgctaggattacaggcgtgagcctctgcggcctggccagaaaatgtataaattttgaagttacactcatgttaattatttataaggtttatataagtgttggtgatttatatatctggtttatatatgttttggtgatttaatgtgcaaaaggaaaagaaaattgaatttttggtggagggtacataagagagtgagatggttatatttataaaaagagaaataggagatccttgtggtggtactgctctgcatttttcactggtggtagatacacgaacttacatatgtgataggattgctttgatctaaatcacaaatgagtgcaagtaaaactggggaagtataagctaagattgatttatatcaaagtcaataccttgtttgggatgttgtagtatatttttgtgagatgttaacattgggggaaaccaggatatatgagatctctattatttcttacaactgtatctgaatgtataattatttcaaagtaaaagttcactaaaaataaacttggggagaatgccactcaaaagattcaaatattgaaagtaagctctctaaaggggatggaaggtattgagaggattgtgatgtggaggaccagcaaattggttctggtagctggttttaaaagtataaggagaactgtgtagttttatggccaaacaatgccagtatatctgaaatgtatggtattctgatgctacagactgaggatctggcctggaggaaacatggctttaggttctgggggcctagatatttcagagataactgttgaggtagctcagttattgacattatttttaatatacttttaaaaaagtgatcttttaaaaacattctagagtgggtatacagatctttgttgggcatcatttttctttggaattctaaaagcatttttcttttgtcatcttggtttcttttgtcatcttatgaaagtcagtccattcacattctttttatcaagtgatttttttttcctcttgagttttttttttttttgagtcttgctgtgtcgcccaggctagagtgcagtggcgcagtcttggctcactgcaacctctgccttctgggttcaagcaattctcctgtctcagcctaccgagcagctgggactataggtgtgtgctatcatgcccagctaattttttgtatttttaatggagatggagttttaccatgttagccaggatctcctgacctcctgatccgcctgccttagcctcccaaagtgctgggattatagggatgagctgccatgcccggcctgagatttttttttttttttgagacagagtcttgctcttgttgcccaggctgcagtggagtgcaatggtgtgatcttagctcactgcaaccttcacctcctgggttcaagagattctcctgcctcagattcgtgagtagctgggattacaggcacctgctactacacccggctaatttttgcatttatctatttatttttttcagacagaatctcactcttttgcccaagctggagtacagtggcgtgatctcggctctgtacaactttcccctcccgggttcaagcgattctcctgcctcagcctccagagtagatgggattaaaggcacaggccaccacacccagctaatttttatgtttttagtagacggggtttcaccatgttggccaggctgttctcgaactcctgacctcaggtgatccacccgcctcggcctcccaaagtgctgggattacaggtgtggcccactgcacctggcctaatttttgtatatttagtagagacgtggtttcactatgttggccaggctgttctcgaactcctgacctcaggtgaaccgctggcctcggcctcccaaagtgttgggattacaggtgtgaaccaccacacctggccttgcttgagatttttaagatcatttcttcatccccagctcttgaaatttcaagatgatgtgctttggtgtaggtctaattttaaacagaaaatctttttttttttttttttttggcagagggtttcactccctttgcctagactggtgtgcagtggcgcgatctctgctcactgcagcctctgcctcctgggctcaagcgattcccctgcttcagcctcccaagtagctgggactacaggcacaaaccaacaggcccggctaattttttttttttttttttttttttgtagagacagggtttctccttgctgcccaggctagtcttgaactcctgggctctagtgatccacccacctcgatctttcaaagtgttgggattacaggcatgagccaccttgcccagtcaggtctattttttttttttttttttgagatggagtcttgccctgtcactaggctggagtgcagtggcgcgatctcggctccctgcaaccttcacctcccgggttcatgccattctcctgcctcagcctcccaagtagctgggactacaggcgcttgccaccacgcccagctaatttttttttttgtatttttagtagagacggggtttcatcgtgttagccaggatggtcttgatctccttacctcgtgatccgcccgcctcagcctcccaaagtgctgggattacaggcgtgagtcaccgcgccctgctctgtctggtctatttttatgcattgtgctgagtattcatgtccttcatttgggagaaactaatgtttctcttatttccactttctggtatctgttttcatctgatgttggacctccttgatagatcatctaaatactgggccttgggtgtttaaaaaaagttctcttctgatattttcattatttccatcattgttttggttgctttttgaatgctttcttaatatctggcgatttttggttgatagttcatattaatattagtaaatatgcatggttttcttgtttgatctaatctgctcatctagtgggctgttttgtttaatgtgaggtatgattccacagtctttttttttttttgagacagagtttcgctcttgttgcccaggctggagtgcaatggcagtgtgatctcggctcactgtaacctccgcctcccaggttcaagcaattcttctgcctcagcctcccgagtagctgggattacaggcacccgccgccatgcccagctaatttttttgtgtatttttaatagagatggggtttcaccatgttggccaggctggtctcgaactcctgacctcaggtgatccacctgcctcggcctcccaaagtgctgggattacaggcgtgagccactgtgcccagctgattgcacgttcttggtaagtgaaaacgtcctatggacttggacacctaggcagagaatagggatgctggctctttttctccaaaattgctaaaacaaaaaaagcagtacttttctctgggatgtagaatttcttagtgtatctcattcattggtgaaattaccttttcttttcctccccccagctctattttagaggttcagaataatgctaggatgtgttcaacttctgttcagccccagtacacaaaacatgagccctctcttgtcaaatcttattttgtttagaaagtaattcttgggcttttagttgggagcgatctttatatagttttatattctgagataaagggattggattgactgttccagctgtgttctatagttggttttccaaatacctattttgattgccatccaatagtccattcctactccttgtaactgccatctcaaaactttctagaaccctggcgggatcaatggcttttgcttcccctttaacctttgtatcagttctaggttgctgttttctctgcttttgtttattatcaatacaatcccatttattttctgctttcccgaaagtcataaaagtctttgatcttctgatagtaatacttgttttcagtattgatgtggatttattgtttttattctttgcactgtgtattattactgcaaataagcatgcaaacttaagtcatcttcaacccctaatctcttaataatggtcttttcctcagaaattacaaaaacaaatttaacagtttgtttattctcttagacttttatcatgtacctgcaaatgtgaaaagcaatgtatattgtttaaaatatatcatcagtattttaaaaaatatatattcacagtgttttacaacttgtctttttttagtaaaaacatcttgggtagtcttctgtttactagaatgtgagctccatcagggcatagttgttgttaaatttattgctgtctgtccctgcctagaacagtgcctggctcagaggaagcactcagatagttatcgactaaatgaatatggatctacattattgggaattttgaaagggaggaattgtttttttcctagacataggaagttagcatgaactgaagggtaaaataggccagaggacgaaaaatgaatgtaacaccaagtagaaactacttccttctgttgggagttttaaactagtttacatgttataagatctaggatctaaaagcttagacttttaatgtaaaccaacaactgttttaagttcttttttttttttttgagatggggtctcgctctgtcacccaggctggagtacagtggcacaatctcagctcactgcagcctccgcctccagggttcaagcctccgcctccagggttcaagcgattctcctgtctcagcctcccgagtagctaggactacaggtgtgtgccactatacctgggtaatttttgcatttttagtagagatggggtctcaccatgttggccaggcaggtcttgaactcctggcctcaggtgatctgcccatcttggcctcccaaagtgttgggattacagatgtgagccactgcacctggcctagctgttttaagttctatagaaggggtagacaattttttttttttttttttttttcttcagacagagtctcgctctgtctcccaggctggagtccagtggcgtgatctcggctcactgcaacctctggctcccaggttcaagcaattctcctgcctcagcctcccgagtagctgggactacaggtgcgtgccaccacgcctggctaatttttgtatttttagtagagacggggtttcaccatgttggccaggctggtcttgaactcctgaccttgtgatccacccgcctcagcgtcccaaagtgctgggattataggtgtgagccactgcacctggcctgaggggtagacattttaacatttgctgaatattagcatgaatttgacatgaaaactgggccatgtagaatggggatgaggatagagtagagggattagctcagaaactatgttattatcattgtgaggtaaaaaggttcggaatagggaagaccattgactctgaaaatcagaagaccttgattctatctatctgtctatctatctatctatctatttattttttgagacagagtttcgctcttgtcgcccaggctctagcgcaatggcgcgatcttggctcactgcaacctccctgcctcccaggttcaaacgattctcctgcctcagcctcccgagtagctgggaatacagcaatccacaaccagataattggttctgtttataattatgaaatcataggcaaatactttcatatctctaggcctttgttttaatcagtaaaatgaatcagtgcaatgtaatggatgattaagactattccaactctaaaagagtctttaatgtaatcctttctttattcaactttgtgtttttctttagtcttaaatttactgggccaaaataatactcacttgattttcttttacagtttggctgttaaactagcaattgagcataaaagcttgatattacttacttgtaacactgttttatgacatttaatttaaaaatgatagaaagttttttatataaattaccaatttcttccttcaggaatcagtgtctgtccctgaagggtcattaaatcagctatgttcttcagaagaaccagaacaagaagaacttgattttttgtttgatgaagagattgaacaaataggacgaaaaaacacatttactgattggtctgataatgattcagattatgaaattgatgaccaagacttaaacaagattttgattgtaactcagacaccaccttatgtgaaaaaacatcctggaggagatcgaacaggcacccacatgtctcgggcaaaaatcacatctgaacttgctaaagttatcaatgatggcttatactattatgaacaggatctatggatggaagaagatgaaaacaaacacacagccataaaggtaattgtttctggccaacatctttctactgatgctttgttttgattgtatgttgctgtttatattttctcaaacttgaggctctattttatgaaatgttgaatataaatacattgtatttaacttgaaaaattcctggaaatatacctgataattaccacctg

SEQ ID NO: 82 - DNA, 149787 bp, Homo sapiens
gggtaaagctcctcggcctcggcgtgctgcgcctccgcggctgccctgcgccaggtgagggctcgcggctcccggctgcggctcccggcgcgtggtggcgggctcggggcgtgcgtcgcggagaggacggggccggcgggcggttggcgctccgttcggtgcggggaggggcgtcacgccgggcgctgcgcggcctcggcgggcggcggcagcggcggccacggccgccgggctctcgggttgtctgtccccagttggagccggccggtgtcccggcggagagacgggcagtcgggttccctggcctcggggccaccccggctggggcggctggggcagagggacgatgtctactcgcgccccgatgcccgccgcccattctcgggaggatccgcccgcggtgactgctgagagggagtcgctgttggccgcggcgaaccggccggccgagcagccgcccccgcccgaatgtgagggcaaagaggcggcgagggaggagagggccgcggccgccactagcgctggggcgcggggagagccgtcgccggcgctggtgctgggacgcagcgtgccccaggcggctgtccccgtgaggcccctggcgctgcacctggcgcacaaggcgcgtgggcccgggggccctttcggcggggagccgccaccgccaccgccgccgccgtcgccgttgccgccgttgctgcgggatccgccggccgaggacgcccgggaagaggtggcagctggccctgcggaaaagcggcagccgccgctgctgccgcctaagggaaatccctggaccaaaaagcctccccagcacctgtccccagacacgacaggtccgccaccgcccccgctggaaaccctggaggcaggtctgtggttgctctgcgttgggcactggcagggtgcgggcaggggcgacttgcgggacttgccggcgcgtggcggcggtagcgggcaccaggcccgggtaacggcaggcctcccctccctgtcagtcggaggtaatttgttccaaggtgtcattcactctgcctatttacagacatgggcatctgggaagggagcggcaggaagaggtgggacctcaggttctccttgcctgatgggggcacggaggtggtagcttggcggcgcatccctgctggcgcggttgcgattgtgttttgtccccagtgttagtgacttgggaaagtagctaactttagatactgcagtgcttcgtatgggaaagttttggtagacttttttttttttttttttacataaaaggattgaagcaagtcagagcaaggggatttattcgtaagtggaagcgcgattgtagtcttttgtgaaataagatgaaaaaaggttttcaaaacactgctgagcagtcatattaaaaatgagactttaaatgtggtttttaaagtgctttatggggggaggggggagggatagcattaggagatatacctaatgttaaatgacgagttgatgggtgcagcacaccaacatggctgcacatgtatacatgtgtaacctgcacgttgtgcacatgtaccctaaaactttaagtataattaaaaaaaataaagtgctttaagttataagtgtgctggaaaataattgaaataggatagttgacatgcgagcgtggattgcacgttaggtaaatggttttctaacattgtcagctctccttccctttagaggagataagattatgccactatatttgaatgctgaccaatgctgtatggccgtcggtgctttattttgattgtagtaactgcaacttaagaaagtaaaaatgggccggcgcggtggctcacgcctgtaatcccagcactttgggaggccgaggcgggcggatcacctgaggtgaggagttcgagaccaggctggccaatatggcgaaaccccgtctctactagaaatacgatcattagccaggcgtggtggcgggcgcctgtaatctcacctacttgagaggctgaggcagggagaatcgcttgaacccgggaggtggaggttgcagtgagccgagatcgcgccactgcactccagcctggtcggcagagtgagacccactctcaaaaaaaaaaaaaaaaaaaaaaaaaaaaaagttaaaatggaaataaaaaccatgacaaaaagcagtatctggccgggcgcggtggctcacgcctgtaatcccagcactttgggaggccgaggcaggtggatcacctgaggtcaggagttcaagaccatcctgactaacatggagaaaccttgtctgtactataaatacaaaattaacctggcgtggtggcgcatgcctgtaatcccggctactggggaggctgaggcaggagaatcgcttgaacccgggaggcagaggttgcagtgagccgagatcgcgccactgcactccagcctgggcaacaggagcgaaactccgtctcaaaaaaaaacacaaaaaaacaaaaccgtatctttctaaattaagttgtaaatgacttgaactttttatatgcaaatgacagctgtttacttgcaagtcttcatttttatttaaaattaaaggttagcagcagaacaagaaatatttgagcgtgtttactggcttgtgaggatcaaatgcgatgaagaggtggtataaatgtaaggcgattggctgtgcgcggtggcacacgcctgtaatcccagcactttgggaggccgaggcgggtggatcacctgaggtcaggagttcgagatcagcctggccaacatggcgaaaccccgtctctactaaaaatacaaaaattagccggatatggtggtgcgtgcctgtaataccagctactcaggaggttgaggcaggagaatcgcttgaacccgggagacggaggttgcagtgagccaagactgagccactgtattccagcctgggtgacagagcaagactcagtctcaaaaaaaaaaaaaaaaaaagtacggtgattgttacaagcacccattatgttatgttaacatttcttcagaggaactctccaaagagggagatatgtgttgagttaattcattcatttgcctttgcacagaaatactcctcattaattgttgataaattttgacacttgcagaaaaaaagtttgctctggatttaatattggcataattccttcctcgctataaagagctgtttgtttactcctattactaactaaagagaacatggttaagtgaagacctcataaagtttttcttttttttcttttttaaagcccagtggcaagcactctaaaatttagcaaagaaagaaaaccctagtgaatcatcttatttgctgtttcacctctctacttctagacttacagacaattaagtgaattaccaagtaggaactctttgttgatcataaaaccagtatcatagattttaaaacttcgaagccatacatggtagtgtgtgcctgtagttttagctccctgggaggctgaggcaggaaaaatcagttttgcccaggagtttgaggctgtagtgtcctgtcatagtgcctgtgaatagccactgcattctagcctgggcaatatagcaagaccacgtttaaaataataatattaataataataataatgataatagaactttaaaaactgtcaaggtaagccttgggaactttaattgcaaatgacctgtgaaaaatatttaacagttaagctattggtgccttcattctccagtcttcactggagattaagaacactgtgatactagttgtatggtatggttcatggaaatttcagttttgctgttgtcttgtgtaggcaactctttctgtctttggatggaatccattctgcactggcaggaagaccatctttcagacctggcatagtgtagtaaccatggtctcttcccaacactgactctgcactgttctcccacaattaatttctttctttctttctttctttctttctttctttctttctttctttctttctttctttctttctctctctctctctctttcctttcttttcttttcttttcttttcttttcttttcttttcttttctttcttttttcaagagatggagtctctctgtgtttcccaggctggtcttgaactgctggcctcaggcgatcctcctgcttcccaaagtgcagggattacagacataatcaggctttctattttcttaagcaaatttacaacttcaggagtaaagaaacaggaccacagtctatttgcagttaaataacttaggtaacttagataaaagagattgtggtgtagaaacatactgttttgagagacttgggttctagtgcaggtattgttactaactggctagttgacttctggcaagatttctgggcattataaatgaataacatggatagactcatttcctctggttcataataccagagtgccacttataacctggctgccttggcttccatttatatatttatttaatattatttaattcatttaaataaatacattttacattagtttatttaaataggtagatagattgtcagtcttgctctattgcagtggtgagatcatagctcactgcagccttgacctcctggactcaagcaattcccctgccttggcatcccaagtagttgggatgacaggcacgcatgtcattccatggaattagccatgcccggctagttatttttaatttttttttgtagagacaggggccccctttgttgtccaggctggtcttgagctcttggggtcaagctatcctgcctcagcccccacaaagtgctgggactacaggtgtaagccaccctgcctggcggctttctattgtctattttctttctttcttctttttttttttttttttttttgttatattgagacagagtctcgctctgtcgcccaggctggagtgcagtggtgcaatctctgctcactgcaagctccgcctcccgggttcacactgttctcctgcctcaacctcctgagtagctgggactacaggcgcctgccaccatgcccggctgattttttgtattattttagtagagacgggatttcaccatcttagccaggatggtctcgatctgctgacctcgtgatccgccggcctcggcctcccaaagtgctaggattacaagcgtgagccactgcgcccggcctttttttttttttttttgagatggagtttcattcttgttgcccaggccggagtgcaatggtgtgatctctgctcaccgcaacctccacctcctgggttcccccgattctcctgcctcagccagccaagtagctgggataacaggcaagcggcaccatgcctggctaatttttatatttttagtacaggcagggtttctctatgttggtcaggctggtctcgacttcctgacctcaggtgatcctcccacctccacctcccaaagtgctgggatacaggtgtgaaccaccgtgcctggccgggctttctattttcttgccatttttttttttttttttgagacagagtcttgctctgtcacccaggcaggagtgcaatggcgcgatcttggctcactgcaaccccccacctcccaggttcgagcaattctcctgcctcagtctcctgagtagctgggactacaggcgcgcgcaaccatggttgcccggctaattatttttttttaatttttactagagatggggttttaccacgttggccaggctggtctcgagctcctgacctcagttgatgcgcccgcttcggcctcccaaagtgctgggattacaggggtgagccaccatggttgacctcaggctattttcttaagcaaatttgcaacttaagaagtaaagaaataggaccagaagttgtttaaagttcacagtgggtacctctaaatctattagttatctattagtgattgtataatttatactatataaattgtataattctacaaaacaggatgctctttgagagagagaattgtattgaaataacagacttaaatcaggtctatcctgctcaaacttggatttactgttactctgttaatgaggtaaaggaattccatccacagaattttgccaggaagtttattactacagttagaaacataggaaacacaggggagaatatttcaggacagaaattatgaattttctctacattacaacctgcacatctaagtgaaccagattcttgatgcctcggcccttgtgagaaattttcttccacttttaggatgattttgatcatgtgttgctgtttctagaaatccagatgaggcactcttcagccaaagttgctgcccacccaagaggccttttatcttgaaatttagtcatgagaccagaaggaacttctcccatctgtgtcctgacttggtattagttttattttggatacctcctttttttttttttctttttttgagatggcgccttgctctcgtcgctcaagctggagtgcaatggagcaatctcattgcaacctccatctcccgtgttcaagcgattcttctgcttcagccttccgagtagctaggattacaggcgctcgccaccatgcctgcataatttttgtttttgtttttgttttgagatggagtctcgctttgccacccaggctggactgcagtggcacaatctcggctcactgcaagctccgcctcccgggttcacgccattctcctgcctcagcctcccgagtagctgggactacaggcgcccgccaccttgcccggctaattttttgcatttttagtagagacggggtttcaccacgttagccaggatggtctcgatctcctgacctcgtgatccacccgcctcggcctcccaaagtgctgggattataggcgtgagccactgcgcccggccaataatttttgtatatttagtagagatggggtgtcaccatgttggccaggctgatcttgaattctggacctcagatgattgacccaccttggcctcccaaagtgatgggattgcagacatgagccaccacacccggcttttttttttttttaagagaccgagtctcactttgtcacccaggctagcgtaggagtacagtgacacaatcatagctcactgcagcctagaactcctgggcccaagggatcctcctgcctcagcttctcaagtagctaggactacaggcatgtgccaccatgcctggcaaattattttatttttgttttttaaatttaaaaatagagacagtatcttgccatgttgcctaggctggtctcagaactcttgaactcaagctatttttattttttttttgagacagggtctcactatattgcccaggcccagtcttgaattcttggcggcctcaaaggattccctgcctcagcctcccaaagtgctgctattacaggtgtgagcctggcctggcagattcctttttttccctcttttaaataatttattttaaacctattatatcacacagtatgttttatacactgacatataaccccctaacaagataaagcaaagacaaaaaagtttatcttattagaaggaagatacaccatcacttattctcttcaagcattattgcactttaacttttcttaacttgacaaagcattcatgaagcagtctgcagactagttttaacagataaataatacctgtaagcagacatgattgtcctaaattgtttattaggtatgaattttacaaactttacttatattggctgtaacggtggagctggagagtattgcgccttctccaagctccctggtgagaaccaccaatagtgtggtggcacttaaggccctttccaaggctatggctctttcggcctgcagatggcagcccatgcatcttcctatgcttgtggactggtttggtgatccattgggtgtcaggatttcttctgatagctttatggaatggatcaatgaggataacctcaaaaaacttgtatgtggaatcttcaccaacccagtgagaattcaggacttttagagccccacagtggcatccagcttgccgctttgcaatggactgaagactttgagcaaactttagctggttaacaccatgatggacaggcttgccataagttgcacccttaggaactgggtgctttcggccaccatggcgaacacgaatcctatatataacataaacttggttggccttgtagcccagctggtgcgctttatcaagccagatggggtggggagccctgtggagagcagagagctggtggtactgccagcaaccaactctcagaagaaagtgcattttctccatagctcctggatttacttgtatgcccccatcttggcttacctgatggctgctgctagacagaaggggcacggattcttttattaaaatcacaatatgggtttattaatcccttacttgtatttatggttgttttttgcctattaaacatcagcattctagtataatttccattcttttactcataacaatatgatgtttaaaaaatactgatttttttctgtcttttttattcttatttttctcgaaccctatgttcatcatcaacctcttttctcctactatttggttcatcaaccttattttctcctgtttggttcctagaaacctcaagtaagcttactgttgttaccctaatgaaataccattttaagtaagttatatagaaaaaatgcataaatatattctccttacaaaaatgaaaaactttgatgtcatcttaagataatttactgaggccgagcgcagtggctcacacccgtaatcccagcactttgggaggctgaggtgggcggatcatgaggtcgggaaatcgagaccatcctgtctaacacggtgaaaccctgtctctactaaaaatacaaaaaaaattagctgggcgtggtggcaggcacctgtagtcccagctacttgggaggctgaggcagcagaatggggtgaagccgggaggcggagcttgcagtgagcagagattgcaccactgcactccagcctgggtgacagagtgagactccgtctcaaaaaaaaaaagaagataatttactaaatctaaactccttttaaaaattgctgaggactgcccgggcacggtggctcatgcctgcaatccgagcactttgggaggctgaagtaggcagatcacctgaggtcaggagttcgagaccagcctggccaacatggtgaaaccctctctctactaaaaatacaaaaatcagctgagtgtggtggctggcacctgtaatcccagctacttgggaggctgaggtgggagaattgcttgaacccgggaggcggaggttgcactgagccaagatggtgccattgcatttcagcctgggcaacgagtgaaattccgtctcaaaaagaaaaaaggcttaggatgaccggctgtagtggctcatacctgtaatcctaacactctgggagaccaaggtgaccggggtttgaggacaggaatttgagatcagcctgggcaacatagtgaaaccctatctcaattaaaaaaaaaaatagctaaggagtggtcctaaatatggctgacatagttgatttagagatttacctgttgattatcttgatttttttcatttttgtatctagaagaaactgaacatttttatacatatgtcttatatccatgtgtgcctttctctagggtagatgctgagaagtagaattgttaggttatagggcattttttaagtttatgagtcactttttatttatttattttttaatgtttttatttttattttttattttttgagacagagtctcgctctgtcgcccaggctggagtgcagtggcgtgatcttggctcactgcaagctccacctcctgggttcatgccattctcctgccttagcctcctgagtagctgggactacaggcgcccgccaccacacccagctaattttttgtatttttaatggagacggagtttcactgtgttagccaggatggtctcgatctcctgacctcgtgatccgccacctcggcctcccaaagtgctgggattacaggcgtgagccaccgcactggcctttacaagttgctttttaaagtaactgtataaactgatactcccactattagagtttgagaattgtcttctttcacaattttttttttttttttttttgagacagtctcactctgtcgccaaggctggagggcagtggcactgtgtcggctcactgcaacctccgtctcctgggttcaagcaattcttctgcctcagcctcccgagtagctgggattacaggcgtctaccaccacgcccagttagtttttatatttttagtagagatggggtttcaccatgttggccaggctggtcttgaactcctgacctcaggtgatccacctgcctcagcctcccaaagtgctgggattacaggcatgagccaccgcgcctggccattctttcacattttaaaaagcactaatttttaccacattttcccttaaatatgataagatgtgaaatattgatatcatcagtgcattttcttaattaaaattttgccaaaagattatggtcataagaattaagctgagtgaaataggctctgctgtgttgtagcttttgtttaaagtatcctagcccttaaaaatatattattttctttaactatttacagttatttccttgtaggtcccagggtttaaggataacgttttattatttatttatttttactttatttatttatttgagatggagtctcgctctgttcctcaggctggagtgtggtggtgcgatctcggctcactgcaacctctacctcctgggttcaagcgattctcgtgcctcagcctccagagtagctaggataacaggcacccgctgctatgcctggctaatttttgtgttttttagtagagacggggttttgccatgttggccaggctgctctcaaactcctgacctcaggtaatctgcctgcgttggcctcccaaagtggtgggattataggcgtgagccactgtgcccggcctaagagtaacattttaaagatagtgaaataatgctcaaaaaagatgtactggtatatagtgtctgtcttactaatgatgtttgaaaaatggagatatgttttaaatttttaaatttaaaacaatttcctcaactggcttgctatttcagtcttaggtgttctctaatgacatgcagcatgatttcctccatgttaaaacatgagaaaatgaaaaatttcctttcttaggcttcttttacttgtaatctgtacgtatatataatttttttttttttaatcagagtctcactctgttgcccaggctggagtgcagtggtgcagtctcggctcactgcaactttcacctcctggattcaagtgattctcctgcctcagcctcctaagtagctgggattacaggcatgcgccaccacacctggttaatttttgtttttttagtagagatggggtttcgtcattttggccaggctggtcttgaactcctggcctcaagagatctgcctgccttggcctcccaaagctgtttggattacaggtgtgagccactgagcctggcctgtatatataaaattatatttaaaacctggtggacttctttccatgtcaatacatatacagctttgtctgatttctaaaagttatatagtattctgtgtattattacgtagagactgtttaaataggattatcaacaaagttgcactgaacatcctatatggacatctttgtaccttttcttgattcctagataatttcctgaaaatggaattcttttattaaaagttatatacattttagatgacagattacccttgaaagatatactaccttggctgggcgccgtggctcatgcctgtaatcctggcactttgggaggccgaggtgggcggattacttgaggtcaggagtttgagaccagcctggctaaaatggtgaaaccctgtctctcctaaaaatacaaaaaaattagccaggcatggtggcaggcgcctgtaatcccagctgcttgggaggctgaggcaggagaatggcttgaaccccggagggggaggttgcagtgagccaagattgcgccactgcactccagcctgggcgacagagtgagaagattccgtctcaaaaaaaaaaaaaaaaaaaaaaaaaaaaagaaagaaagaaagaaatactacctcatactcttaccaacagcaaacagcatgagagaaataaagagactctgtctcaaaaaaaaaaaagttgtatttgtaattttctcctgttatattgttgtcgtttttttttttttttttttttttttttttttttttttggacagagtctagctctgtcgccccagctggagtgcagtggtgcaatctaggctcactgcaacctccacctcccaggttcaagcgattctcctgcctcagccttctgagtagctgggactatgggcatgtgctaccacactgggctaatttttctatttttagtagagatggggtttcaccatgttggccaggctggtctcaaactcctgactccagtgatccgcccatcttggcctcccgaagtgctgggattacaggtgtgagccaccaggcccagcctatattctgttaatgagaggattgttctgtcagttcagtgtaatacgctgtgtttttttttgttttttgtggtggagttttgctcttgttgcccaggctggagtggaatggcaagatctcagcttaccgcatcctctgcctcccaggttcaagcgattctcctgcctcagcctcctgagtatctgggattacaggcatgtgccactgtgcccggctgattttgtatttttagtagagacggggtttctccatgttggtcaggccggtctcgaactcctgacctcaggtgatccacccacctcggcctcccaaagtgctgggattacaggcgtgagccaccccgcccggcaacactgttaatatttcttacttcttgatttggagactgaagatcaccttgaatctatgtgtcaaatggggttgattttttgctaggaatttaagtctcagaaccttggattttggttggaaatgatgattatactgatttactgaaattgacataatagttattttgttgaatttattgaatgaagtagttgtaaaaacaattctatatattttctttagaattcggttccctcaaaattataaaggcaggaaagctcaagacaaagaaatccaacaaggtatgtcttcataggaaatagttcttaactgtattgatttttgaaaattgaggctaagaactcttaggttattataagtgtatttttcttctaattgtattattggtattagattaaagttaatattatggaaaatcataacctttatccaaatctctatatatgcctttgttatcatgtataactcaatttaatgttattaaatagtggtgaaagttttatcataagattaagccattcttatttcaaaatgttctattgtttgcagaaactttttgattaatttggcagatgcctgcatataactgaatataaatgattatttaaaactcctttcacttttagaaaatgtttttttcctgcttaaaatttctaaaagtaatttcagacctaacacttatttgttacttcttaggctagtgatttcagtgatatggagaattggccaacaccaagtgaattagtgaacactggagtgagtattgttttaaagtttttttttttaaagaaaggaaaatgtattcatttcgacatgcagaattttattttacttaaaatgtaaagaattgtcatactgggggacagattttttttatttttttgagacagggtcttgctctgtctccaggctggagtgcagtggtgtgatcacagctcattgtagcctcaaactgctaggctcaggtgatcttcctacctcgacctccagagtagctgggactacaggcacgcaccactgtgcacagctaatttttgtatttttcatagagacaggattttgctggtctccaactcctgagctcaagtgatcctcctgcctcagcctcccaaaatgttgagattacagtatgagctaccattctggctgaggaacagatttaaaaacttgattcatcaagaagattacattttgttactttaatttgcagttattcttcgatgctgccagtaacattggtaatgaacttgttgtcttaagctttactcatgggaagcttaacctaacctattatttctttctttcttttctttttttttttttcctttgagatagggtctcactccattacccaggctggagtgcagtgatgtgatcacagctcactgcagccttggccttccaggctcaggtgatcctccacctttgcctcccaagtgactgggactacaggtgtgtgccaccacactgggagatttttaaactttttgtagagatgggggtttggtcatgttgcccaggctggtatcaaactcctgagctcaagcaattggctcgcctcagcctcccaaagtgctgggattataggcgttagccaccatacctcgcctattatttctttaataatgaagacatattataaattgtaatcaaatttttatatttgtataaaatcacatacattgataaagaggtgctgaaaacgtggcagctatccttttgatagtttacccgcttttcagataacctaatttaattcatcacatttccctcatctggttatattctttttttgagacagagtcttggtctgtcgcccaggctggagtacagtggtgggatttcagctcactgcaacctccgcctcccgggtttaagtgattctcctgcctcagcctcctgagtagctggtattacaggcacgcaccaccacatctggctaatttttgtatttttagtagagacagggtttcgccatgttggtctcgaactcctgacctcaggtgatccacccaccttggcctcccaaagtgctgggattacaggcgtgagccactgcgcccagcctcatctcgttgtattcttaagaggtaatcttatatttgagatttgcattttctagaattttatatatgtggaagcattgagtaggtactcttttttttcctggcttgtactcagcattattttgagatttacttgtgtgtcagcagttcattcttttttcttactgagtagtatggatgtaacacagtttgtccattcacctattgttaatggacatttggattaattttacgttttggttgatacaaataaaactgctatatgaacgtttgtgtagaaaatttttcattttttcttggatatgtaactaggttggatcacttagtagctacctgttttagctttttaagaaactgctgagtttgcacttctatcagcagtgtacatgaattccagttactccacatcttcactcactctcttttttgtgtgtgtgtgtgagaccgggtctcactttgtcacccaggctggagtacagtggcatgatctcagctcattgcagtcttgacctcctgggctcaagtgacccccccacctcagccccataagtagctgcgactataggcatgcaccaccacgcctggctaatttttttgtattttttgtagagatggggtttcgtcatgtgcccaggctggtctcaaactcctgagctcaagtgatctacctgccttggcttcccaaagtgctaggattacaggtgtgagccaccgaacccatctttactcaccgataatatggtcaagtttcaaaaaatattttagccattctaataaatgaggagtggtatcccattgcagttttaatttgcatttttctgatgaatgaatgcaataatcttttcatagatttgccatcagtgtatctttttgatgaagtatgtgatcaatctgcccatttaaaaaaatggaaggctgggtgcaatgggtcatgcgtgtatcgcagcactttgggaggctgaggacggtgaatcatttggggttaggagttcgagaccagcctgaccaacatggcgaaaccccctctctacttaaaaaaaaaaaagagttagccaggtgtggtgacatgtgcctgtaataccagctactagggaggctgaggcaggataattgcttgaacccaggaggtggaggctgcagtgagccgagatcgtgccactgcactccagcctgggcaacaaagtgagactctgtcctcccgcccccgcccctgcaaaaaaaaaaagtggtattgatttgttgttactgagttttgaaagttcatatgtatttgaggtaaaagttctttatcaaatacttagcaaatactttctcctagtctgcagctttacttttaactgtcttttgaaaagtaattttttgcctttgataacagtttttgtcatttgttttgcaattttaggttaggtatattgccacaaatttttgggtatgttagtgaaaatattaatggaaatcatttcattctgaaaacctttttgcagtttcagagcgtcctcagccaaggaaataaaaagccacaaaatagaaaagaaaaagaagagaaggttgaaaagagaagtaacagtgacagcaaagaaaaccgggaaacaaaattaaatggtcctggtgaaaacgtcagtgaggatgaggctcagtcaagtaatcaacgtaagagaggtcagtttgtccatatctttattttgattttagtttttgaagaaagttgtaatgaggaattacatttcattaactgatctctggtagtcaaaaatgtatagtttgtatttcttcaggataaacaatctgcagaggtaactcatttgcttttgtaacatttctgaactattagactttcctttttgtatgtaacttgtattctatgcaagaaaatggaatggagttccacttagaggtacagttgtagatacattcttggaaagttgtgtgataattattgttcttttagatctgcattggaactgctccctatatttagggagtactgtgaaaattaaatacatttttttcctaagagaaaagtgagaataggctgggcgcagtggctcacacctgtaatcctagcactctgggaggctgaggcaggcggaccacttgaggtcaggagacatggtgaaaccctgtctccactaaaaatacacaaaaaaattagccgaacatcgtgttgcgcacttgtagtcccagctactcgggaggctgaggcaggagaattgcttgaacccaggaggtggaggttgcagtgagccgaggtcgcgccattgcactccagcctgggcggcagtgcaagactgtctcaaaaaaaaaaaaaagtgagaataattttagtcaatcttttccctcatagcattcccctgtcaaaattacactttgaaggaatgaaaatattgtcttcatatccttttccattttcttttctgaacttttcgtgtgtctagggacagtttatgatttacatgctttgtaaatcagtgctcggagtcttcgtaaaagtgtcttcaggcgcttctaggcagaaaagggctttaaactgttaagttgtcagtgactgaagcaaggtgattttctgggagagtagcaggaggtgaggttagagacatagatagacaacgtccatggtatacagggccttggagttatgattccattttgaataccatgggaaaccattgaaccaagattctctggaggtgatatggcatgggagggaacatttaatggtaaagttgttgccaacttctttaacactttaacttttaccgtagactgatcacttacttgaatagtttgtcttttttttttttttttttaagagacagagtcttgctctgtcacccaggctggagtgcagtggcccagtcttgactcactgcaacctctgcctcccgggttctaggaattcttctgcctcagcctcctgagtagctgggattacaggcccatgctaccatgcccagctaactttttgtattttagtagagacggggtttcactgtgttgcccaggctggtcttgaaatcctgagctcaggcgatccacctgcctcggcctcccaaagtgctaggattacaggcatgagccaccgggcctggccgaatagtttgtctttttaataaataactaatccttagtgcaggatgagcattatattcacttgatacaatgaataaaggctaattgctcaaaaacagtgacaacaagacaaacaagtggttgttagaaaaatttcttcctgtttctttttttttaatttttaaatttaaaaatgtttttaaaattttgaaacagggtcttgctctgtcacccaggctggagttcagtggcatgctcgtggcccactgcagcctcgatgacctgggctcaagtgatcctcccacctcagcctcctgagtagctgggactacaggcatgtgccaccatgcctggctaatttttgtatttttttgtagagacagggttttgccatgttggccaggctggtcttgaactcctgggctcaagcgatccatctgcctcagcctcccaaagtgctgggattagaagtgtgcgccaccatgcctggcctcctcatttcttaactacttcgtcacttaactgttccctgcttcctacatacgtaagtagtgttcttgactgtctagaatccatacagatgacagatttgttatcctgatctaaaatttgtctttttttttttttttgagatggagtttcgctcttgttgccacgctggagtgcaatggcgcgatctccagctcactgcaacctctgcctcctgggttgaagcgattctcctgcctcagcctcccaagcagctgggattacaggcaccacacccagctaattttgtattttttttttttagtagagacgggtttctccatgttggtcagggtggtctcgagctcccaacctcaggtgatctgcccgccttggcttcccaaagtgctgggattacaggcgtgagccaccacgcctggcaatttgtctttaattgcttcaattaaaactggtcagtcaacagtaaaacccaggtgttttgtagttagaacaattggtataatcaagcttttaattgatctagagtacagatttttgactttaaaagaagggcttctttgtgtcaaggaatctcgttgacataatttatagtataagattaaaagcctttttagatgcatttatattcacttttcctcatttgatccatagtttgcaggatttataggatatcaatattgtagttgcacactaatatttatttttaaattgccttggcagttttttcattgccatgagtctttattttggtagaaaatttagattgggcagaatactgaacattttgaaacctgagctatggcattcatgaatagatgatcttcagaatttcactatagaataaccataaataattagttacattgtcatttagtcatcaagaaaagttaaactgcttgtgtttttttttccttaggaagatgcataatagctgtaaaatgttctgtcaagttaaacaaattttatacttatccctcttccctcttatattttgagaaacctcattcatttgtaaaaatcctgggtaaattaatattttaggcagtgatgtggaactaaaagtgctgcaaacctaaagcctaactttccaaagtatacattatagcgttttatcagatatatcccattctaaagcctaagaattttaaattaaacagatttttttttaaaaaagcctaagaatcaagtactaaacaggaatgttatgtatatatacttttttttttttttttttgagacagactctcgtctctgtcacccaggctagagtgcagtggcacgatctcggctcactgcaacctctgcctcccgggtttaaggaattctcctgtctcagcttcccgagtagctgggactacaggcatgtgccaccatgcctggctgatttttgtatttttagtagagatggggtttcaccatgtttgccaggctggttttgaactcctgaccttaggttatctgcccgcttcagcctcccaaagtgctaggattacaggcatgagccactgcgcccggccttttttttttttttttttttgagatatagatattggactgttaattgtcattgaagtattttggtctgaggtaggcttatgcagaggagaatgttttcatgttacttatattaacattgtttcttctacgaaatgacagattggtccaatgtgatgtaaggagttcagttgtgtgtttgggatttttgggcggctgggcgtcgagcttgaacgctttgatggctgcttttaggccaactatggggattgtactttttactctctttacaaggttttttcctagtgtctaaagagctgtccttctttagactaacagttaaatttacaaggggattgggggttctgtaggcaaatttaaagttgaactaagattctatcttggacaaccagctatcacccaggctggagtgcaatggcacgatctcggctcactgcaagctccgcttcccaggctcaagctattctcgtgcctcagcctcccgagtagctgggattactggcgtgtgccaccacacctggctaatttttgtgttttttagtagagacagggtttctccatgttggtcaggctggtcttgaactcctggcctcaagtcatccgcccaccgcggcctcccaaagtgctgggattacaggcatgagccaccgtgtctggcctctttacaaataatcttaaaatacacattaagtgtttcacttatttgattaaagttcagagtgctttcaaattgcaagggtttagtgaaaattgtacatttgtccttaaatgattttgttttcttcaagctaataagcacaagtgggtaccactccacttagatgttgtaagatcagagagtcaagaaagacctggatcccggaacagctcaagatgtcaacctgaagcaaataaaccaacacataacaataggagaaatgatacacgaagtaagttaccattctaagacaaaaatgactaaggaaagacttagtcttaatgctcgttattttagtaaccacatgtataaaccatttgagaataagttgaagacatcatgtccctttaaccccaaataccttcagggtatatttcataagaacaatataaccgtaatgcaattaacaacaatgaaacttaacattaatacaatgtgattgtccacaggcagatttttctcaataaagtcctttatagtcgtcccctcccctgctccaaggatccattctgggatcacccatttaatttaattttttttttctctttaggctccattaatctgtaacagttcttgcttttgtctttcatgacattgatttttttgaagattgtaggataatcgtattgtagatatcccttactttgggttttctaatgtttccttatgattggattggggttgtgaatttttggcaggagtactgtataagaaaatatatcattttcttctttttttttttttttaatttttattttttttattgatcattcttgggtgtttctcgcagagggggatttggcagggtcataggacaatagtggagggaaggtcggcagataaacaagtgaacaaaggtctctggttttcctaggcagaggaccctgcggccttccgcagtgtttgtgtccctgggtacttgagattagggagtggtgatgattcttaacgagcatgctgccttcaagcatctgtttaacaaaacacatcttgcaccgcccttaatccatttaaccctgagtggacacagcacatgtttcagagagcacagggttgggggtaaggtcatagatcaacaggatcccaaggcagaagaatttatcttagtacagaacaaaatgaaaagtctcccatgtctactactttccacacagacacggcaaccatccgatttctcaatcttttccccacctttcccccctttctattccacaaaaccgccattgtcatcctggcccgttctcaatgagctgttgggtacacctcccagacggggtggtggccgggcagaggggctcctcacctcccagtaggggcggctgggcagaggcgcccctcacctcccggacggggcggctggccgggcagggggctgaccccccccacctccctcccggacggagaggctggccaggcagaggggcgcctcacttcccagtaggggcggccgggcagaggcgcccctcacctcccggacggggcggctggcgggcagggggctgacccccccacctccctcccagacggggcggctggccgggcggggtgctgacccccccacctccctcccggacggggcggctggccaggtgggggggctgagcccccccacctccctcccggacagggtggctggcccggcagaggggctcctcacttcccagtaggggcggctgggcagaggcgcccctcacctcctggacggggcggctggccgggcggggggctgacccccccacctccctcccggacggggcggctgccgggcggagacgctcctcacttcccagacggggtggctgccgggcagaggggctcctcacttctcagacggggcggctgccgggtggaggggctcctcacttctcagacggggcggttgctgggcggagggtctcctcacttctcagacggggtggctgggcagaggtgctccccacatctcagacgatgggcggccgggcagagacgctcctcacttcccagatgggatggttgccgggaagaggcgctcctcacttcctagatgggatggcggccggcagagacgcttctcactttccagactgggcagccaggcagaggggctcctcacgtcccagacaatgggcggccaggcagagatgctcctcacttcccagacggggtggcggccgggcagaggctgcaatctcggcactttgggaggccaaggcaggcggctgggagatggaggttgtagcgagctgagatcacgccactgcactccagcctgggcaccattgagcactgagtgaaccagactccgtctgcaatcccggcacctccgggaggccgaggctggcggatcactcgcggttaggagctggagaccagcccggccagcacagcgaaaccccgtctccaccaaaaaagtacgaaaaccagtcaggcgtggtggcgcgcgcctgcaatcgcaggcactcggcaggctgaggcaggagaatcaggcagggaggttgcagtgagccgagatggcagcagtacagtccagcttcggctcggcatcagagggagaccgagagggagaggggagaggggagggggagagggagagggagagggagagcggaatttattctatcattttcttcttagcgaatcacatgggagtatgaccttgatttgtcccattattgaagatactaactttgattacccctgtaactttgattattagtttgattacaacattgattaatattaactttgattacccctgtaactttatttgattattagtttgattacaacattgattattattattattatttgttttttgtttgagatggagtctcgttctgttgcccaggttggagtgcagtggcgtgtgatctgggctcactgcaacctctgcctcccgggttcaagcaattcttctgtttcagcctcccaagtagctgggactacaggcacatgccaccacacccggctaatttttaaatttttagtagagatggggtttcaccatattggtcaggctgggctcgaactcttgacctcaggtgatccacccacctcgatgtcccaaagtgctgggttataggcttgagccactgcgactggccacaatgattattaaccttgattacttggttgaggtagtgtactctagacttttaaaaaatttttaagtttcttcagcttttttgtttaatttcttttctccctttgtaattactgtgtaatttgtggagagaggctttgagactgtggagataataattttctcagacttttcaaacaagccttagcttccttttttttttttttttttttttttaaataagtgatggggtctcattctgttgcccaggctggagtgcagtgggacagtcatagctcactgcagtcttgaactcttgggctcaagcgatcctcccacctcagcttcccaagtagctatgatgacaggtgcgtgccaccatgcccggctaattaaaaaaaaagttttctttagagacagtcttgcttcgttgcccgggctggtcttgaactcctagcctcaagcgattctcctgcctcggcctcccgaagtgttgggattacaagcatgagccaccgcacttagcttctccctctttattgccaaataatattctgttgaatgcatatagccctttgtcttttcatctgttgatggataagtggcttgtttatagtttttggtcttcatgaataacgctgatgaatagttgtttacaagtctttgtgtggaatgtatgtatttctcaaatgcctgtgagtgaattgattggtcatatagtagctgtatatttaacattataagaaactgctacttgtagcattttacatttccatcagcaactttttttctttttgctatgtgttaagtcccatgtctagtggaattcctgtattttggatttggctgattgctttgtcatggtattcttttttttttttttttttttttgagactgagtctcgctctgtcgcccaggctggagtgcagtggcgcgatctcggctcgctgcaagttccgcctccctggttcacgccattcacccactgagtagctgggactacaagcacctgccagcacgcccggctattttttttgtagtttttagtagagagggagtttcaccacattagccaggatggtcttgatctcctgacctcatgatccaccctctttggcctcccaaagtgctaggattacaggcgtgagccacctcgcccagccgctttgtcatagtattctttggcatttgcatgttcctttttttgagacagggtctcactctgtcttccaggctaagtgcaatggcatgatctcggctcactgcaaccttcacttcctaggctcaagcgattctcctgtcttagcctcctcagtagctgggactacaggcatgcacaacagtacctggctaattttgtatttttttgtagagatggggtttccccatgttgcccaggctggtctcaaactcttgggcccaagcgatcttccagcatcagcctcccaaagtgctgggattagaggtgtgagagccactgtacctggcctgcctgttccttttgtcttttctttttataactggcaataagaaggagctaggttgattagattcaggcttatttttttgcttggaatactgctgtgtgtatttcactttcagttgtgttaatattgagttagctcaggtgttaggttgatcagtccattataaattattccattagtctttttttttgagacaaagcctcactctgtcacccaggctggagtgcagtggcgcgattttggctcactgccttccaaagtgctgggattacaggtatgagccactgcaccctggcccattagtctttactgaatggttttactttcattaaaatcattggccagatactttttttttgtcttgagacagagtctcgcactattgcccaggctgggttctcctgcctcagcctcccgagtagctgggattacagacatgggccaccatgtctggctaatttttgtggttttagtagaggcagggtttcaccattttgggccaggctggtcacgaactcctgacctcaagtgatctgcctcccttggcctcccaaagtgctaggattacaggtgcgatccaccgcatccggcccagatacattttttcacagggattgctcagattttcagaaagcagaggataggatatgtggaaacaataggatgagcatttgtttttatagttttctgctgaaatctgataagtcatgtcctgtgaatggataagaaggcctaaggaaattttacagacttaatattagcattcaaaaattttaaatatacctatgtagaggtaaatgtattttgattaaaaaaatttccaatatattatgaaaaactttaaacatacaaaaaattgaaagaattgttcagtgaatacctgtctagccaccatctagattaataatttctctgtatttaattcattcatctgctgaatcccttgaaagtaacttggagatgttgacgctttatcactaatgtcctaagaaaatgcatcatctaagaaaatcacactagtttcctagtaccatctaaaatctagtcaatagttaatttttctcaattgtccacaaaatatgacttttaaattataaaactttagctaaatgcagtggtgcaagcctgtagtcccagctacttgggaggttgaggcaggaggattgcttgagcctgcgaatttggggctgtagtgcacaatgatcatacatgtgtgggggggagcatatatatatatatgcatatgtataaaacttgtctatagaaaaattgactttttttctattgtttttcaaaatgtcattttaagtttttattctaaaagtaatggattctcataatttcattaatttttttcttattaaatattgaatatataagaaaatagacaaagttatacagaacaacaatataatgagctgagtatggtggcactcacctgtagtcccagctacttggtaggctgaggtaaggaggattgcttgagagcccaagagttccaggctgcagtgagctatgatcatgccactgcagcctgggtgacagagtgagaccccatctctaaaatcaataataatgatgatgatgatgatgaacagtggaaactcaccctgtttaagaaatgtatgttactattacttttaaacttcgctttgtgcactctgcaatttcatcccattgtctcggaaaaaatgagcttaagtgcattggtttctttcatgttttgaaatcgccatgcaatgtgactttatcaacattctttggcaggaatttttgtttttttaattcagcctacttttctttagattaatgcatgttggttgtattactgtaagtcttttcctgctgaaaggctgtttcactatttgataaaatctgtactaacggtgggtatttggattgtttccagtttttttgatattaaggtactaccacgaacattttaatgcatgttttccagcacacaagtacaagaggctctctatggtaattttttcagactgcagactacactctgtgagtgggttatgaaatcagtatattggttcatgatcaggtttttaaaaacctagagtgcttcacatagtaaatttttaaatgatatgtgtttataaaattttttgtaagtgtacttgtatgtaaaataaataaggcttacttacagattaaggcagaaatgtttgaaaaagtggctggacgcagtggtgcacacctgtaatcccaacactttgggagcgggaggtggcttgatctgggagggggaggtgggtggatcgcttgagctcaggagtttgagaccagcctgggcaacatagtgagaactcatctctgttaaaaaaaaggaaatgtttgaaaaagactgttttaggtctaagcattgaggatggaactatgggatctagggtaatgttctcagtgagggtgatttttttttccccaaagagtcatttggcattgtctggagatatttgttactggttgtcacaactgagggagtgagtgggtgctactggcatctagtgggtggtggtcatggatgatgccaaacatcctgtagtccacagaacaggcccccacaccagagtctaaagtgctaaggttgtaaaaccttgtctctaggatttgcatatcttcacattaattagattattccaagttgattttcaaagtagatatacctattttcaacctcattagcaatatatgaatgttctacctgttttttgagacagaatctcactctgttacctaggctagagtgcagtggcgaggtctcggctcactgcaacctctgcctcccaggttcaggtgattctcctgccctagcctcccgagtagctgggattaccggcgcccaccactatgtctggctaatttttgtatttttagtagagatggggttttgccatgtcggccaggctggtctcgaactcctgacctcaagtgatccacccacctcagcctcccaaagtgctgggattacaggtgtgagccaccgcacccggctaatgttctacctttttaaactttgtcaacatttcatattagagacattaaaatatttgttgtactggggtaaagagcctttcattgtcttaatttgcatttcttacagtccataaggctgaacactgttttcgtttttcttttttttttattctgagacggagtcttgttctatgcccaggctggagtgcagtggcagggtcttggctcactgcaacctccgcctcccaggttcaaacaatttttctgcctcagcctactgagtagctgggattacaggcactccaccaccacgcctggctaattttttgtatttttggtagaggcagggtttcgccatgtttcccaggctggtcttgaactcctgagttcaagcaatttgcctgtctcagcctaccaaagtgctggtattacaagtgtgagccaccacaccgggcctctttttttttttttttggagagggaatctcgctctgtagcccaggctggagtgcagtggtgcaatcttggctcaatgcaacccctgcctcccgagttcaagtgattctcctccttcagcctcccgagtagctgggattacaggtgtgtgctatggcacccggataatttttgtatttttagtagaggcggtatttcagtatgtcagccaggctggtctccagcttctgacctcagttgatccgccccccttggcctcccaaagtgctgggattgccggcctgagccaccgcgcccggccttgtatgattattgacccattggtaggcaccgttttctgtatttattgtccacttgcatttttttaccttgcttgtattttagatatttttcccattgagtggttgtgtctgtgtgtgttgcatgagagagagtcgtatgagttcttacatgtactctagatagaatttctatatttcgcttcagatatcttttctcaatttgttttgtgttttcatttcctttttactttataaggaatgtcatttacttaaatagaaccatccttaaatatttcgtgagaaatgttttttagcagttttatgtagtacaaacttagtagtcttggaacttcttgaatctttaacagcacaatcttaataaaactatctctttacctttctagtatgttattttacttgttagaatgtattcttcatgtgtcagtaccttttaggctctgttttatgctagagatatttttgataaattcttattggatctcttcagtttgtatccatctgaaaaatgcctggctactgttcattagttacaaagtggaagaaggtggctattatgttttcataaagacaatcatgttattttacttggcaaatcgaagtatataaaaatatttttatttttaaaaggttggaagcgagatagagaaaaaagggatgatcaagatgacgtttccagtgtgagaagtgagggtggtaatatccgaggttcctttagaggtcgaggaagaggccgaggacggggaagaggacgaggcagaggaaatcctcgatgtatgacataatttttgtttcgttaaattagataaactttgaaaaaaatagagcaactatcctctattatgttttaactaattttctttgtctgataatagatggttttatgtttgttaacctttgaagttcttcactttatccgtagtaactatttttttctaatatgtgattacctttctttttctttattcacatcaagtgaactttgattattcatatggttatcaagaacatggtgaaaggactgatcaaccatttcaaacagaacttaataccagtatgatgtattactatgatgatggtacaggtgtacaggtgtatcctgtggaagaagcattgcttaaagagtatattaagcgtcaaatgtaagtggatgtttgatgtaagcagacgggatagcaaaatctgttgcaatatgaactttaatgtcattgataatgaatatgctataatttttttttttttttgagacagagtctcactctgttgcccaggctggagtgtagtggtacgatcttggctcactgcaacctctgcctcctgggttcaagtgattgttccgcctcagcctcctgggtagttgggattacaggcacatgccaccacacctggctaatttttgtagttctggtagagaacgggttttgccatgttgaccaggctggtattgaactcccggcctcagctgatctgcccaccttggcctctcaaagtgctgggattataggcgtgagccaccatgcctggctgtttataacatttttaaagctacttatttgtaaaggttggaaaatgttaaaaattattttgattatatatttttagggaatgtgattaaagtaggtgtttttaaaattttatatttggtttatgttgtttatataagtctcctggcttctatagtatttagatatttttctccttaaaggagattaggtaaaatgttattgcataatatgaataaatataagactgtaaagcttctctatatatacttgaaactgaacaagtaaaatttggcttattatttgccaataggtgtttatattagaatttgcaaattaacataaataaaaaatggtggtatcttttgattttcttcttagcaattgacttctgaattcttaagttttttttatcttctaagtttttctttgtgacacaattaaatggggactaccttatattttagttcagatttcttactctagttctcatagtagttgctttctgggtactgaatgtgaagtcaggagaatattagttctattttctgaaagaaaaaacaaaccctatgcatattagtattgtataggatattttgcttatttatatagtatgtttttatagaggcaagagaaaaatgttgccaagtaatttgcataaccaatttgttaaaacttgaaatttttctctccttacaaggtgaaggaaaagggctatttttgaaagggcataggcatttaaaaatcatctgtttttccaaaataaaatagactctactctgttactagaaaatttctttatcatcatcagccaggcaccttcctgggttgccttcatggtggatccaatttgcttacagtgtggagcaacttgtttatattgttcttgcttcttttgttacagttgatgcaaacactgaagaaaagggcctttttgtgggcagaaagtgcttgacatgtggctgtcaacttcataccactattactgtcttttttgtaacttttgctgccaagtcccttctgagacctgacagtggacatgcaactccatgtcaggataatcggcctccagtgtgctcatacaagtgagggaggagcagagctacttcagtgttgacaaaatttctgatcatgcagtgtagaatccagagcctctaaggtaggacttgatgatgtccctaggacactgagcaaaatgtcagacatggcattggtcatgcctctttttttgttgttgttctagcagtagggattttggcaaatgttagtagagcactaggtttagtgtggcttgttattattattaccattctttgattagtggagatgtggctttgaaggagtcgtgctttttactttgtattatttggtttctaatatatagataggctgattgattgaggttttgattttctttttgagaagtcactaaaagttttcctggccaggtgcggtggctcacgcctgtaatcctagcactttgggaggccgaggcgggcggatcacgaggtcaggagatcgagaccatcttggctaacacagtgaaaccccgtctctactaaaaatacaaaaaattagccgggcgcggtggcgggcgcctgtagtcccagctactctggaggctgaggcaggagaatggtgtgaacctgggaggcagagcgtgcagtgagccgagatagtgccactgcagtccggcctgggcaaaagagccagactctgtctcaaaaaagaaagaaaaaaaaatgttttcctgacacctgtggaaaaatgatgcaaaatgtatcgtacagtatgaggcctaaacgtattcaaaatggttgaggggttttttttaaacttttttttttttttttttgaaatggagttttgctctcgttgtgcaggctggagtgcaatggcacgatctcggctcactgcaacgtccgcctcccaggttcaagcaattctcctgcctcagcctcccgagtggctgtgattacaggcatatgccaccacgcccagctaatttttgtagttttagtagagacggggtttcatcttgttggtcaggctggtctcaaactcctgtcctcaggtgatccacccacatcagcttcccagagtgctgggattacaggcgtgaaccaccgtgcctgacctttttttttttaaaaacattttaaaaactttttattgcagtctacttttttttaactttttaaaaatttttttgagatgctaatttttgtatttttattagagacaaggtttcaccacgttggtcaggctggtctcgaactcctgaccttgtgatccgccgtcctcggcctcccaaagtgctgggattacaggcgtgagccaccacacctggcctacttgtttttaacattttaagtgaaaacttgtattaattgtttgtgatgtcagcattaaaatgtaaagatcttgattatttctagctgtgataatctctcttggcactcagatgacagcactctgatagatttgtagatctttagaggttttttccttttttctttttctttttcttttttttttttttttttgagacattgtctcactctgtcgcccaggatggagtacagtggcgcaatctcggctcacctcaacctctgcctcccgggttcaagttcaagcaattctcctgccttagcctctcgaatagctgggattagaggcacgtgacactgcgcccagctaatttttgtatttttagtagagacagggttttgccatgttgccccatctggtctcgaatgcctgagctcaaagtgcctggccaggacagtttgttattgatttagggaagttcacatctcacagctaagaacagttgtaacttgtgactaaattaaatgtcttaatgtctgaaattttagaattttttttttcttttgaaatggagttttgctgttgtcacccaggctgcagtgcaatggtgcaatcttggctcactgcaacctccgcctcccgagtccaagcgattctcctgcctcagcctccccagtagctgggattacaggcacgcaacaccatggccgactaattttgtatttttagtaaagtcggggttccaccatgttggtcaggctggtctcggattcctgacctcaggtgatctgcctgccatggcctctcaaagtgtggaaatgacagacgtgagccaccgtgccctgcatgaaattttagaattttaacacatgtattatgtatctgccacatgccagacactatgaataaggcttttgaggtgtaacaaccatcagaatcttcattgctttaagacttcagtgtttaaaattttttcctttagtgtttaaaaagagtaaatgaggccagggcatggtggctcactcctgtaatcccagcactttgagaggctgaggcaggtggatcatctgaggtcaggagttcgagaccaggctggccaacatagtgaaaccccgtctctactaagaatacaaaaattagccgggcatggtggcacacacctgtagtcccagctactcaggagggtgaggcaggagaatcgcttgaacctgtgaggcggaggtcgcagtgagccgagatcatgccatcccactccagcctgggcaataagagtgaaactccatctcaaaaaaaaaaaaaaaaaaaaaagtaaatgatttactagtgttactgagtgagatgtcagtagtatttcagtagtctttgagagagctttgcactctgacaattgggtaaatatcaaactattaaaggaaaatttggatatttacattcttaaaataagttgatttattttcttccccttcagtaaaaggtagctgaaaacaagtttccagttatagatgcctttttttcaaagatagaatttggcccatatacttcaagggcatctttagtcactgagttttataccccaaaatgtgagctggtttgttttctcataacttgtattccatgtttgaaaactttctctgtgatttggaaatagtgtgggattattaaactgtaggccccatcatcattgatgttatgtatttcttttgtatcattcttctctatattttcccgtttgtcttcttctctgtctttaaaatcctcatactctcatttacatatatggaggctataatttttttttttttttttttgagacggagtctcgctctgttgcccaggctggagtgcagtggcacgatctcagctcactgcaagctccgcctcccgggttcacaccattctcctgcctcagcctcccacgtagctggcactacaggcgcccgccaccttgcccggctaattttttgtatttttagtagagacagggtttcaccgtgttagccaggatggtctcgatcttctgacctcgtgatccgcccgcctcggcctcccaaagtgctgggattacaggcgtgagccaccgcgcccggcctatggaggctataatttaaacatgtatttctctctctttaacctttcctatggtgtggataaacatgtatttctcaaaggctattattaaatgtattgtgaatattatctttatatcttgggatttgtagttactgatcatactgacagttcatccatttacatttctctcggaaaggttaagtgggtttgtgtttttcaagagaagataaaacatctaatcatcttctatatttttgcttccatgtgcctcatggtgtcaaggatattccttctttagctatattctgttcacccttaatgtctttcttttttttttttctgtttgagatggagtctcgctctgtcgcccaggctggagtgcagtggtgtaatcttggctcactgaaagctccgcctcccaggttcacgccattctcctgcctcaacctcccgagtagctgggactacaggcgcctgccaccacacccggctaattttttgtatttttagtagagacggagtttcaccatgttagccaggatggtctcgatctcctgaccttgtgatctgcccgcctcagcctcccaaagtgctgggattacaggcgtgagccaccatgcctggctaacgtcttttattattgtttttagacagtcttgctctcgcccaggctggagtatagtggcaccatccctgttcactgcaacctctgcctcctgggtgcaattgattctcctgcctcagcttcccgagtagctgggattacaggcacccgccaccatgcccagctagtttttgtattttagtagagatggggtttccccatattggttacgctggtcttaaactcctgacctcaagcgatccacccacctcagcctccgaaggtgctggggttacaggcgtgagccacctcaccgggccacccttaatgtcttatggtctgtctatcaaagaaagaagcatggagaacttgaatcgttcaaaatatatatgtgcacatatgcctgtgtgttcactaagttttttttgttttgttttgtttttttttgagatggagttttgctcttgttgcccaggctggagtgcaatgacgcgatcttggctcactgcaatgtttgctgcccgggttcaagggattctcctgcctcagcctcctgagtagctgggattacaggcatgcgctaccacacccggataattttgtgtttttagtagagacaggttttctgcatgttggtcaggctgatcttgaactgccgacctcaggggatccacccatctcagcctccccaagtgctgggattacaggcatcagccaccgcgcctggccatgttcactgagtttttaactaagaattgtgctggttactaggcttcagaagtattaaacatggcagtactttgtcaacttagaaaacaaaatgaactacttttctgtatgtgaatttgacaaaggatatttccagtataccactcttctcagcgactgggaaaaaggtggaaggcattatgctaacatgggattagctttgttatctaatgcttaaatgaaacaagtagaagtggctttgtaaagattttcatctaattaactcattaaaaaaaattattgaactattttaaggtaaaatgagcagcttaattctttatatttagtgaaactgatctaaatagaagttattaattttttggaaaataatattttaagtttaagagaaattattaattcagtagagttttttgctatcttatatgtttaccctatctgtgttgtattagagctatacatattgttaaccaaattacaatattttcatgttaatgattggttttcacagttaatgtgggagcaatagaaatatttatttcctactaaataaatggatgaaattctgatttctcttttcagtgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggtaattgctcatttgatgaacaatttgtactttctgctcaaatttcctttgtacctaaaacttctctgaaaaacagagtactaaaaacagacaatctgtagttgcttgaggctcagacagcattccatgatgtttttctattttgtaaaaccttcataaatgtctaaccttggaaacccctgaaagtattgctaacgatgttactgtgtattttctccttcccctccccctcaattagtcaacctattttaaacctgatccttcaaactttaacccttttgaacacccttggtccttaaaacttcttcagggctgggcgtggcggctcgcacctgggtgatagagtacaacggcgcaatcaaacacaaatttcttcaggttactgtaaaaaagcatgtgttcctgtatatgtatgtgtatatatatatatatatatattttttttttttttttttttttttttttaagacagtgtctcactctgttgcccaggctggagtgcagtggcatgatatcggctcaccacaacatctgcctcttgggttcaagcgattctcctgcctcagccttctgagtagctgggactacaagcacgcaccatcatgcccggctaatttttgtatttttattagagacttggcttcactatcttggccaggctggtctcgaactcctgaccttgtgatccgcccaccttcgcctcccaaaatgctaggattacaggtgtgagccagcactcccagccgttcccacttattgaaaggctaatttcaaatagtccttctggctgggcatggtggctcatgcctgtaatcccagcactttggggaaaaaaaaaatctctcatctggtctgtttctagaaatgctttcaacatctttttttttctagccaatttctttccctacacacaacccttggtaaccacaatcactaatctgctttttctttttttctttctttttttttttttttgagacagagtctcattctgttgcccagtatggagtgcagtggcacaatcttggctcactgcaacttctgcctcccaggttcaaggattttcctgcctcagcctcccaagtagctgggataactggagtgtgccaccatacccagctaatttttgtatttttagtagagacagggtttcccaatgttggccaggttgtagccttttgtttctgatttttcacttagtattgtgcttttgagattcacctatgttgcatgtagcagtagtttgttctttcatattgctgactagtattccatggtatggatataccacagtttatccattcacttgttggtggacattcagattatttatggttttggagagtgtgagtaaagcatgaagatctttatagggatatatatatacacacacacacacacacacatatatatttctgttggataaatatctagtattgtgattgctggaaagtatagtaagtatatgcctatctttataagaaaatgccaacctattgtccaaagtggctttaccattttgcattcccacgattatctataggacttgttcctcagccttatcattgcatatattgtcagttttttgaataatagatatatagtggtttctcattgtgggttttttatttttttgggacaaagtttcagttttgctcttgttgcccaggctggagtggagtgcaatgccatgatcttggctcactgcaacctccacctcccggattcaagcaattctcctgcctcagcctcccaagtatctgggattacaggcgcctgccaccacactcagctaatttttaaatatttttaatagagacgagatttcaccatgttggccaggctggtctcgaactcctgactttcaggcgatccatccgccttggcctcccaaagtgccgggattacaggcatgagctaccgcgcgcctggcctgattgtgtttttttgtttgttttttgagacagagtctctctctgtcgcccatgctggagtgttctggtgcgatcttggctcactgcaacctccacctcctgggttcaagtgattctcctgcctcagcctcccaagtagctggtactacaggcgcacgccaccaagcctatctaacttttgtgtttttagtagggatgggggtttcaccatgttggccaggatggtcttgatcttttgaccttatgatctgcccgcctcagcctcccaaagtgctgggattacaggcgtgagccaccacgcctggactcattgtggttttaatttgcatttcactaatgattaaagttgttagcagtttttcatgtgcttttttgtctgcataccttattagtggaaatgtctgttcagattttttattcattattattgaagtgttttttaaaagataattgtatgagttcttcattctggatacaagtccattatgtattttgcaaatattttttcctagtttttgtcttttcattttcttttcttttctttttttttttgttttttgtttttgtttttgagacagagtcttgctctgtcacccaggttggagtgtaatggtgtgatctcagctcactgcaacctgcgtttcctgggttcaagcgagtctcctgcctcagcctcccgagtagctgggattacaggcgcctgccaccatgcctggctaatttttgtattttttagtagagacagggtttcaccatgttggtcaggctggtctcgaacttctatctcaggtgatccacctgcctcggcctcccaaagtgctgggattacaggaatgagccaccgcgcctggcttcatttcttaacaggcttctttgaatagcaagtttttgaacacgtgtgcttcgtgttttaaaaatcaactacagggctgggcgcggtggctcatgcctgtaatcccagcactttgggaggccaaggccgatggatcacttgaggtcaggagtttgacaccagcttggtcaacatggtcaaactctgtctctactaaaatacaaaaattagctggacatggtgacgtgcctgtaatcccagctatttgggaggctgagacaggagaattgattttactatagtaaagtccatgttttgaaaataacataaaataatgatttgttggtgtataattaatgattcttggtttcatgaaaataattactgtaagcaatgtcattattgcatttgtttatagataagtatataaggtttctatatattgtaattaacagagaaaattagtttttttttttttttgcaaaatttgctcttagagcaaatattatgattcatagtagaatgagtttatttatttacttatttatttattttcattttttagtagagatggagtttcaccacgttggccaggttggtctcgaactcctggcctcaagtgatcttcctgcctcagcttcccaaagtgctgggattacaggcatgagctaccgccgccggcattagaatgagtttattaactgctgccattgtgctatagcaaagtgctgtagccaactcagctgccgttttttatgaagttgttgccattttttccctgtctacttctgtacgaatgtagttgtaattttattattgtatgcctttttggtctgtttgtagtcccattaaatcctcaagcacaattttaagatcattgacattttgtttttacaacctacagcagtaaggaaggatttttaaaaggaagctttgagctactgttatggttagcactgatacagtagctaatgatacagtaaaaaataataccactattgaaaagcagaaacacataagcatagcaatttagaagaacataagtctgcattcacttaacattcattatgcacctaccatttgtaatagtaggaaaggtgttctttttctgttgagaaagtaaggcttcattaggcattgtagtgttaacatatcaagatcatggacctatgaatatgtcccttgtagctctgtgactattgtcagtgtcctgagacagtaatatatatttcctagggttgtcatgaggatgaattgtgttaatgaaagtatctggcaaatgtagtaagctctaaataagtaagcatttgctattattgttagtcttaaacgatgtcgttctgttgataactcctttatcttcatgcatttcattttaaccagcttcttcccatatgtatttgaatatgctcaagtttttcctttcttgaaaaactctcaagagaagcaaaataatttagctgatacccgtatctgccctggttgagtatgcaaacgcaaaccaaacttgttgaatctgattcttctccgctcatttattttttagcttactgcattctcgatgtcttccccataattgaaagctttttgtgtcttccatttgttagagcaaattgatcttggttctatagcttaccagttgtataactaagcaattaacgtaatatcttcatgcttcaattttcttgttaaaatatagcaaataatacttaagctataatagagtatgaggatttagaggaataattaatataatatcagcctcagaactgtgcctgctactttcatctcaaaccttgttttctaaattgtctgaacttgtggttcctcaaaacttgtgctcttttctttttatctccaggtctttgcacattcaagtctttctcttactaccaggcagtaagaatgcaacatctatgtattccggcattggtagttattcatagtagtaggtctgtatcattaagaaaagaaccaaaattaatagctaagtcagttaaaacctcagatactggaaaatactgatgtacccagtaactcattgtttaggagttcaggattaccaaggcttggttttataactcgatgtttcttctaggtctttaccttaattttgtgcatggtgtaatttttatatgatccttttatggcctgagtgatgaatgtttcactttatgtgttcttcatttcccttttaaatttattatttctaaataggaaataaattacacaaaattcaaaactcaaaagggtatatggttatcttccagtgattgtccaaggaaaaaaaaggtatatggtaaaaatttttttttccccatttttccaccaacaatgaatgaattacctgccttggtagtggtcagtgttacttctttcttgtgtcttcctcctgagatagtttgtttatgtaagagaatactatgataccttactacatacaatgtttgttatgccccttcctctttttttttttttttttttgagacagagtctcactctgtcacccaggttggagtgcggtggcatgatcttggctcactacaacctctgcctcctaggttcaagcgattcttccgcctcagcctcctgagtagctgggattacaagcgcctgccaccacgcctggctaatttttgtattttagtagagacgggtttttgccatgttggccaggctggtctggaactcctgacctcaggtgatccgcccgtctcggcctcccaaagtgctgggattacaggtgtgagccaccatgcctggcctcctctttttttattttttataaaaaacatgtgttggaagaggctttagtagctgtacataaagaactttgagcttttcatcccacaagtttttctttaaatattttcttttaaattgaggcataatttatacattattattattttatttatttatttatttagagatggagtctcatgatctgcctgcctcagcctcccaaagtgctgggattacaggtgtgagccaccgtgcctggcctttatacattatatattgtaactcataagattagagatgattttttttcctatgtatacggtcaggtaactgccatccagattaagatacagaacattttcaagacccaggcaagctgctttctgtaccctcctagtcagtaccactgctttcccttttaagaggcctctctcctgtttttgaacttcacataaatggtgttatgacttttatatctgattttatttctgaagttatttctgtgagatttattcatattggtgtatagcagttgtttactttctgttttttggtagtttttccattgtatgaatataacagttaatcaatctttcttttcttgctttcttccttttttttgagaccgctctcactctatggcccaggctggagttgtactgacctgatctcagctcactgcaacttccacctcccagtttcaagcgattctcctgcctcagcctcccgagtagctgggattacaggcacccaccaccaagcctggctaagtttttgtatttttggtagagacagggtttcaccatgttggccaggctggtcttgaactcctgatctcaggtgatccactcacctcggcctcccaaagtgctgggattacaggcttgagccaccgtgcccggcaacagttaatttttctatgctcctattgatagacatatttgggttctttccactttgggtctttgatgctactgtgaacgttgtcatagatatttctgggtgaacataagcatttattttcctgggaaactggtgggtaacagggcataaatgtgtgattaccttttgtagatactgctaagcatttttttaaagtatcaaaccaatcaaaaccaccactattgggagtttgacttgcttcacattctaaccaacactactagcagtctttttccacaactttactttggaaaatttaaacatatgggaaagtttcaaggagttttttttttgttttttttttacattcagggatagataatacatggtaaaatacagcgatcttagatgttcactgtgagttttgaaaattaaacataagcattaccccaggcaagatgtagaatactttcattattctaaaaacttccttcatggctctttctagtcagtgtcacacagcctctccaacaacttttctgattttcatatcatagattagattagtctgttcttggcatttgtgtaaattgatttcttctgtctctgagttcttttcattggtagtttttgacattcatccatgttgttgcaatggtctggatgctgggcatactgtttgctactggggtgtcattgcttctaggtctttcagtggacaaaatgaggaaaatatatgttgggaaaaatacactgattttactcatctaaagctttcaccataggattctttcctatctttctccattttatatttcagactcccttctcaaaggagtttcatttaaaataagtcctaattgtaatttaaaggaatccccaattatggccaggcgtggtgtttcacacctgtaatcctgcattttgggaggccgaggcgggtggatcatgaggtcaggagttcaagaccagcctggccaacttggtgaaaccccgtctctactaaaagtacaaaaaaattagccgggtgtggtagtgggtgcctgtaatcccagctactccgaaggctgaggcagagaattgcttgaacttgggaggcggaggttgcagtgagccaagttgacaacactgcactgtagcctgggtgacagagtgagactccgtctcaaaaaataaaaataataataataaaaaaagaaatgcccagttatggaaaatataacttgagagttaagtaccatactaatattaagagcaagagtaggttcttttttcaaaatctgttcatttctgaatggataatgttcttttttttttttgagatggaatcttgctctgtctccaggctggagtccagtggcgccatctcggctcactgcaacctccagctccctggttcaagtgattctcctgcctctgcctcccaagtagctgggattacaggcacatgccaccatgcccagctaatttctgtatttttagtagagatgaggtttcaccatattggccaagatggtctcaatctcctgacctcgtgatccacccgccccggtctcccaaagtgttgggattacaggcatgagcacctggcccggttaatgttcttaattatatacagcatgttctccagctaaaatgtagtgggctttaatttttataagttaatgtacatataactttatattgtttttatattatacattttgtatttatcctaatttctaaaaggtgagtactcctgtatttcagtgagaagttaaaccaataaggatttagtttgtatcttgaagaaattttggcctagttttgttttatccttgtagtacatattggggaggcacctttgcctaatggctaagacttttagttgtagatagatagtggtttgagtcctggtgttgtctcatactagatctgtgatctttgattaagtttatttctttgagcctcagtttcctcatctatatgtaggggtgataccttctttatgaggtattgtgaggaatcatgagtacatgtagtacttattattcaataaattgtggtaattattacaataataaaatgcctacattttatttggtaatattttaatggaagacaaggaaatatgagagagaagaaaatagtaaaagtcaatttgcttctagctgattcagtattccttaaatgactgttctaattgtgaaaaatatatcatctgaagttaaataagtgggagatcaggatatttgttaccttacaggtgcaaatgattttaaaacttgtgttctatgtggttaacttatggattttttagaatcttaactgcaaattagtttgctaatttcaggttttcaaatttttaggttcttagaagtatagcacagacagtgaaatagctcataattttaatagctcaatttctgttaataggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacaggtaacatcttttcttctagagcaaacgatgtaacagtgggttatttggtccaatttacttacttatttatttattttcagtttatttagatttgataggaaaattaaagctaactgaaagacttttgagtcccattttgtattcatattgcctcactcacagagttacaaattaaataaggatttaagaattatgaggaaagctgtcttatgtttcttgttcttaaattatatgtgtactttgtcatgtatggagtttctatcttttatttttactaaataactatagatatgtatcgttttcccctgtaaaattggaatagtatgattggattattctaaaaaggtcttatactcaagagtggggtagtcttcctttaattttgttaccaatacgctttaatcttgtcttggaaagataaaatgacctgcattctaaattagaattggggttctgtttaatttggttgtgtttagaatttccaaaagatttaatgttaataattttttcctggatcatttttaagacattccctcttgggaaaaaatgtgtgcttaaacttttttcagtcagggtgatgatcttctgaagctcttggatgtcatttgatcggaatatgcagtggaataggtgactcactgaaatgcctttataaatactggaacaaatcctgctgcaaaaatgaaagcgatcagactgtcttctgttcaagaatgtctattcccacctcttggtggaggaagttgggccaacactgcagtggagataaccacctttgcgataatgagagacagaccagaggactgctactctttttataggagctgcctatttctgtgtaattggcctgggctgcatgggctgcttttattcatggtgggaaagttaattattattattctggaaataccgcaagattatgttttctgtttccagggttatgtacttgtgtccagatgaataaagcagaaaaagaggggattgagtagcatttcccagattcttaagtactttgctattcgatttgcctttcagtgtagtgtacattgtaaaactcagatattgtcatgatgtttcacttggacataagacttattaatgtggtcacttaaggggtaaggaatttaagaactggatgaggttatttcttcctttactcttcaaaatgtatttttgatacatcagtatgagaggacgtcccatcaacaaagcatcgatgatggacagtctcacactatttttatcatatgtttctttgtcagccttctgcttctaatcccagtaagcaacttggacaggcattttaaaagctgaagaaaagtgacattattttagctagtggtttttaatttattttttgttaagatataatgggtgattatataagttagatttatttatgatatcaacttgggtccaagatgatagttttagctagcttatgaacattgggttcacaaggcattgggtaagttagataaaatagcatatactttctctgcagggtaggtaagataggtcagtcaagttggtaatgcctgtccattaaccatttatgcatactaataaaattataagaataaaatcataatgttgtacatttttgtgttttttaatatacactcagatgcatgcacatacatattgtctgaaacaagccagtatatattaaaatgtcataaattttaggttatttagattacatatcagaaactagatggttaatgaagaaatataggaagatggagggttcttagaattatgctgattcacattaggtcataggaataaatatgtaaatcacctctttccatgaattcccaaatttctgaccttaataatttcctagtgataagaaagcctagtttctttaagtcaatggagagtagtatgtcaccaaaaatttgaagtggaaatagagataagaagcatagactgtgcttatatgtatctatgagtagagaaaagtagtgaaactgtatatcattttaatctcaaatttgaagaccttaaaattttaacaacataactctttatgatttctgagggatttgtatggtaaaatattctaacataattggtcttcttcatcaaagagattaaaatttctattttttttcctatctggaggttgaattttctaataggggttgaactgagcagaagtctacctttatgcaccagaaaacattgattatgggaatggtaagattacttctgaaacataggttttgcagttttatggatattgttagtattttactattaactcttaaatgaaaggatttcattcatcagaattgaaaggtcaggtacctgacaatgttgggtttttttctttttttaaattttaataatcttcacaagggcactgtaatgtagtgtttttctttcttttcttttttttttccccttgactcttagcaccactcaatgaaaattttaaaaagtgccacacataaaatatataatccttttttcaggaaacctttttaattacccagaactgtgatcctcccaaggtacaaaaaaaaaatcataccagagatgaaatgtatatggtgatttatctttggagagttcagttgatattttttttgttgttgttgagacggagcctcactctgtcgctcaggctggagtacagtggcgcagtctcggctcactgcaacttccgcctcctggattcaagcaattctcttgcctcagcctcccgagtagctgagattacaggtgtgtgccaccacgcttggcttatttttgtatttttagtagagatggagtttcaccatgttggtcaggcttgtctcgaactcctgaccttgtgatcagcccacctcggcctcctaaaatgggattacaggcgtgagccactgtgcccggccactgataattttcagttaataaaagcagcaaagataaattttctgtgttcttacaaattaaaacaagtattaaatatatgtatctaaattttttttgtttctaagtagtttaatatcaggtaatctaagtcatttaaactcattttgtcttggaagattagggtttactattacccttaatccgttcagatgtatagtttgaagtcttttcattattaaaaaaaaaaagatttgggaggccgaggcgggcggatcacgaggtcaggagatcgagaccatcccggctaaaaaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaagatgcagcagaccacacagagcatatatgtaaattaattatgaggttaacacctttacgagtcttattctaagaattgtacgttttcttgtcttacccaaattctttagtgttttaatgtcatttcatttctaagcatatgtgttggcgaatatattgaaatactttacttcccagtagaagtatttaagcataattcaagcttaaataacatttagagataattttataagaagcatctgagtgtgggggtgtacacctgtagcccagctacttgggaggttaagtttggaggatacttgagcccaggagttccaaggccagactgggtgacataccaaaaactcataatttttttttttttttttttaagagatggtgtcttgctccgttgcccaggctggagtgcaatggcacgatctctgctcactgcagactccgcctcccaggttcaagcaattctcctgcctcagcctcccgggtagctgggactacaggtgtgtgctgccacgcccggctatttttttgtatttttagtagagacggggtttcaccatgttggtcaggctggtctcgaactcctgacttcaggtgatcacctgtctcggccccccaaagtgctgggattataggcatgagccaccaagcccagctcttcatctacttttaaggctttatttaatatgaacattgataattcatagtattagaaatagagttctctgggccaggtgcagtagctcatgcctataatcgcagcgctttagagattgaggtgagaggattgcttgaggccaggagttcaaggccagcctgggtaacaaagtgagacccagtctacaaaatacatgtatttttatgttgactgggtgtggtggtgtgcatgtgtagtactagttattcagcaggctgagttgagaggattacttgagcgcaggagtttgaggctgtagtgagctatgatcatggcactgtacagctgtaaggggccctgtctcttttttttgttttgtttttgagacaaagtcttgttcttgtcccccaggctggagtgcagtggctcactgcaacctccgcctcctgggttcaagtgattttcctgcctcatcctcccaagtagctgggattacaggtgcctaccaccacgcctggctaatttttgtattttttttttttttagtagagacggggtttcaccagttggccaggctggtcttgaactcctgacctcagatgatctgcctgcctcggcctcccaaagtgctgggattataggcatgagccactgtgcccatcctctgtctcttaaaaaaagtttcatgtatggttcattaaaaagaaaaaaaaaagtgttctctggagttaatatttttcccattcctataactagacaattaatgttcatccaaagcttgtatttcacttgtactttttttgtgaatgaattggtgatatatgtagtgttaataaagttacagagcaccactgtccaataaaaatgtgagccatgtatataactctaaaaattttagtattcttaaaattataaaacatgaaattaattttaatattttaaatagatattttaatttaacttaatagatccaaatgttatatgctcagtgtaaaaattaatggcactatttttttttagcggggttgggagtacctggtctttaatacctggtgtgtattttactcttgtcctgagcatgtttcaggactagccacatttgaagtgatagataactgcatatagctaatgcttactctatttttttttttttttttttttttttgagatggagtcttgctgtgtctcccaggctggagtgcaatggcgtgatctcagctcactgcaacctctgcctccttggttcaagggattcttctgtctcagcctcccaagtagttgggattacaggcacccaccaccacgcccggctagtttttgtattttcagtagggatggggttttgccatgttggtcaggctggtctccaactcctgaccttaggtgatccgcccacctcggccccccaaagtgctgggattacaggcatgagccaccacgcccagctgtgcctactgtattgaacagcacagttctagagcttttcctgttatgaaacaatatatagtcttttataaataatacagtaatctagtagttgagtcctggttgagtccatgtgtccaaggggaagatattaaagctatctgattttactctcatctatgtctagcatgtagatgaatgtaaaatcttgaaatactcttcttaaacccattcttgaaatgtgcctttcatttagtaaatattaaacaaaagattgctggtgttaatttatttcagctttctgcatttaacatttaacttctcaatattttcagtgaattgacttagaggagttaatgatgttaagaattttatggtatacatttttgaaaaataaattttattgtgtatatttgaggcttacaacataatgttacagagtacattttttgaagacaccttgtgttcaaagcaagttcatattgcatcttcagatctaaacatgaatataacttaaaatatttaaatattctttgacttttgaaaaaatatttataaaagaagccatttgattttttttctttttcttttctttttttctttttttttttttttgagacagagagttgctctgtcgcccaggctggagcgcagatcttagctcactgcaacctctgccttgcggattcaagcaattctctgcctcatcctcctgagtagtgggaattacaggtgctcaccaccaggcctggctaatttttttgtatttttagtagacacggagtttcaccatcttggccaggctggtcttgaactcctgaccttgtgatccacccgcctcagcctcccaaactgctgggattgtaggtgtgagccactgcgcctggctgcaatttgaattttatcattttgattaaaaataaacctacagaagtgtactgtatagaaagaccttttaagttccaacaatttttaaatgcttttaatgttattgccagggctgtgtgcgttagtgatgtgacatttactcttttttttttttttttttttttgagatggagtttcgcttttgttgcccaggctggagtgcaatagcgccatctcggctcactgcaacctccacctcccaggttcaagcgattctcctgcgtcagcctcctgagtagctgggattacaggcatgtgccaccacgcccggctaattttgtatttttagtagagatagggtttctccgtgttggtcaggccagtcgacacttcactctttaaagtatttcagtatgagccaaagtagtaaatgactacactgcatttattgcagtagacaaaccttgctgagccaaggaaatgtgaaaagtaggagtaataatggctttagtatagaccctagtagaacaagagactaattttaccttgaataagatgtgcatttagcttaactatggcttaatagcaactgagatgccataatttccttataatttatagattttaatctaagatttttcagagaacttgacttcctaatagttgtactgtcataattaggaagtgactcacattgatatttttgagaagtttacatgaatgtagtggtctgtgtaagacttggtgacatgctttaattattcagtggcttcacttttgagtaaatcttatgagcccttcaggtttgaaaatcactggaaagcttacagttgagactgatcatgtttttgtgaaaaaatatcaagccccagttaaggaaaaaatgaagtgtattttgtaagtaagaaaagccattatcattttaactatagaactaacttaaaattttagagtctgccccaaattctccaagaattggaagcccattgagcccaaagaaaaacagtgaaacaagtattcttcaagcaatgtctagaggtttgtctaccagtttgcctgacttggactcagaaccttggatagaagttaaaaaaagacatcagccagccccagtgaaattgagggtaagttgttacagactgagtgaagtgtgacataccctgggtggagtataaggtcagtgcactttatgtttgttaggtacatatgtaaaatttggaaaagtttagcacaattttaactttgtaattgttggccttcagtagacacttatgggttattctatgaggaaaataagttgtatcaatttttaaaatgttatttatttttttttttttgagatggagtcttgccctattgcccaggctggagtgcagtggcgcgatcttggctcactgccacctctgcctcccaggttcaagcgattctcctgccctggcctcctgagtagctgggattataggcgcgagccaccatgcccagctaatttttgtatttgtagtagagacggggtttcaccatgttggtcaggctggtcttgaactcctgacctcatgatccgcccgcctcgtcctcccaaagtgctgggattagaggcatgagccactgcacccggccttaaagtatattttttatttctgaacatgatttaagaattttggaggctgggcacagtggctcattcctgtaatcacaacacttcgggaggccaaggcaggaagattgcttgagcgcaggagttcggggccccctgggcaacatagggtgaccctgtctctacaaataattcataaagttagctaatgctaattttttggtggaatgtgcctgtggtctcagctactcaggaggctgagacaggaggaacacttgagctcaggaggtcaagactgcagtgagccatgatcacaccactgcactccagggagggtgacaaagtgagaccctgtctcaaaaaaaagaattttgtcttggtttttctacttgtgactaattttaacttgaataatatttcagttttttatgaagttgaaaaaatatgacttttattttttgagacagagtctcgctctgtcgcccaggctggggtgctgttgctgccatgttggctcactgcagcctttgcctgctgggttcgagagagtcttgtgcctcagccacctgacttactgggattacagggtcactccaccatgcccaactatttttttgtgtgtttctggtagagacgggattacaccatattgtccaggctggtctcaaactcctgtcctcaaataatttggctgccttggcctcccagagtgctaggattacaggcgtgagcctctgcggcctggccagaaaatgtataaattttgaagttacactcatgttaattatttataaggtttatataagtgttggtgatttatatatctggtttatatatgttttggtgatttaatgtgcaaaaggaaaagaaaattgaatttttggtggagggtacataagagagtgagatggttatatttataaaaagagaaataggagatccttgtggtggtactgctctgcatttttcactggtggtagatacacgaacttacatatgtgataggattgctttgatctaaatcacaaatgagtgcaagtaaaactggggaagtataagctaagattgatttatatcaaagtcaataccttgtttgggatgttgtagtatatttttgtgagatgttaacattgggggaaaccaggatatatgagatctctattatttcttacaactgtatctgaatgtataattatttcaaagtaaaagttcactaaaaataaacttggggagaatgccactcaaaagattcaaatattgaaagtaagctctctaaaggggatggaaggtattgagaggattgtgatgtggaggaccagcaaattggttctggtagctggttttaaaagtataaggagaactgtgtagttttatggccaaacaatgccagtatatctgaaatgtatggtattctgatgctacagactgaggatctggcctggaggaaacatggctttaggttctgggggcctagatatttcagagataactgttgaggtagctcagttattgacattatttttaatatacttttaaaaaagtgatcttttaaaaacattctagagtgggtatacagatctttgttgggcatcatttttctttggaattctaaaagcatttttcttttgtcatcttggtttcttttgtcatcttatgaaagtcagtccattcacattctttttatcaagtgatttttttttcctcttgagttttttttttttttgagtcttgctgtgtcgcccaggctagagtgcagtggcgcagtcttggctcactgcaacctctgccttctgggttcaagcaattctcctgtctcagcctaccgagcagctgggactataggtgtgtgctatcatgcccagctaattttttgtatttttaatggagatggagttttaccatgttagccaggatctcctgacctcctgatccgcctgccttagcctcccaaagtgctgggattatagggatgagctgccatgcccggcctgagatttttttttttttttgagacagagtcttgctcttgttgcccaggctgcagtggagtgcaatggtgtgatcttagctcactgcaaccttcacctcctgggttcaagagattctcctgcctcagattcgtgagtagctgggattacaggcacctgctactacacccggctaatttttgcatttatctatttatttttttcagacagaatctcactcttttgcccaagctggagtacagtggcgtgatctcggctctgtacaactttcccctcccgggttcaagcgattctcctgcctcagcctccagagtagatgggattaaaggcacaggccaccacacccagctaatttttatgtttttagtagacggggtttcaccatgttggccaggctgttctcgaactcctgacctcaggtgatccacccgcctcggcctcccaaagtgctgggattacaggtgtggcccactgcacctggcctaatttttgtatatttagtagagacgtggtttcactatgttggccaggctgttctcgaactcctgacctcaggtgaaccgctggcctcggcctcccaaagtgttgggattacaggtgtgaaccaccacacctggccttgcttgagatttttaagatcatttcttcatccccagctcttgaaatttcaagatgatgtgctttggtgtaggtctaattttaaacagaaaatctttttttttttttttttttggcagagggtttcactccctttgcctagactggtgtgcagtggcgcgatctctgctcactgcagcctctgcctcctgggctcaagcgattcccctgcttcagcctcccaagtagctgggactacaggcacaaaccaacaggcccggctaattttttttttttttttttttttttgtagagacagggtttctccttgctgcccaggctagtcttgaactcctgggctctagtgatccacccacctcgatctttcaaagtgttgggattacaggcatgagccaccttgcccagtcaggtctattttttttttttttttttgagatggagtcttgccctgtcactaggctggagtgcagtggcgcgatctcggctccctgcaaccttcacctcccgggttcatgccattctcctgcctcagcctcccaagtagctgggactacaggcgcttgccaccacgcccagctaatttttttttttgtatttttagtagagacggggtttcatcgtgttagccaggatggtcttgatctccttacctcgtgatccgcccgcctcagcctcccaaagtgctgggattacaggcgtgagtcaccgcgccctgctctgtctggtctatttttatgcattgtgctgagtattcatgtccttcatttgggagaaactaatgtttctcttatttccactttctggtatctgttttcatctgatgttggacctccttgatagatcatctaaatactgggccttgggtgtttaaaaaaagttctcttctgatattttcattatttccatcattgttttggttgctttttgaatgctttcttaatatctggcgatttttggttgatagttcatattaatattagtaaatatgcatggttttcttgtttgatctaatctgctcatctagtgggctgttttgtttaatgtgaggtatgattccacagtctttttttttttttgagacagagtttcgctcttgttgcccaggctggagtgcaatggcagtgtgatctcggctcactgtaacctccgcctcccaggttcaagcaattcttctgcctcagcctcccgagtagctgggattacaggcacccgccgccatgcccagctaatttttttgtgtatttttaatagagatggggtttcaccatgttggccaggctggtctcgaactcctgacctcaggtgatccacctgcctcggcctcccaaagtgctgggattacaggcgtgagccactgtgcccagctgattgcacgttcttggtaagtgaaaacgtcctatggacttggacacctaggcagagaatagggatgctggctctttttctccaaaattgctaaaacaaaaaaagcagtacttttctctgggatgtagaatttcttagtgtatctcattcattggtgaaattaccttttcttttcctccccccagctctattttagaggttcagaataatgctaggatgtgttcaacttctgttcagccccagtacacaaaacatgagccctctcttgtcaaatcttattttgtttagaaagtaattcttgggcttttagttgggagcgatctttatatagttttatattctgagataaagggattggattgactgttccagctgtgttctatagttggttttccaaatacctattttgattgccatccaatagtccattcctactccttgtaactgccatctcaaaactttctagaaccctggcgggatcaatggcttttgcttcccctttaacctttgtatcagttctaggttgctgttttctctgcttttgtttattatcaatacaatcccatttattttctgctttcccgaaagtcataaaagtctttgatcttctgatagtaatacttgttttcagtattgatgtggatttattgtttttattctttgcactgtgtattattactgcaaataagcatgcaaacttaagtcatcttcaacccctaatctcttaataatggtcttttcctcagaaattacaaaaacaaatttaacagtttgtttattctcttagacttttatcatgtacctgcaaatgtgaaaagcaatgtatattgtttaaaatatatcatcagtattttaaaaaatatatattcacagtgttttacaacttgtctttttttagtaaaaacatcttgggtagtcttctgtttactagaatgtgagctccatcagggcatagttgttgttaaatttattgctgtctgtccctgcctagaacagtgcctggctcagaggaagcactcagatagttatcgactaaatgaatatggatctacattattgggaattttgaaagggaggaattgtttttttcctagacataggaagttagcatgaactgaagggtaaaataggccagaggacgaaaaatgaatgtaacaccaagtagaaactacttccttctgttgggagttttaaactagtttacatgttataagatctaggatctaaaagcttagacttttaatgtaaaccaacaactgttttaagttcttttttttttttttgagatggggtctcgctctgtcacccaggctggagtacagtggcacaatctcagctcactgcagcctccgcctccagggttcaagcctccgcctccagggttcaagcgattctcctgtctcagcctcccgagtagctaggactacaggtgtgtgccactatacctgggtaatttttgcatttttagtagagatggggtctcaccatgttggccaggcaggtcttgaactcctggcctcaggtgatctgcccatcttggcctcccaaagtgttgggattacagatgtgagccactgcacctggcctagctgttttaagttctatagaaggggtagacaattttttttttttttttttttttcttcagacagagtctcgctctgtctcccaggctggagtccagtggcgtgatctcggctcactgcaacctctggctcccaggttcaagcaattctcctgcctcagcctcccgagtagctgggactacaggtgcgtgccaccacgcctggctaatttttgtatttttagtagagacggggtttcaccatgttggccaggctggtcttgaactcctgaccttgtgatccacccgcctcagcgtcccaaagtgctgggattataggtgtgagccactgcacctggcctgaggggtagacattttaacatttgctgaatattagcatgaatttgacatgaaaactgggccatgtagaatggggatgaggatagagtagagggattagctcagaaactatgttattatcattgtgaggtaaaaaggttcggaatagggaagaccattgactctgaaaatcagaagaccttgattctatctatctgtctatctatctatctatctatttattttttgagacagagtttcgctcttgtcgcccaggctctagcgcaatggcgcgatcttggctcactgcaacctccctgcctcccaggttcaaacgattctcctgcctcagcctcccgagtagctgggaatacagcaatccacaaccagataattggttctgtttataattatgaaatcataggcaaatactttcatatctctaggcctttgttttaatcagtaaaatgaatcagtgcaatgtaatggatgattaagactattccaactctaaaagagtctttaatgtaatcctttctttattcaactttgtgtttttctttagtcttaaatttactgggccaaaataatactcacttgattttcttttacagtttggctgttaaactagcaattgagcataaaagcttgatattacttacttgtaacactgttttatgacatttaatttaaaaatgatagaaagttttttatataaattaccaatttcttccttcaggaatcagtgtctgtccctgaagggtcattaaatcagctatgttcttcagaagaaccagaacaagaagaacttgattttttgtttgatgaagagattgaacaaataggacgaaaaaacacatttactgattggtctgataatgattcagattatgaaattgatgaccaagacttaaacaagattttgattgtaactcagacaccaccttatgtgaaaaaacatcctggaggagatcgaacaggcacccacatgtctcgggcaaaaatcacatctgaacttgctaaagttatcaatgatggcttatactattatgaacaggatctatggatggaagaagatgaaaacaaacacacagccataaaggtaattgtttctggccaacatctttctactgatgctttgttttgattgtatgttgctgtttatattttctcaaacttgaggctctattttatgaaatgttgaatataaatacattgtatttaacttgaaaaattcctggaaatatacctgataattaccacctgaggaatcgttttattttatgaaagtaacagcgtgatgaatactgtaattacaaaagaaaattagtactcactgacttatacccttgtttttttttttttttgttttgtttttttttgtttttgttttaggtgacaatactgagaacgccctttctcgtatgaaagaataaaaacaagttactgtggacaggcttaatttatatgctcattgcttacctggctctcaccgcagctgtatgagccagtggctttagagagcactcttcttgcctctttctgttttccccacttagtctatggtgcatgatctaaggtagtggaaatggttgtggacaaactataaatgactaaactggatgattatctctcttggtctagtcattactgtggtgctagggttactttttacaatcttgttctaattttttttaacttcttgcatttcatcccagatcctggttcctatcctagttattaaggtaaaatagagaaccagaatagtttatcaggtatctgcattccttcaatatgaattataatggtacagatatggggataaaaggaatctttttctgctattaagtttatcagaaaagccccaatagttaaatatttgttttcagtagagggtataataagggaaaattatataacattatatgccaaataggaaactgatcttggttggaaataaagttgtaggaagaaaagctagccaattagtggctgagtagaggggactgcctgtcggtggggcttcatatcatcaacaagaagtgtgctagccttcttggctcctcatttcttttcttcctggaatccccagtactgcttttagccttctgtaaccactgccttcttggaggacctgcctcaggctatgatagcttgttacgtgacttagagccttagcagttctctgcctgtcctactgctgtgggaaaggaagtgtgtttttataatgcttctcagttgaaagtctttcctagtgtaagcattgctattttatttgtaatacttaggttcggtaagtaatacctatcttaaatccttttagaacagagatactagtacattctactaataatcagttaaaattatccttcccccattctctatccctttacccagctttgtttttcaccatagcatatatcattatctataattctatatattttacttacttttattctcttggagaaaaaactatggatgtaataccaatgacaataggatttttttctatttgttcattactattgtatttctagtgttagaatagtttctggcacaaagaaatgttcaattcatgtttgtgggtaaataaattatggagtaaacattatgcattaaccaaaggaacccaaccattgtgtataatatttgttctgtgggaaatgttttcagtctgccaagtaacaaatttgtaagccaacttgagaaacatcctatttgtaggtgattatttccttaaattatagacaataattaaaagccatgtattgagttcttgaggcatgtgctgatcttattcattaaatattaacggaaagtaatcttggcttatataactttaaccattataattgcagatatgtcttactttgacctgattcttatgtacattcccatcatttaactcatcccctttggttctgattctgtcttctacatgtagtatctcattagacttgtacttttcctgtgggtctgcttaaagggagagaaatcagtcatttaacatatactcattgagtgcttactatgtgccagacactgcttagaaactgggcacagagtgagaaggtaacaaatagggtttctacatgcctagaacctacagctaactgggggaacagacttaaaaataaacccacaataagtacttaatcacaaattacaataaatactctaaaagaaaaaaacaggatgctatttcattgagtagtcagggaaggcctctgagaaagtcagtaatagtgaaatctgaagtggaagtaggacataaccaagcaaagagtagggaaacagtattccaggaaaagggaacagtaaatgtcaaggatctggcagaaaagattttggtgtatttgaggaactggaaaaaaggtcagtttgcctacggtattatataaaatgttaattatagatgaataggcaggagtcatcatttatgcgccatgttaaataatgtggagtttatctaaagttcaaatccagtaccttaggttttgcaaaggcagtgtgacatctaatttttatttttaatagatcactctggttgttttggcacagaatggattgtacagggacaagagtgggcagaagaaatccagttaacaggctgtccatatagaagatgaattggtcggccaagacaaacaggtggcagaggaaatatagaagtgagaagacctgtctcatctgagccttgaggaatgattatataggagttgtataggaaagtgtgttgttgtggaagtcaaaagctggctctaagagaagaaaataatcaggtgtgtcagcaactttacaggttgaattagataggaatgaaaagtatgccaaattgatagggcagtttagtactcatttttgacctctgcaaaaagagttttggtggatccagaagctatgttgaactggaccaaagagtgagtaaaggctttattctgtttttggcatatatttactgctgaagactactaaaatgataggcttataggtaagaaaatatctgcttaaaatctttgaagatatgctaggtaagttattatcaggataaaactatacagaagtgaagtactgaaacttagttttacccttaggaccctttgtagaagctacccaaaacgggtaaaaaccataaactcagggaccattcaaaactgtggattcccataggattccttttcccatttaattggtacccaaaagtgcaccaagatctcacagatcactactaaataacttactcgtgtaaccaaataccacctgttccccaaaaatctatgggagaaaaaagataccccaaaagaatacacttacagtggaagaactaaacttgcttcctacctgctccccaagggactctgtaaagaatatttttctggctggcgcagtggctcacgcctgtaatcccagcacttcgggaggccgatgtgggtggatcacgaggtcaagagattgagaccatctggccaacatgatgaaaccccatctctactaaaaatacaaaaattagctggacatggtggcgcgtgcctgtagtcccagctactcgggaggctgaaggcaggagaatcacttgaacccgggaggtggaggttgcagtgagtggagatcacgtcaatgcattccagccttgtgacagaacaagactctaactcaaaaaacaaaaaacaaaaacaaaaacaaaacagaatgtttttctggttgtgctgagcagaatagagaggaaaaaattgggctagaagttgtattcatgcaacccaagttcatactctgggtgactaaaggaagcactagttgtaaatttgatgtgattgtggtctcttagtttcccagacacctagcatatgaaaataaagattttttgtgtatgaaaatattcacctttatcttagacctcctttattcacattatattgcaaggaaagttagcagcacataaagtgaataatctaacaagaaagtgagatctcgcatgtgagaatgagcaaaagtaacaggcagcagaaacataccttaaaataatcttttttttttttttttttttttttttgagatggagtctctctccgtcacccaggctggagtgcagtggcaccatctcagctcactgcaacctccgcctcccaggttcaagtgattctcctgcctcagcctccaaagtagctgggattacaggcgtgtgccatcacacctggctaattttttatgttttttgtagagatggggtttcaccacgttggccaggctggtctcgaactcctgacctcaagtgatctgcttacctcggcttccgaaagtgctgggattacaggcgtgagccaccatgcctggccccttaaaataatttagatagtcagattattaaacaaaatatgcagtagctaggcttactgtgtttaaggaaataaaaatatgtgtagagaagaagaaatcctaaagaataacgatagaactggaagtaaaaacaattatgattaaaattaagaaccaaatcaattgaagggattagcaacagattagacagaattagagaattagtcaattggaagactgttcccaagaatttattcagaaatttccacagagtagcaaagaaatagaatatatgaaaagaggatacagaatgattttctacagtctttgctattggttggtaagttttaatcaagttttgtaatttaacatctagtagattttattataaagctttttatttgtttttgttttttttttaaaaaaaggtaagcaagaaacttggaatataggataacggagaaggtctaaaatatacatttagtcagagttccagaatgaaagggtagagagaatggggccaagtcattattataagaggcaattaggacctctacagaactgaggagaggtgtcagagtttagccagaaaaaaaagagattactttcaagaaagaagaatcattagacagctgatagctagtttcccaacagtgacaaccaatagacattggaatgatagctttaatttgccaagggaaaataactatcaactgataattgtaggccttgcaaaaatatctttcagtaagagtgtagaatatgagaaatggccaccagcagagtctcatgaaagaaagtcccaaagggtagaataaaagtgattttacctatcagagacacagaaaggactgcagagcaaaacaagtaataaatacatgaataaacctaagtgaatattaactgtataaagcaattattatgtcttatagatttactataacaacacaaactgggagagagagcagtaaatgaatctaatatttaaatgtaacttcatatctggacaaagggtactgattaaagttattaaagtttgcaaattgcagtttgaaggatacacatttaattgacaaggtgatctaagttcatttggaaatttcaggaatccatagtagtcaaaacactcttaaaaaataacaaaattacggccgggcacggtggctcacgcctgtaatcccagcacttcgggaggccgaggtgggtgtattacctgaggtcaggagttggagaccagcctgaccaacatggtgaaaccctgtctctactaaaaatacaaaattagccgggcatggtggtgtgtgcctataatcccagctacttgggaggctgaggcaggggaattgcttgaaccccgggaggtggaggttgcagtgagccgaaattgcgccattgcaatccatcctgggcaacaagcgtgaaaactcgcaaaacaaacaaaaaacaaaattgaaggactcatattttatgatttcaaaacttactacaaagctgcagtaatcaagatagtggtgctgtcataaggatgaacatatagatcaatggaataaaattcagagcccagaaataaacatgtctattttcaactgactttgcaacaaatgtgcctagaccattcagtatggaaagaatagttgtttcaacaactgggactctgtcaacttgatatctacaaacaaaagaaggaagttgggtccctccctatcttacatcatgtatcaaaattaacttgagttaaattcataaatttaagaggaaaaagtataaaactcttagaataaaatgtgtaaaatcttcatgaccttggatttgatggtggtttttcatatgacactaatagcacaagcaacaaacaataaaaacaggtaaattggacatcaaaatttaaaaattttgaatctcaaaggacactatacagaaagtgaaaagccagtacagatgttcctcaaattatgttggggttacatgcttataaactcatcataaattgaaaatacactgttaaactgaaatgtatttagtacacccaacctaccacacatcatagcttagcctagcctaccttaaacatgctcagagcacttatgttagccttagttgggcaaaatcatttaaacacaaggcatattttataataaagtattaatagcttatataatgtattaattattatactgaaagtaaaaaacagaatggctcactgctgctgccctgcattgcaagaaaatataccacgtattgctggcctgggagaatttaaaaatttgaagtacagtttcttctagtaagtgcctcttgctttcacaacattgtaaaggcaaaaccataagtcaaactatcataagcctggggctgtttgtacaaaaaaacacaatacaatttacattggcacccaaatacatgaaatagtttataaatctgacaaaatatgtacaggatctatctgaggattactacaaaaccctgatgaaagaaaaaggggctgggcgcagtggctcacgcctgtaatcccagcactttgggaggacgaggtgggcagatcacgaggtcaggagatcgagaccaccctggctaacatggtgaaaccgcgtctctattaaaaatacaaaaaaattagccaggcgtgatggtgggcgcctgtagtcccagctactcaggaggttgaggcaggagaatggcgtgaacccgggaggcggagcttgcagtgagccaagatcgcgccactgctctccatcctgggcgacagagcgagactctgtctcaaaaaaaaaaaaaaaaaaaaaaaaaaaaaaaaaaaaaaaattcagccgtgcgtggtggcgcgtgcctgtagtcccagctactggagaggctgagacaggagaacagattgaacccggaaggcggagggtgcagtgagccgaggtcacacactgcagcctgggcgacagagcaagactccgtctcaaaaaaaaaaaaaaaaggaataagtaaataaatcgagaaacattccttgttcatattatagataggaagactcaataatgtcatgtcagttctttccaacataaccatagattctgtgcagtttatggtcttgttaaattgagatgcatttagtatacccaatcaaaatcccagcaaatgattttgtggatatctccagaggcaaaaaacacctaaaaaacccagaatagctaatacaacattgaaaattggaagacgacactacctgacttcaagatttactgtaaagctgcagtaatgaaggcagtacggtactggtgaaagaatagacaactaaatcaatagaacagaatggaaagtgcagaaatagacccacacagatgcagtcaactgatgcttgacaaagaagcaaaggcaatacaatagagaaaagtcttttccacaaatggtgctagaacagctgagcattgaggtgaaaaaaaaaaaatgaatcttcacccttcagaaaaattaaagtggacggaccatcgtccaaaatgtaaaagacaaaaccataaacgtcctagaagatgatctaagagaaaatctagatgaccttgggcttatcatgactttttagattcaataccaaaacaatccatgaaagaaataataagctagaattctttaaaattcagaacttctgcccagtgaaagatactgtcaagagaatgaggaaggccaggtgcagtgagtggctcatgcctataatctcagtactttgggaggctgaagtgggaggattgcttgagaccacgagtttgagaccagcctgggcaacatagtgagactgtctctacgaaaaatttttttaaaaaaggagagaagccattgactgctagaaaatatttacaaatgacaaatttgatagagggctattatccaaaatatacaaagaactattaagactaagaaaacagaacccaatttaaaaatggttcactaaaaaatggtcgatagaccagtttattgaagaaaaaaagaaaaaacttgaaagacctgagctgacacttcaccaaagaagataaacagcaaatatgcatatgaaaagatgctcaacatcaaatatcattagggagctgcaagtaaaaacaacaatgagatactactgtagattcattaggagtgccaaaatccaaaacaataaccaaatgcttgcaaggatgtggagcattaggaaatctcattcattcctggtggcaatgcaaaacagtacagcttctttggaaggtagtttgacaatttcgtataaaactgaactaaactaaactcttaccaaaggatctagcaaatttactcaaatgagttgagatgtgtagccacacaataacctgaacgtggatgtttatagcagcttatccataaattgtcaaaacttggaaaaacccaaggtgtctttgaataggtggatggataaacaagctgtggtacattcagacaatggacttactcagagctcaaaaatgcatgagctatcaagctgtgaaaagacatggattcatacaaagactgagtttatattgggtgaaaaaagcctatttgaaaagactacatactgtatgattccaactacgtggcattctggaaagggcaaaactatagtaacagtaaaaagatcagtgattgccaatggttggaaggggaagagatgaatggacagagcacaggttttttagggcagtgacagtattttctatgatgttctgatgacgatacatgtcattgtacacttctcaaaacccatagaaaatgtacaggacaattttgataatactgtcagtgttttcatctattgtaactaatgtatcactctagtgcaggatgatagtgtgggaggttgtatgtgtttgggtgcagagggtctatggtatactctgtactttctgcttggttttgctgtgaacctaaaacttctaaaaatacctaaagaaagataacaggttaggagaaaatatttgcaaatcaaaggagggaggggcaaagagcttattttcttctaaaaatttttctttaaaaaaagtttttaccagtctgtgtgtgttgaaaaatatttgtaatatgcaaagagctcttacaaatcaataagacaaataacctaattttaaaatgggtaaacaagagttcaaggccagcctgggcaacttagtgagaccctgtctctaaaaaacgtaaagatataaactaggcaggtgtggtggtgtgtgtctgtattcccagctactccagaggttgaggcaggaggattgtgtgagcccaggagtttgaggttacagtgagctgtgattgtgccactgcactccagcctgagcaatcaagcaagtccctgtctctaaaaaataatacataaattaaaatgggcagagaatttgagtagacatttcttcaaagaagatatacatggggccaataagcacttgaaaagttgcttaacatcattagccaccaggggaattgaaataaaatcgttgttataccatgttatacccaaaaggataactataataaagaagacagatatactgacaagtgtgaggaaagggagaaattggaacccttatactctgctgctgggaatgtaaaatggtgcatctgctttggaatacagtctggcagttttcaaaaggctaaacatagggttaccatgtaacctagcaattccacttttatgtatgtaatccaaagaaacaaagacatttgtccacacagatgtcatgttcttgtacatgaatgttcatttcagcatttcaaaaaatgaacagaactcagatttttattaactgatgtttggatgaatgtggtatatccatacaatagagtatttggcaatcaaaagaaatgaagtactatttgtttttgattattattattgtgttttgagacagagtcttactctgtcgccctggctggagtgcagtggcgcgatcttggctcactgcaacctctgtctctcgggttcaagtgattctcctgcctcagcctcccaagtagctgggattacaggcacgccccaccacgcttggctaatttttgtattttttggtagagacggaatttcaccatgttggccaggctggtctcaaactcctgacctcaagtgatctgcctgcatcagtctccaaaagtgctgagattacaggggtgagccactgtgcccggccaatttttaaatttttattttttgtcttaagatcttttttctctaacctgcttcagagaaagagaaatgaaggactaatacttcataatgaagcattatgaagacagtatgtgaaaggagccatcataaaagactacatattgtagagcagcggtccccaacctttttgataccagagactaattttatggaagacagtttttctgtggactggggggcatggttttggaataatttaagcacattacatttattgtgcactttatttctgttattcattataatatataatgaaataattgtgcaatttatcataatgtagaatcagcaggagccctaagcttgtttttctgcaactagatggtcccatctgggggtgatgggagacaatgacagatcatcaagcattagattctcatgaggatcatgcaacctagattcctcgcatttgcagttcacaatagggttcatgctcctatgagaatctaatgctgccactgatctggcagacggtggagctcaggcagtaatgagagcgatagggagcagctgtaaatacagatgaagctttgctcacttgcccacccaccactcaaccgtggttcctaacaggctacagaccagtactggtgagtggctaggaggaaatgtggagtgactgttaatggttaccaggtttcttttggaggtgataaaaatgttctatagttgattgtggtaatggttgtgaaactctgaatatatgaaaaacaattgaattgtatacttcagtgaattgtactacatgtgaattacacattaataaagctgttatgaacaacaaataaatggaaagtcatctcatgttcatggatgacttaatattattaacatgtcagtactatccaaagtatctacagcttcagtgcaatgcctatgaaaatcccaatggcattttttgcacagttagaaaaagccacccaaaaaattcacgtggaatctcatggggccttgaatagtcaaaacattattattgaaaaagaagaaatttggaagcttcagacttcctgcttgttacagtaatcaaaaccttgtggtactgtcataaagacagacatacggaccaattgaatagacagtccagaaataaacccttaagtatatggttaaatgatttttttttcttttttgagacagagtttcgctcttgttgcccaggctagagtgcagtggtgcgatctcagctcactgcaacctccgcctcccaggttcaagtgattctcctgcctcagcctctcgagtagctgggactacaggcctgcaccaccatgcccgaccattgtttgtatttttagtagaaagggggtttcaccatgttgaccaggctggtcttgaactcctgacctgaagtgatccacctgtctcagcctcccaaagtgctgggattacaggcgtgggccactgtgcccagcccaatttttttttttttttttttaagacagtttctcactcttttgcccagtctggagtatggtggcatcatcatggctcactgcagtcttgacctcctgggctcatgcaatcctctcacctcagcctccagagtagttgggactacaggctcacactgccacacctgggtaattaatgaattttttttgtgtgtgtggaggcagggtcttgttatacctggtttcaaactcctggccttaagcaatccttccatcttggccttgcaaagtattgggattacaggtgtgagctactgaagctggctgggtaaatgatttttttgacaagtgtatcaagaccactcaatggagaaaggataatctcttcaacaaatgatattgggaaaattgggtatccacatgtaaaagaaggaagttagatctttaccttataccataaatgaagattaattaacctagattaaagacttaaacatattacataaaattatagaacatttagaagaaagcctttggggaaggccttcatgatcttggatttggcagtggtttcttggatatcacactaaaatcacatgttacagaacaaatgtagacaaatggaattcttgaaaattaaaaatttatgtgtatgaaaggacacagttaacagtaggcaacctatggaatgcagaaaaatatttgcaaattatatatctgataagggattagtatcctgagtatataaagaactcctacaaatcaacaaaaaatataacctgattttaaaaatggacagaagacttgtgtagatagttctctaaaggtgatatgaaaatggctaataaggctgggcgcaatggctcatgcctgtaatcccagcactttaggaggctgaggtgggtcaatcacttgaggtcaggagtttaagaccagcctggccaacatggcgaaactccatctctactaaaaatacaaaaaattagggttggtggtgcatgcctgtaatcccagccattcaggaggctgaggcaggggaatcgcttgaaccccggaggtgggggttgtggtgagctgagatcgcaccactgcactctagcctgggtgactgagacttcatctcaaaataaataaataaataaataaataaataaataaataaataaataaaaaggataacaaacatttgaaaagatgctcgaagtcactactcagaatagaaatgcaaataaaaaaatcagaggattatcacctcacactgattaggatggttaccatttaaaaaaacacacagaaaatagttgttaacaaggatttggagaaattagacccttgcgaactctcatgtgaatgtaaaatggtgcagcccttatggaatacaggatggcagtttctcaaaaaattaaggatagaaatatcatgttatccagcaataccaattctaggcatatatccaaaaaaatgaaggcaggatctctaagaggtatttgcgtgtccatgttcagagcagcattattcacaataacccaagaggtgggagtaagccaaatgtctttcagtggaggaatggataaacaaaatgtagtatatacataacaatggagtattattccaccttagaaaggatggaaatattgctgcaacacggatgaaccttgaggactttatgctaagggaaatattcagtcacaaaaagactcagtcgaagtatgtttccacttataggagatagctaactaaagtggtgaagtttatagaaacaaagtaagaaggtagttgccaggagctgaagggaggagagaaactgggaaagtgttgcttaatgggtatagggttttatttttgctagatgaaagttttggagatctattgcacagcagtgtgaatatatttaacactactgaattgcacactttaaaatggttaagatcgtaaattttgtgatgtgttttttaacattattaaaaattattttaaaaatccaactacataccaaattaaaaaaaaaataaccaaaagaaaacttaatacacataggccaggtgcggtggctcagacctgtaatcccaccactttcggaggccaaggtgggcagatcacctgaggtcaggagttcgagaccagcctggccaacatggcaaaaccccatctcttctaaaaatacaaaaattagctgggtgtggtggtgcacgcctgtaatcccagctacttgggaggctgaggtaggagaattgcttgagcccaggaagtggaggtggcagtgagctgagattgcgccatcgtacttcagtctgggagacagagctagactccatcttaaaaaacaaataacagtctcaagaaaaacaaaaaaacaaaaaaacaaaacaaaaaacaaaaaacaaaacttacatattagtagcagatggaagacttacaaagttgacttagagataaaaagcattactagtgtgaaagtgtcatataatgataaaaagtgaagtttatcagaggagataacttcaaattcaatgtatttaatattaaagcttcaaatatatgaaacaaaagttggtaaaacaaatccactgttgtaatttactctctaagtgatttactctctaagtaaacaaggcataatcagacaataaaaagtaatttcagaaacgttttgcctaagaattgcagagcattgttcttttttagtatatacatggtacttagacctccactggtatataaagtgaattccaaggcatttatattacacaaagcacattattagtggaattaaactggtgattttatttgttaatttttaaatatttttgtagagatgaggtctcactatgttgcctggctggtcttgaactcctggcctcaagagattctatggccttgccctcccaaagtgttgggattataggcatgccacactgcacctggtcaagctagtgattaataataataatataagtgaacgtaataaattcccatattccccaaaacaatgatatgtttttaaattaaacaactcagcattcaaagaagaaattaatggaaattagaaaatatgaattgaatggtaactaaagttaaaaagtgcagctaaggcaataggcttaaatgcaaatattaggaaaaacacttgaaattaatagtccaattaccaatattatcttgactttaattaaaaaaactcccccgacaggttgcagtgagcagagattgtgccactgcacttcaacctgggcgacagagcaagagtccatctcaaaaaaaaacaaaaaacaaaaactcccccaattctcaaagacagagcaaaagcatctcattcatgttacctgatattggctgtgggtcagctattacagctctgtatatttggttcttctccaattgtcttctcatttggggattaattccaaaacagcagttcctatacattacatgcttattcatgtggcagaggggaagaacaagaggcagagccaaatcttagttatatttgatgttgctgcttatatgtgctttatgtgcattttttatattccattgactatatggccaagcctatataggctggggaatatatattttttccttccatttggtatttattttttagtgatacataataattgtatatatttatgggatacatgtgatattttgatacatgcatacaatgtgtaatgatcaaattagggtaatttatatatctatcacctcaaacatttatcatttctttgtatttgaatggggaatatatatatacatacacacattatatatatacagaaacgtgtgtgtatacatatatatatatatatatatattttttttttaggggggttggtgacagagttttgctttgtctcccaggatggagttcagtggcatggatctcagctcactgcaaccaccgcctcctgggctcaagcagtgcttcagcctcctgagtagctgggactacaggcatgcaccaccaaacctggctaattttggaatatatattcttaaaaggcaggtgacagtgttgaatatgcataatcttctcttctggggaatatgaggattgaacaacataacagaatctgttatagcattgatctcaagaagttaggaaaagaattagcaatataaactcccataaaaaatatggaaggaaataaatagcagaatttaattaattatatctaacgcacaatagaggattaatcatatcaggacttaatttttcaaaaaggctagaattaagcttatcataacaaaaaaagaaaatagatattttacatggaatgcaagaggggatatagttactaaccatacagaaattttaaaatgtaattttagagcaataaatttgaacttttttataaagacagatttctagaaaagtatataacttcaaaatggagtggaaaagaaagtctagatagtgctatgacaatttaaaaatcttcaaactctataataacttcaaatatagatattttattaacatatctttttatgattggaatgaataatttcaggaatgcacaaatatttccagagaatagagctaataataagtcaaatatttgtggaaagggtagtggtgggggagaacacttatgagaagaacatatctttggtacctgagctgtacataagaaattagaattcatgagaacgtgaatgagagtcaggcattacctaggtataaaaaggctaaacagctgggcatggtggctcatgcctgtaatcccaaccttttgtgaggccaagccaggtggattacctgaggtcaggagttcaagaccagcctggccaccgtggtgaaatcctatctctactaaaaatacaaaattagccaggcatggtggtaggcacctgtagtccgagctacttgggaggctgaggcatgagaatcgcttgaacctgggaggcagttgcattgagccgagatcatgccacttcactccagcccgggtgacagagtgagactctcaaaaaataataataataatttaaaaaggtctaaacaatattttagtaaaccaaatatagcagttttttaaaaaacagataaccaagttgtgttcatttcaagatcatggattaattgtacataagaaaagttagtaaaggaaattcacattaacggattgaagaaagattgtgatcacttgaataaaaaagaaaaaaatagaagaaaataaagaaaaatatttgaggtgattgatatccccattaccctgatgtgatcattacacattgtatacaggtatcaaaatggcacatgtaccccagaagtatgtacaactaatatacatatatcagtttttttaagaagcataaaaagtccccaaaccagtaacagtctaggcattaaagaatatctgtaagtcaggcatagtgctgtgcacctgtagtcccagctattctagaggctaaggcaggaggatcccttgagcccaaaaattcagtgctgtagtgtgtgatgatcacagctgcgatgtagtgtgcacctgtgaatggccactgcactccagcctgggcaatatagtgaggcccatctcttaaaatagaagaaaagaatccataaagtagatttactaaatgcttgtaactgtataactgttaaaaaaaaaaacaaaaaaacagtataagatcgtgccattgcactccagcctgggcgacagagtgagactgtcacacacacacacacacaaaagattcagtatactgcttataagacatgaacaaactttttacaaaagaagaagtctaaatgactgagaacatgaaaagatgttcaacattattagtcaaggagatgaaaatatttcaatgaaatagttcataaaacttatattagcaatgttaagacatcagatggtaagtagagtttgggagtatttggagcaagaacctcaatctgtgggaataaaaaatggtaaaccatatgctatgatccaccatttccactcaggaatatattctcgagttgcattgtttagtagacattaaccacatgtagttattgagcccttgaaatgtggctagtccaaataggatgtgttttaaatgtaaaatactggattttgaagacttagtaacaaaaaggaatataaaatatctcaaattttaataattattgcatgtcgaaatagattatttaaaatgtacatcttgtatattttttgtagttatgggaaatttaagattacattgtgtttgtattggctggcactaccctggaggaatttagatgtgttcaccaggagcagtatgtaataatgtagcagaataattcattatagtcacaaattgaaaatatttgaagtatctatcagtagctgactatgtcatcattatagtagtgaaaagtagctatatagtagagaaaaaaatgattgccatacacatctttatgaatacatctagaaaacaatgctgaatgaaagaagtgagggttcatacacaatatgactccacaaaactcaagaacagatcaaatgaaacatgattttttaggtacacttaacgtatatagatggttgcataaagaaaaacctggaataattactacgtaagtcagaatttgttcattgtgggggctggggggaggtgtaggatcctcagaagtttctaaaatactaacagttgtgtttctggtagttgttacatgaatgcgttataagttgcacatgtatattttatgcattattctaggagacatatttcataacaatactaaaaggctagaattaaagggggatgggtagtacaaaagaggcaagccaaagctgatttatttacttcttgaagctgccacattgttgttccttggtctaaagtcaaggtaggttaattgtctctgtttttttttttggcagagtcttgctctgtcgcccaggctagagtgcagtggcgtgatctcggctcactgcaacctccgcctcccgggttcaagcgattctgctgcctcagcctcccaagtagctgggattacaggcatgcaccaccatgcctggctaatttttgtatttttagtagagatggagtttcatcatcttggccaggctggtcttgaactcctgacctcgtgatccacctgcctcggcctcccaaagtgctgggattacaggcatgagccaccgcacctggccaattgtctctgcttttttgcgtccagctatttgtcttcctttccagtggtctgcttgagtggtataaatctgtacagtattgaagactttgttaacataggatgtagagatcagacgtccattccaaaaatgtgctgataggcctttacatcttatcattggtatcattggctagcgtctgggctcatgagctcaggaatttcctggtccactatctcatgataccttcccctaactataaatgtttaatttgtatctacagaataagagagaaacacgttacaacgagttgctcagtattctatcctctgcccaagttgcttgtgtagaaactcaaatatgctaatgtgtttatctccaacattttaggaagaaccttcaaatttgaaacttatgaatcacatctgctagtcacttaatctcatcgttaggctcattgcatttacagtagtgaaatataccagttttgtccagtactacttatagtattatcaggtgaacttaacactcctcactggtggcctaaacatcagttcccagaatttttcttggaggtacttagctttgtggtatttgagagaacatttccagttgttagatgattgagaccatcagcaagcacgttgttgagaggttacactctcaacaagaaagcgtacctctagtggctttcttctgccttgacccagacagcattctggaattattggggtccttgagccttggaagactggatagctctcattcactttgactttgctgattacttcactctcttatgcagcattcccccttacaaatgaggcaagtccttacctgtatttatttcagatagtgaaaggaacttcagttgtggcagagtatttggtataaaggtggacatgctgtacacatttatcaggagatggctggcagacagaaacaatagcttcatactgacttgtcaagaggagagtcatgtaaacttcctgtctcctcaccaccacttgagctgaccttttctcattagagaagtgcaccaagttgagaacctgtctggcaaagcctgttcttgaccagcagtcaactatgtgcaagttccactgggagtgcagttctggaccaacacctaacttctgtgaatctcaggtggggatcattcttaccctgtccacctcatgaggttgtaaagaatttgaaaactgtaaaaaactgggcatatatgaagaaagaacaaagaccagatggttatgtgggaccagaaacaatgctacaaatggaggaaagaccaggaatttaaggaatgtagaagcttaggcagcctttacatagaaactgtgccatcaaagtacagtctgtggagttcttccaggtgccacagttccattattagtcctcttatgttgtatatttctttctttttttttttttttgagatggagtttcgctcttgttgcccaggctggagttcaatggcgcgatctctgctcactgcagcctctgcctcccgggttcaagctattcttctgcctcagccccccgagtatctgggattacaggcatgcgccaccacacctggctaattttgtatttttagtagagacggggtttctccatgtttctcaaactggtctcgaactcccaacctcaggtgatctgcccgccttggcctaccaaagtcctgggattacaggcgtgagccactgtgcctgggttatgttgtatatttcaaaatacaaaattcttttacactcttcctaacaccttactctgaaagacttctcagatcgctttcctttcatggacaacgtgagctctcaagttaactgtagtcactctctctttagaaatggttttgaactaaagttctttctgctggagagtcaagtgaatcaagagacctgattttagaggccaggcacggtggctcacgcctgtaatcccagcactttgggaggccgaggcaggctgatcatgaggtcaagagattgagaccatcctggccaacatggtgaaaccccatccctactaaaaatgtaaaaattagctgggtgtggtggcacacagctgtagtctcagctattcgggaggctgaggcaggagaatcacttgaacccgggaggtggaggttgcagtgagccaagatcatgccactgcactccgtgacagagcaagactccgtttcaaaaaaaagagacctgatttcaagttttgcctcattatgtaaattctagccataatcccttgcacaagttagtactatatttcaaatatggcagccttataataaattgactctgccagggattcattcattaacatatatttgagtgtctgctgtgtaccaaacaatgttggaagctgggaatttggtagtgaacatgactgacaattgaaaatacaatctctaaataattcaaaatggtggggtgggtggagctaattaaactggaaaatctaggcagaagagaactatcataattgaccactgaattcagttttgagcctcttgataaacaagagagaagaaatgtgctgagatatctcagtggaacagtggtgggggagagtgtgaatgaattaataagcagaaatatgagtatgatacattcaaatgtatgagtatattgcactcaaatattgaaacttggtataggtattggagaaatgacagtatctgaacatagataagttaaggcacagggtgtgtgtgtgtgtgtgtgtgtatctatattaatatgcttttaaagagtgaaaagtactagaacattttacatggtgatgggaacggtccagtgtaaagagagaatggaagatacagttgagagtagataatggggctaagttcctgaaaatacgagactagataggatttggagcatgtagtacagggtttctcaacctcagtactattaacatttcgaactaggtgattctttgttgtagaagctgtcttataaatcataggatggttagcattatctctagtctctacccacaagatgccagtagcatccccccaccccaatcccatgacaatgaaaaatgtatggtggaggtgtggacaaaatcaaaacccagttgagaaccacagaagtcagccattatttgtattcttgtccccttgtatgtaatgtgttgttttcccctctggctttcaagatttttactttaccattgattttcagcagttttactatgatgtgtcttggtttggttttctttgaatatatccaatttgaggttaactgaaacttttgaattagtaatttgatgtttttcatcaaatttgggcacatttcagtcattaattcttcaaatattttttatgttccttactcattttttacttgggaattcacttatagatatgttatactatttgataatatttcacaggtccttgaggttctttctgttttttttgttttgtttttttgagatattacccagactttttgtgaaatcctaggctcaagtgatcttcccacatcagcctcctgagtagctgggatttcaggtgtgagccgccatgcctggttctttctgttttctggaatatttatgttctatagattggactgtatttatcattctgtcttaaacttcactaatttttgtctaccattttcattctatttttaggcccgtccaagtaaaagtttttcagttctggaatttccattttttatagtttgcattttttgggctgcgatttcctatctattcacttattaagaccatgtttttcttctgtttcttcatatatatttataatagttgctttgaagtccttgtcttaaaatctgacatttgacatttgagagatcttgtgataacatttgagcgatctactgactgcttttttaccttgactatgggttacattttcctatttattttcactgctagtaatttttaaagttttatactgttcattatacatatgctgtagagattatagatgtcatcttcctctgaaggatgttgagttttttgttttattgggcgttgtaggctacacttggaattgtgtagacttattttactctttcgttaggttagatctgtggaaagcctctttaacttgacagaacttaacctccaaattctgtgtctcctctagatcttatgaggttttatattaggctttgctagtgagtctagagtaggtcttattctctagactcgagtgtggaccttattctgtagcatggcttcatttctaagctgtatcacacatgaatgcccaaagggttaatgagtagcttacaaagggtatccattcttaactgggcttgtatgctcaccatcccccagcactactggacctttagtatatctgttcagcttaaccacatagcagtcactttggggtatgtcttaggtagtcttatcctgaacatatgtgctctgcctccagccaaggacacacagcagcctgaccctcacatggacttattgcccccctcttccctgcatagattgtctccagcgctctattccacaggttccactgcttcaactgtactaaactctaaagcactaccttctcagctcagcaggacagttatactttgcttgggctgaagcttactgtgccatggttaggaaattgtacccagaaatagagctggagtgatcgtggagcccatcttgtgagctcttctctcagagatcacagtcttacattgcttttgttcaatccctaaaaatagttgtttcatagtcatatcagttttatggttatttacattaggaggcacaggctggtattggttgctccgtcatagccagaagcagaagaccatacccattacatcataaaattaaaaagtctgacaatattaagtcttggtaaagaagtggtgcaacatgaattcacacatcactattggtgttaaattaaattgttacaaccaactttagtattacttattaaagttgattgtttatgtatcctaagaagcatcagttccatttccacatgtacatatgtatacatgcatttttctaatacacatcagttccatttctagttatgtctatatgtgtacgtgtgtgtatcttttgtagagaaacttttgaatgtgtggactatgagacacatccatattgttaaatctaatagcttcattatgtctaaaatggtattatatatgttttgtatacagtggtatggtatttaacagtgaaataattggtatagaaatgaagatgattttaaaaacaatgccaatatagatcaaataagagaatggtaaaatggtgatagttgttgaaaccatgtgatgtgtatataggactttgttatactattctatttttgtatatgttagaaaaattccaaagtaaagaagttttaaaagtttggtggatgttagccatataatatatgcagaaaatatgattttattaatatacagttccaaaacaggggaaatgaaatatattgcatagggaaactttcaaaggtaataaatgaaagaacagttaggaaatcggtcttgctaaggtcaatatggtggtttttctggagagaaggaggggaatgggattgggcaggggcaaaaagggacttccaggatattggcagtgtcctattaacatagatggtagtagcatgtggtgttcattgtattaattttcataccatacacataggttttatacaagatatttcaaagcagaacagttatttaaaaatagctggatgaaagaattttgagagttttaggttggcataatcaagggaagcatcctagagaagcctagaacttaaaactaggtcctaaataacgaatattctatattataaaacatctgatctaggacccactgttatgcttagtattcctgaccaaaaataaaggacacagaagataacttccattgcaacacattctccttgatgacagtgtctatcccattggttcactcattcattcatctatccatttattcatttaacagatatttgagtagctgttaggtgctaagcatagtgataggcaatttgtgaacagtgttgaggagtgatggagtttccagtccccagattctttatgattctcagctttgttagctgggacgagagacctcttttgtatatttgctttgaggtgtgaactagttagccccaaacaactggctggcttctttcttgccctttttctaagatcgcctggtttctttgctcagatttctgtgacagagtctttccctttttctcactgctaagacagcgattgaaaaatttgctcttttatacattctttcaaaaagttctccccttgatgcatgcaagagttttgccttgattattaggcaatatttggatatatgtacaaaatcaaaacagagaataagtagtctagctagagaaggtagctggtgggtttgatttatgaaggggaacagtaaaaaagagaagttgaggacagaaagtagtatggggtgctctaagtgggtagattgcctcttaaataatgaaatctggatgtggttattgctagaacagtggctgaagaaaatcttgtgtttcaaagaaagtggattgaagagtactttttgtgacccagaattcaaaattaaaaacttataaagtcaataaatggaaaacaaatgagtttctgaagtgtcttcatcaaataatagaattatggccagtagtaaaaaaaagaaaaaagagttatggccagtaattacaatataatttataaagtttctagtcactccttcactgatagaatacagtaatatgtaagcacgaatgtgtttattaatagcctgttgatataatttatgaaaaaaatacagagtttacaacttttttttgaaattggctcctgagtaataaaaagtttcttgacattgattatctaatgagagctaagtatgtgaattatctaacagagttcaatattatttgggaataggttttagagcccttttaagttgaaaattgagaatgatcaaaacattcctaattctcttaaatcaccagtaaaatacgtatcactttatgcatagccttacaccttaatatgcatctaaagctgggcgcggtggcacatgcctgtaatcctagcactttgggaggctgaggcaggtagatcacctaagggcaggagtttgagaccagcctggccaacatggtgaagtccctctctactaaaaatataaaaaactagctgggcgtggtggtgggcgcctataaccccagctacttgggaggttgaggccggagaatctcttgaacctgggaggtggaggttgaagtgagccgagattgcaccattgcactccagtccagcctgggcaacaagagtgaaactctgtctcaaaaaaaaaaaagcttctaaatatatatgtagtaatgtagcaggatcatatttataaaataaagtattgaagtgcttgaattttgaagtacttgagcatatttataaagattctaatttgatgggtcttcctgtccatagtcatctttctctttagaagctgatttttttttaaattttattattttactttattttatttatttatttttgagatggagtctcattctgttgcccaggctggagcacagtggcggggtcttggctcattgcaacctccaccctcggggttcaagcaattctgctgcagcctcctgagtagctgggattataggtgctcaccacaatgcctggctaagttttgaatttttagtagagatggggtttcaccatgttggcctggctggtctcgaagtcctgacctcaagtaatccacctgccttggcctcccaaagtggtggagttacaggcatgagccactgcacctggccagaggctaatacttaaaataattctttctacttttagttgttatttccctatgcttttcaacatttttgaacatgaaaggatatggtaaaactatacttgtttgggcacttttcagtggtcaggacattatcgaaatgtattcatcctttcgttaggtttttctttctgtgcattaacattaggatttgattacatcaatgcatacattcattgagtagaatagcagtggcattgctggcccatttaaaaagtattattattgctaaacaagtataattgaatttctgtaagttaaatgttagcactacagtactctgaagattgggtaggtgaggtgggaccagattgcaaagtgtcttgaaagctttataggaatttagaataaagagcaattgcagtttttataaagaaagtggaatgatcaaaatagtggtttaataggtttatatatgtgaggcattaacctagatcagaataggggaggacagaagttgagttaaaaaacccacttatagtaatccaagggtgaaatgaagagctgaacaaaaggaatatcgtttattttctcaacattcattaataacctacgtgagaatgaaaaagtgccaaaattgggaagcgattttaaagaatctgttcataataccttgtgaaagaagtagggacattagcaaggaaaacctaggagagaatgatcttaagatcagatttggaaatgttgagttgattcatggtgtctatttatgtaaaatgtcttttgccctctctctaaatcctagagatgataagaaggccagaaatgtagattttggagtatttagtaaagaagggagacttaaagcaggaaaagtgattgaactttttaaggtattaaagaaaaggagagggaacaattgagacaggaagtccactagtggtaatttggaggaaaaaaataggtgtgggctgggcgcagtggctcacgcctgtaatcccagcattttgggaggcagaggcaggcggattacaaagtcaggagttcgagaccatcctggcctacatggtgaaaccctgtctctactaaaaatacaaaaattagccaggcatggtggtgcacacctgtactcccagctgttcaggaggctgaggcaggagaatcacttgaacccgggaggcggaggttgcagtgagccgagatcgtgccactgcactccagcctgggcgacagaccaagactccatctcaaaacaaaacaaaacaacaacaacaaaaaaggtgtggttattatatatagtttcactgaagaagccaagaaaataaatggtgtctgagattatgacccataaagggacacattctatctcaactatagctttaatttttttcttttttttttttttttcagacagggtctcaccctgttgtgcctaggctggaatgcagtggtgagatcatagcgtactgcagcctcaaactcctgggctcaagggagtcttctgtctcagcctccctagtagttggtactacaggcatgtgttaccacacctgactaattttttacttttttgtggagacagtgtctcactgtgttgctcatgctggtcttgaattcctggcctcaagtaatccttccacatcagcctcctgaagagctggaattatagatgtgagccactgcacccaaccagcttcatcttttttcccccactgacttcttattttaaggcagagaaaattgcttgaacccgagaagcagaagttgcagtgagccaagattgcgccactgcactccagcctgggcaagacagcaagactctgtcttgggaaaaaaaaataaatgaagaaatgtaaaataaaaaaataaaaatcccttactgctgaccaccttggacctaccatcagactgtaattcacattgacatgaatgggaagtgagaaagttgaagcaccaagggttctttcaagcaatttggctgaagggaaatccttgttgcttaagcttcttctttctagtcagaccaatatgagttgcagagaaatgtagactttgaaagacaatgccattttctcacttaatgttatgaatatttttctgtatcagtaatatgcatctatattttattccctccaagtcttcattttgaaatacttcaaaccttcagaaaagttacatacataatatgaggaatgccagtatattgttcacctagatttggcaaacatcttaccatatttcctttttttctatgtataaatatataggtgcatatatatacattttttcctgaatcatttgaaagttagttgtagacattatgtcagcttatcctaaaatacatcagcaagtatctcctaaaaacaagtacactctcctacataaccacaattatcaaaaacacaagaagtttaacattgatagaatgctattattgaatatgcagtttatatttacatttctccagttgtctcagttgtcctttataatttcttttatttttttctaagtcaattccagacaggaatcacacattgccttgagagtcatataattttaatgttctttcatttagaatagttgtgctgcctttttttttctttttggctattcatgacattgatgtttttcaagagttcaggccagttgttttgtccttcagtttggatttgcccgatatctttatatgattagcttcaggttaagattttttttttttaaggtggagtctcgctctgtcacccaggctggagtgcaatggcgtgatctcggctcactgcaggctctgcctcccgagttcaagtgattctcctgcctcagcctcctgagtagctgggattacaggcatgcactaccatgtctggctaattttctgtattttcagtagagacaaggtttcaccatgttggccaggttggtctcgaactccagacctcaagtgatctgcccaccttggcctcccaaagtgctgggattacaggtgtgagccaccgcgcccagccaggttaagtatttttgacaagaacattacataggcaatgtgccttgtttagtatatgctctccagagacatgtgatgtcagttacaaaatttgatgtggttagaattggtgatttggtcatttggttatgatgatatctaccagatttgctcactgtaaatgtaccttttctcttttgtaattaataaatgatccttggagtgatattttaaaactgtgttccccaacagtctttattcagtattttagcttccattggtgatttttgcttgaatcagctattatgcttattataagatggtgatttttttttttttttgaggtggactctcgctctgtccccaggctggagtgcagtggcgcaatctcggctcactgaaacctccacctcccgggttcaagcgattctcctgccttagcctcccgagtagcttggactacaggcgcataccaccacgcccagctaatttttgtattttcagtagagacgaggtttcaccatgttggccaggatggtctcgaactcctgacctcgtgatccacctgcctcggcctcccaaagtgctgagattacaggtgtgagccactgcgcccggccaacatggtgatttttatttattttttatttttttattttttaggttaatgttttttattttttatttttatttttttatttagatggtgatttttaaatttgttattccctatatgtctgttagtattcttctataaagaagaactttcctctccacttcatttttttatttttatattttaattttctccctttttagtgatagtatggactccaacatggatttctatccattcttgtcctcattcattttgatgttcagaatatctcaaacctagtcaggttagagctctctcaagatggttcctgcttataaccagcatgttgtcatctgttcagcacatttatattttatggcacaacaaagtggtcttgttgccctcttccttttttacttttgttttttaattgtgataaaacacacaacaggatttattattttacagttttaagtttacaattttggtttgccttttttttttttttttttttttttttgagatggagttttgctcttgtcacccaggctggagtgcaatggtgtaaccttggctcactgcaacctccacctcctgggttcaagcgattctcctgtctcagcctccccagtagctgggattacaggtgcccgccagcacacccagctcatttttgtatttttagtagagacggggtgtcactatgttggccaggctggtcttgaactcctgacctcagctgatccgcctgcctcgacctcccaaagtgttgggattacaggcatgaaccaccacgcctggccttggtttgccatttatttatttatttatttatttatttatttatttatttatgagacagactctcagtctgtcgcccaggctggagtgcagtggcgcgatcttggctcactgcaacttccgcctcccggattcaagcgattcttctgcctcagccacggactacaggcgtgcaccaccacgcctggctaatttttgtacttttagtagagatggggtttcaccattttggccaggctggcctcgaattcctgacctcgtgatccatccgccttggcctcccaaagtgctggaattacaggcatgagccacagtgcctggccagtttgccttttaaaatgtggtcttccctggtttatccctggcctacttctcttattattttgatagcttgtctagaaatgatagactctattcttaagttttgggtttttatttattaactgtatgctaatgactcccttgtgtctttgtgggactctagaactatattaccggtagcctactaaattctccagttatttgtcttatgtttcataggcatcttttttatattctgtctctcattttaaaaaatgaaagaaaacccaccccaaacctatattttttattttgcttggatgccttaggaatccccatccacttatcgtaacttctaacatgcagtttgtcactaggtcctatcagtcctttcatattcattcctactgccatgcgtcatctctctatagaagttttataggatgttcttggctctagttcattctctttctagcttaactcttgtcagagtagtctttcctccttatttctcatttcattttttttccctagcaaattagataatttactacaagtccaagaagcagttcttgattttaggcaaggctttgtataagacaccaaagaaagactttgcttttctttacccctatctttggtgtactttgctctgtgttagcttcattttcagttacgctttctctgagtgggagcaacagtggccattgatggtttcaggctttcattattttcaaagtaaatgattccaaggaaaatccttcatccttctaaaatccttcatcatcgtaaaatataaatatgattatttctctgtttttcttaattctattcagtggttcctcacccccttcaggataaagttcaaattctttggcaagcaagaattcatgaattcttgatttggcttttacatattttcattgtcctgttgctctctgctttaaaatttgtatccataaataccaagttgcatgtgcagtttcctctgcctgcagtggcttttcacattgtttacttgccaaattcattatcttttagctaaataaaccccagttcagatattactcttccaggaaaatcttatttgataaattttgtgctcaatcccagaaaaattactctcctgttctacctttgcaccacatatgtatgtttgtttttgacttatactgaattgtaatctgtttacaaaattttattttttttgagacggagttttttgctctgtcacccaagttggagtgcaatggtgtgatctcggctcactgcaacctccgtctcctgggttcaagcagttctcctacctcagcctcctgagtagctgggactacaggcgcccaccaccacgcccagctaatttttatatttttaatagagatgaggtttcactatgttggctaggctcctctcgaactcttgacatcaggtgatccacctgccttagccttgcaaagtgctgggattactggtgtgagccactgtgcccaggctacaaatttttttatatccattagatcattaaatctctttggtccctttttgaacaaggcaaggtataaatttattaaaaataacaacaacaacaaaaacaaaaaccaaaattaggctttggttgtgcatccagttgtggtagactggctaattcagatgaaccctattgctgagaacagctgaaaaagtaggtttaaaaaatctgtgtgaaggcacagtagagggccaagacagtaaaacatcatgtggtcaaaatctggaaagagagtcggaagccagcggccgtggaccacgcggagccgccagcccggggcatgttctgagacttcagggaacccggcccgagctccgggaatggcgtgggtatggcgaccccgcgcagccccccggccgcagtgcaggcagcccagcagaagttccacctcgtgccaaggatcagcaacatgagtggcagtgaggagctgcagtggatggtacagcttcattttctggggcccagcagttgccccaggcctctgacctacccttagtccagccccctacaaccccagccaggagccatccgggccctggggccgcctccagtggtgtgtccaaggccttgtgaacagatcagcccggaggaagaggagcgccgccgagtaaggcccgagcggaacaagctggctgcggccaagtgtaggaactggaggaaggaactgactgacttcctgcaggcggagactgataaactggaagatgagaaatcagggctgcagcgagagatcgaggagctgcagaagcagaaggagcgcctggagctggtgctggaagcccactgacccatctgcaaaatccccgaaggagccaaggaggggtacacaggcggtaccagcggcaccagcagcccgccagccccctgccgccctgtaccttgtatctccctttccccagggcctgtgcttgaacctgcggcactgcacacccccaagctcatgaccacaccctccctaactcctttcacccccagcctggtcttcacctaccccagcactcctgagccctgtgcctcagctcatcacaagagtagcagcagcagcggagacccatcctctgacccccttggctctccaaccctcctcgctttgtgaggcacccgagccttactccctgcaggtgccaccctaagcaacgtctgctccccttcccccaccagtccagctggcctggacagtatcccatacccaactccagcagctgcttctccatccctctaatgagactaaccatattgtgcttcacagtagagccagcttggggccaccaaagctgcccattgtttctctagagctggcctctctagcacaatttgcactaaatcagagacaaaatatttcccatttctgccggaggaatcctggaagcccagagactttgtagatccttagaggtcctctggagccctaaccccttccagatcactgccacactctccatcaccctcttcctgtgatccaaccctacccccgtgacagaaggtgccactttacccacctagaacaccaactcaccagccccactgccagcagcagcaggtgattggaccaggccattctgccgccccctcctgaaccgcacagcttgggaggtgcccatggcttctgtgatgagctgatctgcagatctcagctttgagaagccttcagctccagggaatccaagcctccacagtgagagcagctgctatttattttcctaaagagagtatttttatacaaacctaccaaaatggaataaaaggcttgaagctaaaaaaaaaaaaaaaaaaaaaaaaactggaaagagaagaaaacctagagaaataaggctggcatttgggtcttcatttccctcagactcatctgccagttccatcctaagcctcaagcttttagtaatagtgtctgatcctcaaaaaataattaggaatattagaagacaatatgatatgatagaaaaaaaacaaaagaaacaacaggaaatagaaacagacccctagtgatccagaaaatagagttatcaagcagactttgtttttaataagttaaaaaataaaagataagatggagaatttcagtatagagccagaaactttaaaaaataatcaagtggaaattttagaaatacaaaatatgataatcaagtgcaatgggtaggcttaatagtagatcaggacagtgaagagataattattaaactggaagatggatcaaaagaaaaatccagagtgaagcattgagcaaaaagatggaaaatacagaaaagggtgtaagagacatagtctaacacatatcattggatcctccaatgggggaagagagagagaataaagcgtaagtaatatttgaagagattatgggtaagaattttccaaaactgatgaaagacaccaaaggacagattctagtcctaaaaacttcaaagaagataaatacagagaaaacctcatcaagaccatataaaacaactgaaaacaaaagctggataaaaaggacagattacaagcattaatagtaagacttacagctaacttctcagtagaaataatggaggtgagggaacaaagggatgatgtagttacagtgcctgaaagaaagggaaaatagtgttcaagaattaaggtaaacaaataagtgaattgtacgcttaaataggtgaatttatgagatgtaaaataaagctctaaataaacctgtataaaaatgaaggtaaaatagagatattatcagagaaatgaaaactatgaaaatttatttgcagcagatctgctttaaagaaaatactaaagggaatttttcaggcagaggacaatgattccagaaagaaggttggagatgcaggaagaaatgaagagcaatgggaagggtaaatatgtgtatatatttaaataaatagtggcaataaacacaacaacgctggtgtaactctatttactctatcaggcaaagtaggtttttaaggcaaaacttattcaagatataaagatggatattttataatcatgacaagtttcattgccttagaagatataatatttctaaatttgtgtgcatctaataatgtagcttcaaagtacataaaatttgcaggcaaataggtgcattcataatcatagtgggagattgtaacacacacctttcgtataaagaaaggtgtaagatggagcaatcagaaccaaaaaatcagtaaggttatacaaaatgtgaatgcagtttagaaaagtgaattccagatggattatagttctaaacgtgaaacacaaaataataaaacttatagaaataatagctcagtaatatttcagtggggaagatttattgaacaggaagcacaatgaaggaaatgattgataaattgcactacattaaaggacttcttttcatcaagatactataagagaataaaaaggcaagttaaaaaagtgtcaaaaagtatttacaatattttataaagaactcttacaaatcaataagagaaagacaaccctatagaaaaatgagcaatagtattgaatagtcatctcaacaaaagaagctatccaaatcagcaaatatactcaagcttttcagcctcattagtaatcagagagatacaaattaaagctgcagtgagataacacatatacctaccaggatgactacattaaaagctttttctgaatatttattttgagatatttatagattcacaggaagttgcaaaaagtgtacagagaggtactgtgtaccgtcacttcccttcaaaagtcacatcttatatataactatatatacatcttatgtaactatagcacaatgctgggcaaggtagctcatgcctgtaatcccagctgttctggaggctgaggcaggaggattgcttgaggccaggagttcaagaccagtgtgggcaacatagtgagacttcatctcttaaaaaaaaaattaaaaaaaaaaattagcctgtcatggtggcatgcacctgtagtgccagctacaggttgaggtgggaagatcacctgggcccaggagttcaaggctacagagagctgtggtcgtaccactgcgttccagtctgggcaacagagcaagaccctgtctctagggaaaaaaaaaaaaaaggaaatatgttgtgtaatattaaaacaagaaaatagacatttcttatcacaaatgtatgtgtatagttttgtgccattttatcacatgtagattcatataactatcaccacagtcaagacactgaactgtattattaccacaaagttctccctgtgctctctaaagttacccctttagagtctaacccacctgcctcacctccactatccctaacccctggcaaccactaatctgttcttcatctctataattttgtcattttgagaatgttacatgatggaatcacacatttcttagagcaattttagattcatagcaaaattgagcagaagatagattttccatagatcctcttcccctacacaagcatagcctcccgtattgtcaacatcccctaccacagtggtacatttgttgcagttcatgaacctacctagatgcatcattctcactaaaagtttatagtttacattagggttcattcttgttcaaatggctaaattttgagactgaaaataccacacattggtgcagatgtagatcaacaggaactttaatatactgctaatggggataaaaataggtacagccactgtgaaaaactggcattttctactaaggctaaatagaaacctactgctcaattcagcaattccactcctaagtaaatatccaacaaaaatttgtgtccctgttccccaaaagaagtttttgtaaaaacgtatttataggaatttgtttgtaatagctataatctgagaaaggacccaaatgctcatcaatagcagaatggatttcttaaaaacttgcagtgtattcatatggtaggatagagcaagggtagacaaatatagtaaatatcttagactttgtgggtcatacgttgtctgtggtcatacattgtctacctaactgcagttgtagcaatgaagtagtcataggcaatatgtaaacaaatgagtgtggttatgttccaacacagccatttataaaaacaggctttagcctttgggcctgtagtttgctgacctctgctgtagagccacaaactgtggttacatgcacgtacatggatcagtctcataaacataattttgcatgaaagaaaccatgtggtgtaattcaatttttataaagttcagaaacatgcaaaacacctactgtattgaaggtgtatgagctattttgggggagaaagaggagatcctgaccagaagggacatgaaaaggaagcttctagggtgctaataattgctttacctgaatggtgattaagtctgtttaccttcgattattcattgagatatatacttatgatttgtacacttcttgtgtgtgtgtgtgtgtgtatgttatacattaatgaattagttaaaaataaaaataaacaaaaacatacacaacttgtgtttccatcagggtagaattgtgttatttatctctggcatgtagtaaacatacaataattatttatagaattgggagttgctaatagcaagctctgtagcaagataaaggacaagaggagtgagcaatgattctgatttagcctgaagagcttattgaaaacttttgaggaagaaatgttgataaatatacattttgatgtaattaaaggtactttagtgaaaaaagatcataatctaaaaggctaacattgggatttaataaatggtttgagctgacaagtgacttcatctttgaagacagaaggaaaagattcttttgttattaagagcaagctacaactattttgtaatgatatttaatttccttcctgttttaaatttgcttcaacccgaaaaattctttcttatgttttttacttgcttaaacccgctttggatgttgccctgtaaagattcatgtacccattagtaccatgtggagtagatgtgatatagggttttattgggaaaaacttagaagaaatagtggagtgtaagcagtccctcaaactccttttttatctcacagtttaggccagacatagagggtctttatggttcacctgggtgaaccatagggttcaacctttagggttcaacctttaagttcacctgtggccaagtgaacttccagtagagaatgacctctaccctctgtaatgctccacacatttgtaggtcagggccggaaacacttaagtgactatgcaatagtagttacaaaggggaagcctccagaaccccagaggcagggaggggtctattcttcctttgagctaacaactcaaatatactgagtctctttgctgcagctatccagggccatccagatttatctttatcacatgcatcccattattataaaacaaagtgaaatcttcttgacccagtattaaaggtcttctagtagctttctccaacttcctcatcagtcctctttgccactggttctacacagattttcttagtcacttaattactttgtaataaacacattgctttttccaagcttcttatctttgctctcattacctatttagaatgtttctccctttctctaaattctcatccttcaagaggtgcttttgtcccatctctcctgtgatggcttcctgatgatcgtaattcttacaccaatatcgctcttcacatactacctaatattatttatttttatgtgttcatttcttccttttcatctaacatataaattccttaatggtagggaacatgtattagattactttgtaacgtctgtaatacctggtagtcttgtatgtaaatgctcaacaaataattaatgattagtatgtgtggtcttataatgttttttaattataaaatcattataatattttagggtgttatatgcctcttagattctgaatgttgttattaagtataatgctagactctttattagaacgtctttttcactccattgtaattaatccctgttttagaagttcatttttttgaggttggtatcaattattgtctgttggttactctgttagccagtttagtaattagattcctccattctacttcagcaagaagttgagaactttaagaagctaaatctcattagtaaagagcagtttgaaaacctaacacctgaacttccttttgagccaaaccaagaagttcctgtagcaccttcacagtccaggcaaggtatgtaaatctgcttttgtgtaagtgtctgaatagtattaaagcagttctgaattgtttttaaaaattgctccttttttttctttatttgtggaaaatcattaggtaaatggtaaaatgctagaattttaaaactcaacttttatccttttgtgaacttctattatcacaccagattatgctcaaagccagaggcttacttagaagtaggcagaatttgttggttctttatgtatctgatgtgattttaagattgctgggaatgtttctcttcccaaaataaaatttttcactgactcactgatccttagaatgcgctagagtcattcttttgttttaagggcttagctctgtgtgagagtgtaaataaatacattgggagatccataaattgaatctgacatttcagacaagtataactgattttattatagccttttcctgaaggtggttaaaaaaatgatttataaaaagtcacacatatacaaagatagagtgaattttataataaaactcccatgtacctgctatacttaatcatctcatacccaattttgtctcgactccagtaactcctatacctccctgtggattatttttaaacaaattctcaatcacatgattcatatttttttgtccttaaagatttctgtatgtgtctttaaaaagataagggctatatcttttaacacataaatagcaggacattatcatatctaaaattaacagtaattccttaacgttagatatctagtgttcaaatttcctcattcatcactttttttttccagtttcttcaaatagattgcaatagattgatatgtcttttttagtctacaggtttctactattttttgccttataatttattggtccttgcaatttggtattgaagaaactgggttgtttgtcttgtagaatttttcacattctgaattttgctgattgcatccccatggtttcatttaacctgttttctagtcctgaattatctataactgttagttcagcatagagacttgattagattaagactcaaatctctgtaagaatatgtcatatgtagtattgaatactattaggagatacataatgctctattgtctctttttgtaatgttagcagtcattgatgatcagtgagtgaagcttttattttactaggggttgcaaaatagtgatgattctatttttaatcattacgtcttaccttaataggtagaatacttttataaagagaactttccccagaatatttatttattctgagatagagttcttacaggaaagtgagtcagtgctgaattatttccctttgtttactagtttcaaagtactagctggttccttaacattcttcgctggtgactaatgaagtttttgtttgtttgtttttaaatgatcattgtgaactcataaatacatgagatgggtttcattctattacagttattattattattattgatacctatgccagttatcagtttattgacttttagctctaaagccacctttcattttcttgctcagtaataatggagttggactgttaactttaatgtttcccaccccacagaaggttgagcccccaccaaggttgagctttgtcagtaccggatctgctactcagttggtccttgtttctaggccttttgaatagaaagagctaggaaattttttaaggagaaaaatatattacgtattcatgttgatattttctgtctaaatttaagattataggttttaattttaatttctttgattttgtagttgtattgctttttacttatatataaaaaatctttcttcctaaccacagtaacataattatttatttgctaatcctatgatataatagttccagaataacaataacattaaataataatattataaatactgaaaggtaacttcttttagagttctttaaactgtaaacttttaaaaacttcatactttaaagctttctttaaagttcttagtgtgtcccactagggctgttcagttaaattgctggattttttgccttgttaaatttgaatactttaaaattgagaatgtatattcctttgcacatcatagaaagcatacaagtcacaaataaggagataaatttggcattgcatgacattaacaaagaattaatatcatagaaatctaaaaccttaaaaattaatatgaaaaatggcaaacatgaatagaaaaagtagtaaatgaaacatgaacatcagtttcatatttgggaagaccaaatggccaataaatatgaaaagaggctatttttactgaggttttccaattaaaaccatagcaatacgccatattataacccagcagtttcatttcaagagatactgttgcaggccattgtggctcatgcctataatcccaacacttcgggaggccaaggcaggaggatcacttgagcccaggagtttgagaccagcctgggcatactgttgcaaatgtttaccaagagaacatttgtagtatcattgttcataatagaaaaaagcaaatgaaaactaaaaaatgcccagttatagtagaatgtattataagatgtggtgtagtcatacgtaggaaaaataggcagcagtggaaaatgaaagaactaatgttacatgtgacaaaatgtgttaatctaaaaatataggaaaaaataaaaaaataaaaaagggatgtataaaataagctagaacaaagaagttcattcagtgtaatgctattacataaagtataaaattcatggatagatgcatagcacataggagccatgaagagaagcaaggggaattattaatataaaaaattaatatattaatttactcctgagggtgggggaaatcccatctggaaggtctgcacatgtgtttgctagcatctggaatttatgtatgtattggtctagttggtcggtatgagtgtgtatcagctctattttaaaatttatatataaatttattaatttttatttgtgtgctataatgtctagtttttaaatatatgaacagaaaaatataaaaataaagcaaaaatttaaaagatagaatttgaccaatatattgctatgacaggaaatgttgaatagattaatgttcaaattaaaagataattttaatctttaaattaattggacttaaaaaaattcactctatgctagttatatgtcataacatatggaaagattggaaggtaaaggatgggaaatcatataaaagaatgatcctaatagaaaagagttggtattgctattacgatatagaatttaaggcataaagaaggagtttattttcactgtcttcagtatctatattcctatttattccctatacctgctccaaacaggcctctgtcctccacatcccaaatcagctactgataataccaccagaaatctccatatataagaggggtcaaatcagtcctcatcttacctgacatcagcattagatcaaattaatcgctctgtcctgaaacacatttttacttcctggatacttattcacttattctccttctgcctcatagagtcttttttgctagttcttcagtgtttccctaacttctaaaatttggaagctttaggacccagtcctcaaatttctcctcttttgaatcctcaataactccttgtgtaatagcatcaagtctcatgggttttaaagagcattattatactaatgagtatcaaattaatatgtatagaccagacctccatcctgtatttcagacaaatattcaactgtgtggttaacagtaccacttgtatattttataagcatgttaaatatcatatgtccaaaatctaagttctgaattcccacccctctccaaggactcttcctcctagacttccacatctctaaatattacctccatttttccagttgcacaggtcaaaacgtttgtgtcatttttgatccatttgttttttaaattccgtatcttatttattggaaagttatattcatatatatttaaaatatatctagaatctaaccacttctcactttctccatctctatcaccctgtaaaagtcaccagcgttttctccttggttaattgtaatgaactcctagcctgtctccctcctttcattctgatcaccctacaaatatccagttatattttttgtttcctcttaaaaatatatataaggtgtacaacatgatgttttgatatatatatagtgtaatggttacaatagttaagcaaatgaacatattcattatctcacatagttacctttttttgtggcaagagcacctaaaatctctcttagcaaaaataccaaatataatataatgttattagctatggccctcaggttgtacattagatctctagacttatctatcctacatatctgcaacttggtatttttttacctacatctccccattctccttcatcccacccttggtaactactgttttattatctacatctatatacttttttttttaaagattctatatataagtgacattatgaagtatttttctttctgtgtctggcttatttcatttagcataatgtcctccagtttcatccatgttgtagcaaatggcaggatctccttttttaaaggcttaattatattctattctctctctctctctctctctctctctctctctctctctctatatatatatatatatatatatacacacacacatatatatacatatatacatacacacgtgtgtacgtatatatacacacacacacacatatacacacacacacacatcaccatttctctgtttatcataagtggactcatactttagttgttcccatatcttatatcttggctgttgtgaataatgtggcaatggacatgtgagtgcagatagatatctttctatggtgatgatttcatttcctttgggtatatatataaggtgtacccagaagagggactgttgggtcatatggtaattctacttttaatttctttacaaatctccatactgttttccacaatggctgcaccagtgcaccttttcatatacctgttggcattgttatgtcttctttggagagatctctaatcaggtcttttgcccatgttttaattggattatttgcattcttgctattgagttgtctgagttacttatgtattttggatataactcctaatcagatgtgtggtttgcaaatgttttttcttattctgtaggttgtctgttcactctgttgattgtttcctttgctgtgcagaagcagctttttcatttgatgccatgtttgtttatttttgcttttgttgcctgagctttgtgggtcatatttttaaaaaaattaagatatagtttacattcagtaagtttcacaccatttatgtatattattttgggaactttgacagatgaatgcaatcatgtaaacaccacctagttaagttactgaacatttccattgctccctgagaatttttccatgcctctttgtattcaacccaggccaagtttttggcagtttgttttctattttctatccctatagttttgccatttctagaatgtcatataaatagaatcatataaaatacagacttttgagtctggctcctttcatttagcctagtgcctttcagatttattcatgcttttgtgtgtattacctttttattgacaagtagtattccattgcatggatgtaaacagtttatttatccacttattagttgaaggcatataggttgtgttcctgtttttggtgattatgaataaagctgctatgagtatcaagttgctatgtgaatatatgttttcatttcacttgggtaaatgcttttgagggcactgttggatcatacagtaagtataactttttaagaaactgtctaacttttccaaagtggttgtgccattttacgttcttaccaacaatatatgagggttccagttgctctacatcatcaccagcatttagtattgttagttttttttttaaaaaattttgcccatctaatagtagtatctcattgtgactgatgctgttgagtatctttttatgtgcttatttgccatcagtttatgcttggtaaagtgcctgctcaaatctttggacatttcttttattgagttgtttcttttgttactgagctttgagagttctttactctggatacaagtcctttgttacatatgtacatatgtaatttgcacatatcttctcagaacctggggcttatattttcattttttaggtatatcttttgggccagttgcagtggctcacgtcatgtggcttgtcttaattagtctgtttgtgttgtaaagtacattgattggttttcaaatgttgaactagtcttggattctcaggataagcctcatttagttattatattatccttttatatattgttagactcaggttgcttacatattttttgaagccttttgtactatattcatgaggaatattgtttttttttttcattgtcttggattatatttgtctgattttggtgtcagaggaatgctggcgtcataaaatgagttggtaagtgttccttcttttgtattttggaagagtttgtccacaattgtttatttcttacacattggtagcattcccaagtgatgccatctgggcctggaactattggaatgttttaaactacacatttatttatttaagaaacataagactaagtaagtcttttttctcaggtgagcttttgtacctattgaatttattcatttcctggaatttataatatgctctttttctccttttactgttcgtaggttctgtagagatatctcttctttcattcctactatttataaatttgtgtcttttttgtcttgatcgatctagctagaggttcatcagtttaatttttttaagttttattttcattgatttactttatttttattccaggtttattaatttttgctccttattatttccttttttcttattttgttcctccttttctagtttgagtggaagcttagatcatttatttgacaccatttttctttcctattataaccatttaatactacaaatttccacctaagcagtattttaggtgttattgtattttgattttcattcagttctatatattttctaatttctttttaattttttgatacatcagctatttagaagtgtttttgtttaatttttaaaatttggatatcttcctgaaatctatttttttgaaatctaatttttaagggagagtttaaattattgatttgagagtttcttttctgatataagcatttaatattctctctctatctctatttctatctttatctctatctatctatatatttttttaagacagaatctcggagtctcgccctgtcgcccaggctggagtgcagtggtacaatctcggctcactgccacctctgcctcctgagttcaagcgattctcctgcctcagcctcctaagtagctgggattacaggtctgtgccaccacacctggctaatttttgtatttttagtaaagaccaggtttcaccacgttggccaggccggtctcaaactcctggcctcaaatgatccacccacctcggcctcccaaagtgctgggattacaggcatgagccatgagcacagcccttaattctatgtatttttatttaagcactgatttagctgcattccacaaatttgatatgctgtattttattaatttttattcttttcaaaacattttctaaattcttttgagacttcctctttatggattatttaggagtgtattcggtgtaatttccaagtgattggaattttttcagttacccctctgttattaatcttattgatatatagtttaattatattatagccagagaacatactttacattattttaaaatttaaaattaatttgttaatttcaaatttgtttaattaatttgctaattttatcacccacaatatagtctgtcttggtgaatatgccatatgcatctgagaagaatgtttattacactatttttgagtagaatgttccatattgtctgttcaattcagttggttaatggtgttgatgagttctatatctttgctgattttttgtctactggttctgtcttactgagagaggagtgttgaagtcaccacctataattgcagacttgtttatttcctatttcagttctgttgtattttgctttatttatttagaagctcttttgttagttcaccttatacccattggtatattgtgtcatcttggtgaattggccctttcattcatatatgttgtccttgtttgctttgaaatttagtttgtctgattttaatatagccattccagctttctttcatttctttctcatggtatgtgatgtatcttttgccaactttttacttttaacgtacccatatcattatatttgaagtcagtttattatagatagcatatagttagttcatgttttttattcagtctgacagtatatcttttaattggtatgttttgactaatgtaattattggtatgtttggatttaggtcaacctttttattattcattttctttttcttttctttttttttttttttttggcttctattgcccattttgtgcattctttgtgttgtttgtaactttttccattacattttaatttatgtactatgaatttggacatatatatctttttttgtataattgtttttagtgattgctctaggggttgcaaaacacatacttttcagtttatttggaatcagtattttaccatttcaataagaatgtagaaacctaacctccatagagattttttttttttcctttctctccccaccggccccaccccaagagatagggtctcactctgttgccaaggctggagtgcagtggtctagtcatggctcactgcagcctcatactgctgggttcaagcaatcctaccacctcagcctcccgagtaggtcggactacaggtgcacgccacaaagcccaactaatttttttattttttgtggagacagggtctcactacattgaccagattggtctagtactgctggctggcctcaagagattctcctacctcagcctcccaaagtgctgggattataggcatgaatcaccacactcagctgaaatttctttatgtaataattgtcttatatatcttcatatgttaaaaagcccatcagacaatgtttgattgtctttcaagcgtgttttactttcaagcgtgttttaaataacttaaaaggagaatagtctattatatttatctggacctttaccgtttatcttgctgttcctctatttgtgatgtttcaggtttcctttgttatcattttcttctgtctgaaatactcaggttagcaattcttttagagcagttcagttggctatgatttatagttttctttcttctgagaatgtctttatttcacctcattgccaaggatattttcactggataaagaattctgaactgacaattgttttctgttagtgattcaaaactgttgtaccactcctttctgtcctccatggtttttggtataataatttatagtcattcaaattgtttccctacaagtaatgcatctctagctactttcaagattttttttttttttcatctgacatttacagcaaatagagtgtgatgtgccttggtatggagttctttgggtttatcctggatgggattctctgtttcttaaatctgtaggtttgactttagacaaatttgggaagttctcagctattatttcctcaaaaaaaatttttagccctgcatttcttctctcctagaccttttgttgtctcacaggttcttaaggattggctgattattttttttcaatttctttttttttctgttgttgaggttgcttttctgttttcggttcaatttctgttgattctggctgcttttaatgtttcctctgtcacctattttaagcaccttaattacgattgctttggtgtacttttcatgtttcttgtgcttgaactcactggatttttaaaatatgtgtgtttatacatttttaatcaaatttggaaagtgttcagctgttcctttaaatttaaaattttaattaaaaaattaataggctgggtgtggcagctcatgcctataatcccagcactttgggaggccaaggcgggtgtatcacctgaggtcaggagttcgagaccagcctggccaacatggtgaaaccccatctctactaaaaatacaaaaattcgctgggtgtggtggcgcacacctataatccaaggtacttgggaggctgaggcacgagaatcacttgaacccgggaggtagaggttgcggtgagccaagatcaaaccactgcattccagcctgggtgacagagtcagactctgtcttaaaaaaaaaaagaaaagaaaattaataatgttttcttgttacttttttctctttctctcaagactccaattacatttaaaatttatattagggcacttgaagttgtcccatacttcactaatgctctgttttgttgttgttgtttttcagtccttttactctgtttttgttttaggtaacttttattcctctcttcaagtttattagccttttcttctacagagtctatttttaatcccatccaatgtgtgtgtgtgtgtgtgtgtgtgtgtgtgtgtgtatgtgtatgttttaaaatctcagctgttgtccttttctcatctagaagcttgattgggttctcttttatactgcctatatatatattttaatatgcttatgtttttctgtgctttattgaatacacaaaatatagttatgattttgtttttttgctagcaaagtgtgaatccaggatttggattcatatctatctgaccgctatagttcagtggccagcaaattgtggcccattggctgaaactagcctgccacgggccaatgtgataacgctggtcatttacatatggcctctcgctgtttttatgctacaaaagcagagctgagctgtttcaacagagaccttatgtcttgaaaagccaaaaatatttactatctaacatttgtaggaaaagtttgctgagttctgctttagaggcatttttatttataaaaaacctgaagtgccagttctcatgtagcatttttaatttttgacgttcactaaacactaacagcataatattgagttttatttttataaaggcagtagagactgcagacaaggctcatatggttcaggtatgaagctgtgcaatgatctgatttggtagtgataaaatttggaaaatcttagatagtaaaatagttagcacaccccttcagtggtttttacatttagcatgtttaaggttcacctggaaagcttgttgaaacagattaaaggactctgtatcaactttcttattcagtaagttaggtgggatatgagaatatacatttctaacaagttcccaagtcatgccaatagttctgtttgggactataccttgaaaattactgctctaaccctttttaagtgtatcatttgaatttcagtagatgtataaaattgtataccagcaccacagtccggttttagaacaattccatcatactaaagagttcctcatgcacatttgcagtcaatgccaacattccccttcagcctgaggcaactagttatctttctttcactatggttttgcacttttcagaaattttatataaatggaattatatgatacatagttatatacttggaatgtttcacttaacataatatttttgagattcatctatgtcattgcatgtatcagtaactttcttttattgctaagtattatttcatagaatgagcatactacatttttttgtccattcaacattttatggacatttggattgtttctagttttggctattatgaaaaatgctattatgactattcatgttcaagagatggcatatgcttttgagcagaaggaagttataatatctagatgatattcatatattatcctatgcttgtagttgacaaaaaatgttaatatattcttgtttcctaatatatttccaataataatattttaatatttactatgaatattttatgttcttgcaatgaatatttgataattttatgtcaaaatattataaattggtatatgatagtctataaacattttgtaaaatgtttcttttgagataatcaacatactctatagatgttgatcttacaaaattaatatatctactcttattggtgggcaaaattcaccctggaataaaataagtataaaacaaataaaacttagcttttgatgttggaaatgttcagatacagataacagtagggagaattgtttaatgaaatccccatgtatccatctcacctaatttcaacaattgttaatagtttgacattcttttttaatctgtaccttgcctcccgatctattcctggtgttctatattgaatctcaaaatcatatcatttctcctggaaatacttcactatatattgcaaactgatgaggacttacgaaacaagtatgtatgtaaatttttacagcaccattaattcacctaacaaaaatagcaataatttgtaatatcatctactacccagtatatgtttagttgtccctaattgtgtgacgtatatttttcaaattgtttgattgaactaggatgaaacaagatgcaaacattgcaattgactgataacaccgttaagttaatcttaatctataatgatttctcttcccttgtttttccatgacaatgatttgttgaagaaactggttaatttgttgaagaaactggtaggatttcttatgatctgcatttacctgactgtatcttcttcatatcatttagtatatcatttatcccatgtattattaatgaagtataagtacaaaggatttagatataggactgagtatattcaggttttggcatggtttttttcctagtagcaaggatatttcttaggaagacttgtctatttcctatagcatcatagcatatctgtcactcccacttttactgatgctgtgattcatgatttgattcaggtgttgtcagcctgatgctttcattatcaagtttccctccaatcttttaccaaatggttttagcagctattgatgaatattccctagatttcctctatttcagtagaattgcaaaatggttatcttctaattccatcattccttctgcaatccttacataaaatttttctgtgaagaatgttctttcatcaactctttggttaccctgaaattcaacctttacagacaaggaaggataaatgcttgcttctttctttttattcagtttattggttttcaaaataatgagttggtgccctaggacactctaaatgtgactgagttttaaagtatcattatgaactcatggagcttatttattcaatgtgtttattaatccatttcggtcgttgttttcagtggtcaaattgttttatttttgactggtggacctctaagatttactcttgtgtcctttgatttatgctagtatttttaaaactactttattgccttttgctcaagatttcccaggctcagattatacattctgtgctccagatgttatttttttgaggagaactaattagtgggaattggaatttatagaccataatctaggtgctaggaagcttactctttctgggttgttactgttcctagatctttgaaaatttctttcacaaaggtactggatttaacacatttttcagtatatgttcatgtttttatctctaggattgtctctgtctctctctctcgatatatatatatacacacatatatatacacatatatgtgtgtatatatatttatattatatatataaatatatatattatatataaatatataaatatatttttatatattatatatttatatataaatttatatatacatttatataaatatatacatttatatatatacacatatgtgtgtgtgtgtgtgtatatatatatatatattttttttttagatgaagtcttgctcttgttccccaggctggagtgcaatggcatgatctcggctcactgcagcctccacctgccgggttcaagcaattctcctgcctcagcctcccgagtagctgggattacaggcgcctgctaccacgcctggctaatttttgcatttttagtagagatggggtttcaccacattggacaggctggtctcgagctgctgacctcatgtgatctacccgcctcggcctcccaaagtgctgggattacaggcgtgagccactgcacctggccagattgtatatatttttggcataaggaaaacagtattaacacaattcaattaagtttagcattcctttgatgaggatacattttttcccaaacattatgtatggtaggcactagtattcgatgcagttgtggtagttgctttctgggaagcaatgagacttactcttggcatctatgggatgatatgtaagaaaataaattttaatttaataaatgaaacaataaatggataaaatgcagacacagcacaaaaagggactaattaactctcttggcaggaggtgttcaaggagtgcttcacattcccaagaaaggtaacatctgtggtgggtattaaagggaggctatgatatcctttgcattgggtatacaaaagatgcaggaaagggactttcagacagaagaaaaagcatatgaaaagatatggaacaaggaacaggactgacagtttggtgctatttgtgtcaccaagaacaaagtggaaaatgacaacagatgaggcaaaatcagcaaaatctcatatgccagggtaaagagcctaggcttattctagaggcaaatgggaaacactgaaggatgttaagcagaaatatgaaatgatctaatttgctcctcagaataatcattctggtaacagtgaagaaaatggattgggagaggaaatggcaaatgtgtaagttcacttttgactttacaaattcgtgcctagaatagtgcttggcaaatagcgggcacttagtatttgttgagtgaaaaaacaaaaagttgttatatgaatcaaaaaaagtcgataagtctgaagaaaaaccacacagaaatagtgcctatttttttttgttgctactgcttgattcatctgctggcttgtttgttatcttaccataagattttcatgaacaaatcagtaagtaaaataaccgaataaaaaaaacagtcaaaggatttgaatagcaggcttacaaaagaggaagtctgaagggtaactagaaatatgaaaacatgctcaatttcactagcaacaactagatcatttaaatcccatgagatggaagaatatttaagagtttgcacaaaacccagtcttcaccagaatgttgaattggaattctcacatgctgctggtgagagtgtaagttggtgaaatcattatggaaagtggtttggctgtcagtagtcattaagttagaagatgcttatctcttttgactcagcatttccactcagatataaaccctagagaaatgcttgtacctgtacagagacatgttcagcaatgttgatcacagcattgttgattaaacaaaaaactttgaaataacataaatgtctatctgcaggagaatggataaattgtgatatatttgtacaccacatactattcagcaatgaaaatgaacaaattagagctatgtaaataaaacatgaaaaaagtttacaaagtgatatatatatatatatatatatatagcattatgttacataaagttaattatgcaaaataatattacatatatgtaataaaagatcaaaattccaatttaagaggctagttatctctgagaagggaaagcaggagggaaatgggattaggggaggttacacaggaagcttcaccctttctttaaaagaaaaaaaggtcataaacagatatagaaaaataaaaattttataaagctagataatggtcaaaaaagtatttgttatttttgtttttatatatttgaaatgttttcagtgaaaaatcctttgagcttagagaattacaaaattatccttattctcaaagtaaaatattttcctagcatctaaataattttaagagttttttattttgcagatttgactgatgaattagctcagaagttatttgatgtttcagaaataacttcagcagcaatggttcattcgttgcctacagcagttccagaatctcctagaattcatcctacaagaacacccaaaacacctcgaacacctaggttacaagatcctaacaaaacaccaagattttatcctgttgttaaagaaccaaaagccattgatgtaaaggtatacaaaacaaccaggaatataaggcttgcattttgtatcctttaacattacagaatgaaacgttttagtttctatcacattgaaaaatgtgtgttataacttgtaatatttcacttaaaaatcatactttaccatagtgatattttctctggttaggaaatttttcggttgggcacggtggtttatgcctgtaatccaacactttgggagaccgaggcaggtggatcgcttgtgcccaggagttggagacgagcctgggcaatgcagtgggaccccatctctaaaaaaatacaaaaattagatgggcgtggtggcgtgtgcctgtagtcccagctacttgggaggctgaggtggcaggattgcttgagcctgtaggggtcagggctgcagtgagccatgatcatgccactgcactccagccttggcaacagagtaagaccccatttaaaaataaacaaacaaacaaaaaccttttttacaattggatagtgtaattaaagacgaacagaaagtataatgaagaatcacactaagctgcacttcatttcatctttgtgtcacaaacctaccaaaggactttatttattaagttttgtaacttgtgtgtgagatttttgagttttgtgacttcatatgatttcacaatgtgttatctacagtatgaaaatgtttgagttcatttatagtcagagggttttaatttacttgtgaagttcacactattgaaactaattgcaatgcttgactttattttctttagagtccaagaaagagaaaaacaaggcatagcacaaatccccctctagagtgtcatgttggttgggtaatggattccagagaccgtgggccaggaacatcctctgtcaggtactatatttctcaaacattacttttttgttcgtgatttgaagttttttgaaaacagttactaattggatatttcaaaatatttaaaaattaatatgttagcaaattatagagcaatgaaaatggtacaaagaagccaaagaagagataagttttacaagtatgttaaggaaataatccagttggacagtttttttttcccatttaaattatttttcacaaatgtgaactcttagatttataagctatgtaggtctatgaaagttattatctttggaaagttcccagagtcttagtggcatttaataggttcttagtagatatttattgaggacattaatgtgctaaacaaacaactcaaactgtataaataatatggaaacgaagcattgttattttgcttttttcccccttttttgaaaatcattaagattagctgattattagcaggaatttttttttataagaaagaagaaaattaattaaaaaaagaagaagtctagagcaaatctcttagagtgccagtgatctgcaaagcactatggtatgttttgtccttcagaggggttgcagaggtgatttattgctcgttgctttgtgatgctttttttaaaataaaaatagagacagaatcttgctctgttacctaggatggtctcaaacttctggcctcaagcagtcctcctacctcagccttgtaaagtgctgggattacaggcatgagccacctcacccagcctgtgtttcttaaaaaccattttgtgtttatactagatattttcagaataattaactgatagtttttccatttgaaaactttgggaaaatatgtttttgactggttactagaaaagaaggattagttagtttcatgaaaagaaatgctagggagtttatcatgctctcaaaaccttgaaatctgtcttgttagtgatacacatttgattattttacattgttcttactagctatattgtctctaaaagataaaaagtgtgtatgttcttctgcacacctgtggtatactaatagttattttggggttataagtgatttttcagtttttttccccagagtatttctttttattggagcagtatatgtagagatcaacaacaatggaaaatgtttaatttacctaatgaaggacatcttgtctttgttgcttccaagttttgggaattatgaataaagctgctataaacatctatgtaaaggttttagtgtggacatatttttaaatcccttagataaatactaaggagcatgattgctggattgtataataagaatatatttagttttgtaagaaactgccaaactgttttccaaagtggccctatcattttgcattctcaccagtaatgtttctttttaaccttggtaatgtcttgttttgaagtcagccttgtctgatatttatataattatgccaactttctttagatgagtgtttgccagtgtatctttttctacctttttacttttaagcaatctctttgttttaaagtgggtttaatgtaggcagcatatatttgggtctttctttgctttttataacccagtctgataatgtgttgtttaattagtatgtttagaccatccacatttagtgtagttattgatgtggttggatttaaatctatcatttatttttctcatccattcttttttttttttttttcttttgagactgagtctcactctgtctcccattctggagtgcaatggcatgatcttggctcacttcaacttccggctcccaggttcaggtgaggactcaacctcctgagtagctgggattacaggtgcctggcaccacacccagctaatttttgtatttttagtagagatggggtttcaccaggttggccaggctggtctccaactgctgacctcaggtgatccacctgtcttggcctcctcaggtgctgggattacaggcatgagccacactgcgcccagctgtctcatctattcttcattcttttttctctttttctgctttcttttggattgagtttttataatgatcctattttatctctactattgacttattagttatgtctcttttttattttttactgatcctctaggatttacaggtatactttgttttgttgtgcttcatagatactgtttttcacaaagtgaaggtttgtggcacccctgtgttgagcaagtttatcaatgccctttatctaacagatgtactcaattcatgtctctgtgtcaccttttggtaattcttgcaatatttcaaactttattattattatgatgtccttttttttttttttttttttttgagacgaagtctcgctctgtcgcccaggctggagtgcaggggtgtgatctcagctcactgcaagctctgcctcctgggttcacgccattctcctgcctcagcctcctgagtagctgggactacaggtgcccgccaccacgcctggctaacttttttttttgtatttttttagtagagacggggtttcaccgtgttagccaggatggtctcaatctcctgatctcgtgatctgcccgccttggcctcccaaagtgctgggattacaggcatgagccactgcacccggccttttttttttttttttttttgagacagagtctcactctgttgcacaggctggagttctgtggcacaatcatggcccactgcaaccgtaacctcccagactcaagtgatcctcccacttcagcctcctgagtagctggaactacagttgcatgccaccatatccagctaatttttgtattttttatagagatggggtctctgctgtctgggctggtcttgaattcctggactcaagcagttctcctatctcggccttccaaagtgctgtgattacagacatgaaccaccatgcccagctactattttgtattttatggtgatctgtgattagtgatctttgatgttaactattgtaattgttttggtacaccatgaaccatgccaggataagacagtgaacttaataaatattgtatgttttctggctgctccactgactggccatttctccatctctccccctcttcttgggcatccctgtaccctgagagacaaaaatgttgaaattagaccaactaataaccctacagtggcccctaattgttcaagtgaaattaagagtcaaaattcttcaaaattaggaatgtcatcattaatgaggaaggcacgttgaaagccccaagacaggctgaaaactagatctcttgtgtcaaacagccaaaatatgaaggcaaagtttttgagggaaattaaaagtgctactccagtgaatacacaaatgataagaaagtgaaacagttttattgatgatagggatagagtttgagtggtctggataaaagatcaaaccacccccaatattcccttaagccaaagcataatccagagcaaggccctgactctcttcaattctctgaagactgaaagaggcgagggaggtgcagaagaaaagttggaagctagcagaagttggttaatgaggtttaagaagctgtctccataatataaaagtgcaaggtgaaggagcaagtgctgatggggaaggtgcagcaagttttaaggaagatctagctaagataataaaagtggctacatttctgcaggtctagatctgaaaaaaaagtgtggctaccttaaacaatagattttcagtgtagacaaaacagccttctattgggagaagaagccatctaggactttcatagttaggaaggagcagtcaatgtttggcttcagagcttcaagggatggggctgactctcttgttaggggctaatgcaggtggtgactttaagttgaaggcaatgccagggctcttttgaattatgctgaatctactaatctgcttatgctctataaatagaacaacaaagtctatgtgacagcacatctacttacaatgtgggttactaaatattttaagcccactgttaagacctactatttagaaaaaaagattcctttcaaaatattactgctcattgacagtgtacgtcatcacccaagaatgctgatgaatatatacaaggagattaatgtttttttcatacctgctaacacatttattctgcagtccatggattccaaggagtcattttaactttctagtcttattatttagaatattcatatatagtatattcataaggctatagctgccacagctagtcattcctctgttggacctgagcaaagtaaattgaaaacattctggagagtattcaccattctacatgccattaagaacattggtgattcataggaggaagtcaaaatatcaacattaacaggattttaaaagaagttgatttctaccctcatggatgactttgagaggctcagacttcagtggaggatttaattacagatgtggtggaaatagcaagagaagtagaattagaagtggagcctgaagatgtgactgaattgctgcgatctcacgataaaacctgaaaggatgaggaattgcttcttatggacgagcacagagagtagtttcttgagatagaatctactcctggtgaagattctgtgaacattgttgaaatgacaacaacagatttagaatattatataaagcagtggcagggtttgagaggactgactccaattttcaaaggagttctactgtgggtaaaatgctatcaggacagcatccatgctacagagaaaacttgggaacagaagagtcaatcaatgtagcaaatttcattgttgtcttattttaagaaattgccacagccattccaaccgtcagcaaccaccgctctgatcagtcagcagccatcagcatcgaggcaaaaccctccaccagcaaaaagactatgacttgctgaaggctcatatgaccattagcatttttagcaatacagtttttaaaaaaattgatacataacagttgtacatattttgggggtgcatgtgatattttgatacatgcatacaatgtgtaatgatcaaatcagggtaatggggatatcaatcacctcaaacatttttctttattctgttccatttttttccttttctttttaagatctttttgcataccaaccttctagctattttgtactatacaatatgttattgttaagtatggttattctactgtactataaaacactaggtctcatttctggtattaactgtatttttgtacctgttaaataactgcttttcaccgcccttccccctacccattctagtccctggtaagcactaatcaactctcttatctctatgagatctacttttttacctcccacttattagtgagaacatgtggtacttatctttctgtgcctggcttatttcatataatataatgacttccagttctatgtttctgcaaatgacataattcttttttatggctgaatagtattccattgtgtatgtgtgtatgtttatgtatgtgcctatgtatgtatgtgcatatatttacacatatatacatatatacacatatacatacatgtacatacacatatatatacccatatataaaattttcttcattcatccattgatagacacttaggttgattacatgtcttggctatagtgaatagtgctgcaataaacatggaagtgcagctgtctctttgatatactgatttcctctattttggatatatatccagcagggagatttctggatcatatggtagttctgtttttgttttttgaggaacttctattctgttttctgtagtggctgtactaatttacattcccaccaatggtgtgtgaagcattctcctttctctgcatccttgcaacatccattattttttgttttcttgataaaagccattttaactggggtgagatgctttatcattgtagttttgattttctttatcttcttgataattagtaatgttgagcactttaaaatatacctgttgtccagttgatgtcttctttggagaaatgtctattagatcttttgtcagttttaaaatgggattatttgtattgtttttttttttctactgagttgtttgagttccttgtatattctagttattagtccttttttggatggatagtttgcaaatattttctcctattctgtaggttgtctcttcactttgttgattccttcatgtgctgtgcagaaacttttttgcttgatataatctcattagtctatttttgcttttgttccttgtgcttttagcatctaacacaaaacatctttgcctagaccaatggcctagagtgttttcccaatattttcttctagtaatttcatagctttgggtcctagtttaagtctttagtccattttgattggctttttgtagagaggggtctagcttcagacttttgcattatggttatctagttttcttagccccacttatcgaagtgactgtcctttcttcaatgtatgttcttggtacctttgtcaaaaatgaattggctgataatgtgtagatttttttctaaattttctattttgttccattggtctatgtgtctgcttttacaccagtaccatgctaccttggttactatggctttgtattatattttgaagttgggtagtgtgatgcctccaggtttattctttttgcccagaattaatttgatttttcacggccttttgtggttctgtataaattttaggattttttttctatttctgtgaagaaattttgatagggatggaattaaatctgtagaagttgctgcatagtattgagattttaacaatgttaatttttccaatccatgagcatgtgctatcattccctttctttcgtgtgacctctttaatttctttcatctgtgttttttagttttctttgtagagatctttcactttggttacacttatacctagatactttatgtatttttgtagctgtcttgatttctttttcagtgtgtttgcttttggcatatataaatgctactgtttttttgtatattgattttgtattgtgcaactttactgaattgacccagatttttggtggagtctttagatttttctaaatataatatcagatcatctgcaggcaaggataatttgacttcttcttttccagtgtggatgctctttctcttgcctaattgctcttgctaggacttacagtactatgttcaattaaagtggtaaagtggacaaccttgtgttattccagatcttagaggaaaggccaagtgctcatgtctaagacaatgagaaaaacaccttgtaggcattttagagacctcccgccgcaggaccagaggcctaggaggacagaatggggccctgtgcaaccttgggaaactgctccctgcattccagctgctccagctgtagcatggctaaaaggggcccagatacagcttggggctgctgcttcagagggtgcaaaccataaaccttggcaggttccatgtggtagtaagcctgcaggtggtgcacagaatgcaagagttgaggcttgggagcctctgcctatatttcagaggatgtatggaaaatcctggatgtctagactaaagcctgctgtaggggcagagccctcatggagaacctctacaaggacagtgcagagaggaaatgtggggttggatccctcatacagactccccactggggcactgcctagtgaagctttgagaagagggccactgtcctccagaccccagaatggtagatccactagcagcctgcatcctcagcctcgaaaagccacaggcactcagtgccagcccttaagagcagccatgtgggctaaaccctggaaagccataggcatggagctgcccaaggctttgtgagcccaccccttgcaccagcataccctggatgtaacatatggagtcaaaggatattattttggaactttaagatttagtgattgcccttctgggctttggacttgcatgcagcctgtagcccctttcttttgggctatttcttccttttgtgtatttacccaaggcctatacctccattgtatcttggaagtacctaccttgtttttgattttacaggctcataggtggaagggactagccttgtctcaaatgagactttggacttttgagttaatgctagaatgagttaagactttgggggattgttgggaagacatgactagattttgcaatgtgagaaggacatgagatttggcaggggccagggtagaattatatggtttggatctatgtccccacccaaatctcatgttcaattgtaatccccagtattggaggtggggcctggtgggaggtgattggatcaccggggcagtttctcatggtttaacaccatctgccttggagttgtcattgtgatagtgagttgtgagatctggttgtttaaaagtgtgtggcacctccactgtctctcttcctcctgctccagctatgtgaagtgctgctccccctgccttccaccatgattgtaagttttcctaaggcctccctagaagctgagccagcatcatgctgtactgcctacagaaccatgagccaattaaacctctttcctctataatttacccagtctcgggtatttttttttttttttgaggcggagttttgctcttgttgcccaggctcaagtgcagtggtgtgatttcagctcactgcaacctccgcctcccgggttcaagtgattctcctgcttcagcctcctgagtagctgggattacaggcatgcaccaccatgtctgggtaatttttgtatttttagtagagatggggtttctccatgttggtcaggctggtctcgaactcccaacctcaggtcatccgcccgccttggtctcccaaagtgctgggattacaggcatgagccactgcgcctggctgggtatttctttatagtaatgtgagaacagcctaatacatctagctgaaggtttgttgattttgtttatcttttcaaaaaaccaactttttcatttcattgattttttgtacttgttttagtctcaattttatttatttctgccttgatctttattgtttctttctactaattttgggtttgatttgttcttttctagttcttttaagtacatcgttaggttgcttatttgaaacctacttttttgatgtaggcatttattgctataaaattctctcttagtactgctatgctgtatctcataggttttggaaagttacgtttccatttgcatttgtttgaagacattttgaagttttcttcttaatttctttattaatctgttgatcattcaggagcatgttgtttaatttccacgtttgtgtagattccaaaattcttcatgttattgatttctatttttattctgttgtagccagaaaagatacttgatatgattttgacttttttaaatttgttgagacatgttttgtagcctaacatatgttttatcctggagaatgttccatgtgctaatgagaagaatgtgtattctgcagtagtaggtgaaatgttctataaatgtcactaggtccagttggtctaggtgtagtttaacttcattgtatctttgttgattttctgtctggatgatctgtccattattgagagatgggtgttgaagccccctgctattatttgtattatagtctatctctcctctagatttattaatgtttacttaatatatctgggtgctccagaattgggtgcatatatttttaaattgttacagcctcttgctgaattgatcctttcctttatcatcatacagtgaccttccgtgtcctttttttttttttttttacagactttcacttgttctattttgtttgatacaagtatggctacttttttttttttttttttttttttttgcttccatttgcgtggaatgtctttttccattcttcactttcagactatgtgtgtctttataggtgatttgagtttcttgtaggcaatatatagttggatcttgtttctaaaagtttttcactcagccatgcttatatcttttggttggagaatttagttcatttacattcagtattattattgatagataaggacttactacgcagtatgtcattacttggtttctggttgttttgtaactcctcccttacttccttcttactgcctttgtttgtgattaagtggtttttctctgggagtatgttttaattcattgctttttatttttagtgtatctatcataagtctttgctttgtggttaccatgaggcttaccaaagccatagctgtaagttattttaaacatatgacaacttaactttgatcacaaagaaaaggaaagaatcaagggaaaaactaaaaaactctacacttcaactccatcctcccacattttgacattttgttgtcttaatttacatctatttatcttccctatctcttaacaggttgctgttaatattttcagtagatttgtcttttagtcttcatattagagatatgaatggattacatgtaacaattactgcattagagcattctgaatttgtctacttttaccagtgagttttataccttcaaacatttttggttttgcacatcaaagtttgttttctttcaaattaaagaactccctttagcatttctgaaaagatgggtctagtagtgatgaattcccttagcttttgtctaggaaagactttatatctccttcctgtttgaaggaaaactttgctgggtacagcatagttggttggcaggttttgtttttgtttccatttatcctgtagcactttgaatgtgtcacttaactccctcatggcctgtttggtttctgttgaaaagtctcttgccaaaaaaatcagagctcttttatatgttcttttattttttttctcttgctgttttaaggatcttctctttgtccttgacattttcaggtttgattattatttgccttgggatactcttatttggattgaatattgatatggtttggctttgtgttcccacccgtctcatctcgaattgtaattcccataatccccatgtgtcaagggagggacctggtaggaggtgattggatcatgggggcacttatcccatgccgttcttgtgatagtgagtgagttctcacaagatctgatggttttataagtgtttgacggtttctccttcacacatactctctctcacctgctgcagtgtaagggtgcctgcttcccctcccaccacgattgtaagtttcctgaagcctccccagccatgtggaactgagtcaattaaaccactttccctcataaattacccagcctcaggtattatttatagcagagtgaaaatggactaataaaaatatatttggtaatttctgaccttctgtacctagatatttatatctttctttagatttggaatgttttctgttatttctttgaataagcttactactccttgctcttaactcatcattgaatgccagtggctcttacatttgttcttttgagattattctttatatcttgcaggtgttcttcattcctttctttttctcctctgactgtattttccaataggctgtatttgagctcactgattgtttcttgcaatgtgagagcctgtaatccatttttcagaaaacgtatttctgagttccaggatttttttttttaatttcaatctctttgtgttacatttctctgataaatttaattgcttctctgtgttatcttggattttgctgagtgtctgtagaactgttattttgttcttgatctgagacctcacacattgcttttcttctccctgactccttgctttgtgcatttggggatgtcatagttccgtgtttgctgttgtttctcgtggatgtacatttgtggctttgctttaaaggatttattatttatcccagtctttgctgtcttgcttgttttgtctttctaaggtatgttttcttagagattctttgcagtagcgtgtgagttcccttaatactattgtatatcagtgcctccttttgggcactagatggcgccttaagcccaagtttgccttggctctcacaaacattggagcactgcctgtcagatggtgggggtggcaaaggggattaccccaactgtgtggtaaggctggcaaacggtttgtacccagaaaactcatggatcatacctcctacagtgtggtcctgctgaacagccactctgatatggcatctcttttggctgaaataaagaggagaatttcagggctagggtttctgttcctgcttcccctctttttctgccttcatgatttttttttctccctgctagccctcatgatattatacttcttatgggttgaggcaggaacagttttcctgcaagggaacccaagatggtgggaaagctggctgtcctcctccatctaactttttccaatgaagaagctgagtctgggaggaatttttcatgcacagggcctggcagattgcagaaaaggcatcatgcaaagagaaggctatttctcttactgtttgcttggagtttttcagttctctgtggctcacgggtactatcagcctcagatttgagttctgggatattgctgatgataagctttgtgctagatatttgtttttggctttctgtgggagagtgaagccagattgcttctactctgccattttggtgacatcattgtctcaataaagtatttttaaattaaggtatgtactttttttaagtcataatgctattgcacacttggtagagtacagtataatgtaaatataacttttatatttactgggaagccaaaatattcatgtgacttgcttttttgcaatatgtgctgttttgtggtggtctagaattgaaccagcaatatctctgagatatgcccatataattcagctgttccttgaattatgatgtggttacatcctgatgaaccctttgtagcttgaaaatatcataagttgaaaatgcatttaatacacctaacctactgaacatcatggctcagcctagcttaccttaaatgtgctcagaacacttatattaacctatagttgggcaaaatctagcacaaagcctattttataataaaatgttgaatatcttatgtaatttattgaatgctttgctgaaactgaagaacagaatggttgtatggtacttgagctatggtttttactgaatgcatattgcttttgtaccatcataaacctgaaaaaccgtaagtgaaaccatcttttaagttgaggaccagctttatacattttaacgtaccacagtctactttcaaataatcttatcccacttcatgtgtagtataagcaccttacaacattaaattttcattatttctccccatttctctgtttgtttctttgttttttttttttaaattagagacagagtctcgatctttcacccaggatagagtgcagtggcaaaatctcaggttactgcagtctcaaactcctgaacttaagcagtcctcccaccttaacctcaagtatctgggactacaggtgtgcaccacaatagctggctaatttttaaaaaaatttttgttgcgacaagatcttgctatgtaattcaggctggtcttgaactcctgggctcaagcaattctcctgccttagcctcccaaggtgttgggattaccgttatgagtcaccacacccagtcccccattctttgtgctatactttgttattatttttctttagacagttatgtgtacatgtatatacacatacatatatgtgcacatgtgcatacacacatacacacatatagtttgagtagatagtttagcacattaaatccttcatatatatctattaaaaactttctaaatgccattgagaatctgggagatttctttagtaggttcgtaatagatatttgcctgttattaatacacccacacacaaacacatacacacacctataaagtatcctgctctggttctctgatggtttcagatttatggctttttaaattgttagaataatttttgactcatcataaatttttttgccctgttttctttttttccttcttctgggtttcaaattacatatatgttagaccatttgataatacccatagctgttggatgctctgatctgctttttctcctactccttttttattttatttttttatttttatttttatttttgagacagagtttcgctctcgttgcccaggttggagtgcaatggagtgatcttggctcactgcaacccctgcctcctgggttcaaacgattctcctgcctcagcctcctgagtagctggaattacaggtgcaagccaccacgcccagctaattttttgtatttttggtagagacagggtttcaccatgttggtcaagttagtcgtgaattcctgacctcaggagatccgcctgccttggccttccaaagtgctgggattacaggcgtgagccactgcgcttggcctcttactccttttaaattgtatttcactttgtgtaattttgattgatttatattcaggtttcctgattctttccttagctgttctagtgtgctaagaagtccatcaaagaagtattcatttctgatattgtgttgtgtatattttgcattactgtttgactatttatttattgagatgcagtttcactcatgtcgcccaggctggagtgcaatggcacgatctcagctcactgcaacctccacctcctgggttcaagcgattcttctgcctcagcctcctaagtagctgggattacaggtgcccgctaccacacccggctaatttttgtattttaatagagacagggtttcaccgtgttggccaggctagccttggacccctgatgtcaggtgatccgcccacctcggcctccgaaaatgctgggattacaagtgtgagttaccgcgcccggccccatttgactttttaaaaatagttttcttggctggtcgcagtggctcacgcctgtaatcccagcactttgggaggccgaggcgggcggatcacgaggtcaggagattgagaccatcctggctaacacggtgaaaccccgtctctgctaaaaatacacaaaaattagccgggcatggtggcgggcgcctgtagtcccagctactcgggaggctgaggcaggagaatggcgtgaacccgggaggcggagcttgcagtgagccaagatctcgccactgcactccagcctgggcgacagagcaagactctgtctcaaaaaaaaaaaaaaaaaaaaaaaaaaaaagttttcttggctggatgtggtggcgctcactggtaatcccaactacttaggaggctgaggcaggagaatcgcttgaacctaggaggtggaaattgcagtgagctgggatggggccactgcactccaacctgggcaactgagtgagactccatcgcaaaaaaaaaaaagttttctttttttctgctgaaattctccatctcttcatgaatgttcatcttttacattagagtcttcaacatattaatcatggttattttaaagttcatttgtgattatgctagtactgagttatctgtaagtctggttctattcattgtctcctgaattttattttttctttttgtgtgtcttatacattttgattgaattctagattattacttctagacttttttttgttgttgaaatcttgccaaatcccagtctgaataaatccagctttctattatatttgctcctagtctactgaatgttgctaaagtaagtcctaggcttattgatagtaatatagattcatgtgctgtaattatagttagagcttcgatgttatctgcatttcttttactaatctaagtattcgatattaattttatcttcgttctttccttttgattgaggaattctttatctctcattgttccatcttttgaaaactgttttcaaatttctatttgttagtcttcattttgatctacctctttgcttccttctggctccctgtgataagtatgccagtaaggtatatttattcattgtggagaatttatttaatgatagctaccacttttatatgctttcaataaatgttccaggcactgtgctcaacattttacatgcattgtttctctatgtcttctttagacaataagttctttaatgtaaagaacttctcagtacctgtcatactttgcagtcaataaataactacatgaatgaaactactgattccatatagagacagggaagtttatagctgtaaatgcctacatttaaaaaagaaaaaagatctgaaatcggcaacctagctttatactttaaggaactagaaaaagaagagcaaactaaacccaaaatagtagagaaaatcaaggaaactaaaagttgattctttgaagagatcaacaaaattgacgaaactttagctagactgacaaagaaagagagaagatgcaaataactagaatcagaaaaacaaacaaacaaatgggatattactactggttgaccttacagagataaaaaggatatgagaatactgtgggctgggcgtggtggctcatgcctgtaatcccagcactttgtgaggctgaggcaggtggatcacaaggtcaggagttcgagaccagcttgccaatatggtgaaaccctgtctctactaaaaatacaaaaattagctgggcatggtggtgggcgcctgtagtcccagctactcaggaggctgaggcaggaaaatcacttgagcccgggaagcggatgtcacagtgagccgagatcatgtcactacacttcagcctgggcgacagagtgagagtctgtcaaaaaaaaaaaaaaaaaaagaaagaaagaaagaaaaagaaaagggaaaaaaaaaaacccaaaaattaacacccagcctgcgcaacacggtgagaccacgtctctactaaaaatccaaaaaattagccaggcatagtggtacttgcctgtagtcttagctacttgggaggctgaggtgggaggattgcctgaacccaggaggttgaagctgcagtgagccatgaccatgccactgcactccagtctgggcgacagagcaagaccctgtctcaaaaaaataaaaagtaaaaaagaattaacaccaatccttctcaaattctttcaaaaaaattgaaggaatttttgttttctgtttttttttttcggacacggagtctcactctgtcgcccaggctggagtgcagtggtgcaatctcggctcactgcaacctctaccagctataccactcttagttatatatcaaaagtattgaaaacacatattgtatgcccatgtttgtagcagcattattcatgatagccaaaaagtgggattctcaacaaaagactggataagcaagtatccaacaacaaatgattagataaacacatacaatggaatataaatattcaaccacaaaaaggaatgaaattttgatttatgctgctacatggatgagctttgaaaacattatgcttaatgaaacaaggttgacacagaaggataaatattatacgatcccacttatatggagtacctagaatagtcaaatttatagacagaaagtagaatagaggttactagggctgtagggaggggtagaggggtagtttttatttaacaggtacagtttttgatggagatgatgaaaaaattttgagtctagatagtggtgatgattacagaatattgtgattatatttaatgcctattaattatacacttatgaatagtgtttaaaatgatatatattatgttaggtatatttttaccacacatgtacacacaaaaactcctaaaattcttttttatttcattagaaaagtctttaagtattggttgtaactgtcaggctcttagtgacaaatacaagatttccaaaattttcatttttgcttgaaagctcaaattttatcattggaaaaaacagttgttttccttgacattaaaaactcatttttttatcagctgggcgcagtagcttacgcctgtaatcccagcactttgggaggccgaggcgggcagatcacgaggtcaagagattgagaccatcctggccaacatggtgaaaccccatctctactaaaaatacaaaaattagttgggtgtggtggcaggtgcctgtagtcccagctactcaggaggctgaggcaggagaatcgcttgaacccaggaggtggaggttgcagtgagccgagatggcgccactgcactccagcctggcaacagagcgacactctgtctcaaaaaaaagaaaaacaaagaaagaaaaaaaacctattttttttcattttcaaggaaatatctgagaaataataaagtctgagtaaccatagtttgtgggttgttcttttagttaaacatgaaaaaagttgctagtttgccttataacttaatcacacaagtgctttgctttaagaaaacgattgtagctttttttttttttttttttttttgagatggagttttgctcatcacctaggctggagtgcaatggcatgatctctgctcactgcaacctccgctgcccgggttcaagtgattttcctgcctcagcctcccgagtagctgggattacaggtacatgccaccacgtccagctaatttttgtattttttatagagacagggtttcaccatgttggccaggctggtctcgaactcctgacctcaggtgatccgccaacctcggcctcccaaagtgctgggattacaggcgtgaacccaccacacccagccccattgtagtttaatatgctgcaaaaatgctttgtgttttcttctcatttttaaaaaattgtaaaaaaatgtataacatgaaatttaccatcttaacagttcttaagtgtacaactcagtagtgttcagtatattcacattgttgtgaaacagatctccagaacattttcatcttgcaaaacaagcttccatttcatgtttgtcacacacaaaaagatatgtactcatgagtgagattttataattttttggctttatcaaggatatttttaagttgaaactggaattgttttattttttctaattgcaagtgcataacaatgaaggatgcagtcacaagtaagtaaagtttggtgccactgcctcaattcacatcagttttacacaccattgcttttgtaccatcagtagaaaggtcaacatagaggcaagggccaacaatgtcttcttattatgaaatcagttttgactttgtagactttctagaaggttcttaggaaccttccaacagtccacagaccactttgagaaccactgatttagataaatgttttaggaagataactttggtggcaggatagagaagggacacttggaaaaacaaagagactggttaattcaagtgaaagaagagagactggttaattcaagtgaaagaagaggaaggtctaaatttgaatttaggtctatatttgaatttgagtgcagatgagaaggaaaagacagatttaggagatagatcaaaagtggaattgatttagagaattgcaggttctgtcttacttttgatgcctttagaaaaaaagaaaattgcaggtatgtctttgagataatgaaattattgcccatctttgtgccagattttatccctaatctccatgtattcaatttacatcactaacctaaattattcaagataagttgaaagtttccacataataaaaaactaatctaaatgaaattaataatgatttggaggaggaatgagctattcagttatctgcttctgcttaaactgtgttagcttgagagtttatgaccatgctttttatcagcttctgaatttacatatgtgtattgaacataaatagcactatatgcagatctgtatgtcattaatttaggagagttttagggactactgtcttttccactgcttagacccccaataatgaaaaaaatagtacaaattggttcatatacttggttcttgatttttcattttgaaggcttttttcccctttctcaaacagcacttcaaatgcttcaccttcagaaggcgcaccactagcaggaagttatggatgtactcctcattcattcccaaagttccagcatccttctcatgaacttttgaaggaaaatggctttacccaacaagtgtaccacaagtatcgtcgaagatgcctaagtggtaagatgcttgtcctttatctatctaatatatttaaaattaaaatataattctaaaaaatttaaatgttgtcatttaatatcaggttaagatattcttttattgttagactatacatagttttactttaaacatgtttacatatattctttattcatgtactttataacttagacacattaggaaataaaaattaatatactcggctgagcatggtggctcatgccagtaatctcagcactttgggaggccgaggcatgcagatcacttgaggtcaggagtatgagaccagcctggccaacatagtgaaactccatctgtactaaaaatacaaaagttagctgggtgtgatggcaggcgcctgtaatcccagctacccaggagattgaggcaggagaattgctgggacctgggaggcagaggttgcagtgagccaaaatcgtgccattgcactccagcctgggcaacagagtgagactctgtctcaaaaaaagaaaaaaaaatttattatactcttcttgttgctattgagagatatttataatttaagcagtgagtcaaaaaatgggttagcatttgtcagctgtttcagcagtcctcaatctttttggcaccagggacctgtttcatggaagacaatttttccatgggggatggttttggataaaactgttccacctcagatcatcaggcattagattctcttaaggagtgtccagtctagatccctcacatgtgcagttcacagtagggtaccagtctgtggcctggaggttggagatccccactctatttagaagaaacctaaatacactttgaggattaatatggttgagctttcttcattttatatataacatctgctgtcttgtctttaaaaagtatgtttaataaaataatattttatttaacttttttcagagagaaaacgcttgggaattggtcagtcccaagaaatgaataccctctttcgtttctggtcctttttcctcagagatcacttcaataaaaaaatgtatgaggaatttagacaacttgcttgggaagatgcaaaagaaaattacaggtcagatattttcttttacacttcaagggagttttattattttcttcttctttttttctttacccaggtagatccgatagagggagtttttagaaaataatttttaaaactagtactgaagtagcctgattttgaaccgtgaaagtagcacaatataactagagggagacctgtattagttttctatttctgcattgcaaattaccccaaaactccataggttaaaacaataaacatttgttagttcacagcttcaaagagttgagactccagaaactgcttagctgggtggttctggcttatggtttctcatgagcttgcagccaagatgttgaagtgggctgtggtctctgaagacttggcctgggctggaggatctttttcaagctcattcacatggctcttggcaggaggcttcagttccttgccacactgaccttccctagggcattttacaatacggtttcaccctgaatgagtagagcttccaaaatggaagcctcagtattttatacaacctgcacttggaagtggcataccattatttctgccatattgtatagtccatacagaccagtcctggtacagtataggagggtactacacaaggttgttaataccaagagatgggatcattaggaaccatcttagaggctggcagaagggctgaatgaaattacaaaacttttctctcccatgctcccaccattacagacttcccttgcatgtacatatacataccccaattgatatgtgcttagagccaacccagttcttaagattctttgagaaaagaaaaagcaaggcctctcacaatatgtcctttgactcaccttgtctaattttttccccgctagtcctgtagtactctgggcaacagtgatactgaactacatattcttcaaatgaaccaagctctctagcctctggacatctgtgcatgttcttaactttgcttctacttctcttcgtcctccctgtgcttttctaaatcctattctttttgtcccagcttagaccttgcttccttcagaaatgttcatggaaagtcttgagagtgcctgtagggctgagtgagggcagacaaagagggtaagaaggaacatggcgtggactcatgaaggctatttattcatggggaaaaggagaaaggaacaagagatggagagaagggaaaaagatgatttttcattcaatcatatttacctaaacttacccttctttaagttctgaaaatggattcctcttgtaaatatcaaataagaatatattgtttaccagatattgtgatctttgagaagaatacaaggtgtgctacaaatacatttttctgattaaaatcacaaaaatttctttgtgttgacttatgtaaaaacaaagcccgtttaatttttatctgttatctatatcaggaacagcagatccatggcaggtgtacttctatttctttttcctctattactgatatctctaatcaatcccagttatgttttatgttctttcttaccacacttttaagatttatactcttccttatgactttaatagctactgccagtttaccagagttggcataaaaagcaaaatttgccattcctaatctcattgttcttattcaaactgtggtttgctacctattcgtcaattgtaaaatcaattgagtggttctaacatgctttaaaaaatacagtagaaaataccagactgcactgagcatagtaattcatacatatgaatttaattcatacccatatacatacaaatttaagaactgttttgcaaaacatatatctttttatgtacacacatatagagacatgcatattgatttagttataaggtaaaatatttttcatggtattggacctagtcagaaaagtttgaaagccattgttttaattgatctcagactattttgctatttatgcaatttctgtttgttccttaagactttctgataacttctctgattccatttccacccaagtctaggttgggagttcctcttctgtgttcctatacacatacctctgtgtatgtttctaatacctttgtaacacagtttcctacctttggttctgtttctgcagtatttaccactagactgtattagctacttcttaggaagtagtggttaagcacctgaagtccttgaaatcaggactatgtttgagttgcagccattaatttactgtggccttggcagattataatcccaccaggctttaggttctttataaaaagtaggttaagccaggcatggtggctcacacctgtaatccctgcactttgggaggccgaggcaggcagatcactgaagccaggagttcgagactagcctggccaacatggcaaaaccccgtctcttctaaaaatacaaaaattagcttggcgtggtggcctgcgcttatagctgcttgggaggctgaaacatgagaactgcttgagcctgggaggaggaggttgcagtgagccaaggttgtgctactgcacttcagtctgggtgactgaacaagactctgtctcaacaaaaaaaaaggttaaattgtgatagatactctctcatggggttattgtgaagattacacaaagcatttaaagggcttaacacattaacttatgtatagtaagtgcttgacaaatgattccctctctccctccctccctccctccctccctcttttcttttctttttcctccctccctcccttcctttctttttttctttgagacaaagtcacactgttgcctaggctggagtgcagtgtcgcgatctcggctcactgcaacctctgcctcctgggttcaagcaattcttctgcctcagcctcgtaagtagctggcatcacaggtgcccaccaccacacccggctaatttttgtatttttagtagaaatggggttttaccatattggccaggctggtcttgaacacctgacctcaagtgatccacccacctcggcctcccaaagtgctaggattacaggtgtgagccactgtggccggccagatgattattgtcattagggaattgttactaattctgtccattggttgaaagtagtaataatgtgattacaggaaggagggagagagctaacatcgcttacatctcttcaatgtgctagctctggtctagagggtttacaaatatctattttcgaaaaataggatctaattgactcaattttcagtgatataatgacaagcccatgattcaaatatagttctttctggttctaagcctctaggttttctactcctctgagctgtcttgcagttagtggtaaatgagtaaatgacaactgagaaggctgatcatttgcctttgtccttcactccagcagttatgctgtgtatttgggttgtgttattaatgtcatacttttggtctttggaatagtttgctaagaaataagagtaaaaatccaaatattgcctattcaatataaatgttgtattgtcatcctttatcaataatctaagaatttctatattcctctaaaatatgatttacttgataaaaaccaaaaacttacttctccagaaataaagagagatactgaggcttcacctcaaagattctggttttgggtacaaaaaaaaaaaatggttggaaagaatgagtaagacctactatttgatagcataatagggtgactatagtcaatggtagcttaattgtacattttaaaatggcttaaagaggccaggcgtggtggctcatgcctgtaatcccagcactttgggagaccgaggtaggtggatcacatgacattaggagttcaagaccagcctggccaacatggtgaaaccccatctctactaaaaatacaaaaattagccagacgtggtggcaggcgcctgtaatcccagctacttgggaggctgaggcaggagaatcacttgaacccaggaggtggaggttgcagtgagccgagatcgcaccactacactccatcctgggcaacaagagtaaaactctgtctcaaaaaaaaaaaaattaaaattaaaaaataaataaataaaatggcttaaagagtataattgaattgtttgtaactcaaaggataaatgcttgaggggatggatactccattcccaatgatatgcttatctcacattgcatgcctgtatcaaaacatgtcatgtgccccataaatatatgcacccactgtgtacccacaaaaattttaaaaattaaaaaaaaagatcctgattccattggtttggagcagagcctgggcatcagtatttttaaaagctccccagatgattataatgtgtagctaagattgagaacaactgatgtcggtatatgatcccataagaggaacatcaaagcaagtttgtcattctgaactgtggttcctttagtctttgatctccttagacttcagtcatgcaagctcaaccagtagcatcacttaaggctatgggagccaagggctcaggttgctgtataagtgtgtagttggcagtcctgcatttctcttgttggcttgccagaccatcactcttcgtcttgtaaataagctggttgcaaaagagacacacaatcacataccctgcttcctgtgactgacagccagttaatattatgttagcagaatgaagaggttgtaacctttctgctgaggtacccagaatgacttaggattctaacttaggagtgttttaattgtggtatcttttagttgagtcagctagacaaggtctttttgctgccatcttacagccttgtttcactctcatgggttctgctcatcacctgtggttgaaggttgagcctatatagtttgctgatctactgagcagaactcctagattctcaagatagttatagacagaaacaaggaaatttgttttctcatttacgtagtgattatagctctattagcaatatatctactattaattgtactttataatgaaagcagggaggctctcttaaccatttaattatgtttgtaccattatagttgaatgggacagccacacctgggatctagggcacagccgtacagtctttatcttcctagagtaaagcttacattcaagagtatttatttaatgctgtgtacaaagataccattataaattttggtttggggaaaatctaacacatccccaatttatcactaaatcttttggccagttcttcagaaataccagggagagataatgtgtgcatctaaagaggtcatactgaactgtccaagggctgcctttcatgcagcaggttctcagtataccttcatgatgtgctacggctgagtcaacaaaaatagcaaagccagctgtagattactaattaccagttcagttaaaaatctgcataccggccgggcgcagtgactcacacctgtaatcccagcactttgggaggccgaggcagatggatcccctgaggccaggagtttgagaccagcctggccaacatggtgaaaccccgtctctactaaaaatacaaaaaattagctggatgtggtggtgggcacctgtaatcccagctactcgggaggctgaggcaggagaatagcttgaaccagggaggcggaggttgcagtgagccgaggtcgcaccattgcactccagcctgagcaacaagagtgagactctgtctcaaaaataattaaaaaatctgaatgctaaaattttattttttgtttaggattagttgtgccatgtttgcttatattgatgttactaactatagagatattgtattttattataaaccttttattttctctttataggtatgggttagaatgtctgttcaggttttatagttatggactggaaaaaaaattcaggcgagaaatttttcaggatttccaagaagaaaccaaaaaagactacgaatctggtaacaataacatcagaaaacttgtactctaattggaaattgtaaacctgagtctgtcagtaaatagggaaggagttcatagtttttttcttcagggcaaaccatttaagatcttcatgctattgttgtgtttcttgatgaaggatggggcaccaggtagtaagaaggcctttcctgggaggtgttggaaagtaactactctcaagtctttcttttatggaggtatattttgtcattatccctttgacaaacgtggctactcactgatgttccgttacatgaaaattctatgcaacatcagcaggtaagcttggaaaggcagaaatagcacagtggttaagagtgcaggctctgggacagactgctaggtgcaaattccctttccactatttagaagctatgtgattgtgggtaaattgcctacccttgctagcctcagttttctcatctgtaacatatatgagaacacccatcttttgggttgtatatggttcaaattagtttgatgcataataaagcacttaatgcttgttacataacaaatgctcaataaatattagctgccattattggttaattcattacatgtcttattctcaagatctagagtaagcatatattggaagataaattgtttattgctgataggattatatttaatgtgaataatttttaaaatttcatataattcataatgtatattattctttgttattaggtcagctgtatggactagaaaagttttgggcttatttgaaatattctcaatctaagacacagtctattgacccaaaacttcaggaatacctctgtagttttaagaggttagaagacttccgtgttgatgtaagttttaagtcatttcctctattctttttattatccatatatttcagtctcttatcagtgactttttaagctttaattttgtaatttttattttttaactttttagttttaaaattaaactttgaaatagatataaaaatagttcagagaattcccatatactctgttcactcagatttcgcaaatgttaacatcttgtataaccacagtgcaattgttaattcaatttaattttcatatgctgctataattaaacattttctagatttattaatttttacctgatatgctaatttgtcactagcaatgtgaaaacttttcactttttaatgatcttttatccatataattcctgtaacatgtgctgatatggatttagggtacctgcataataaaattaaggagagaatgttgtgtgcatgtgtgcaagcacaagagtggtgtcttttagttgagtcagccagacaaggtccttttgctgccatcttacaacgatgtccactctcatgcgttcttctcatcacctttggtggaaggttgaacttatataggctttatccatttgatttcaagaggaaaagaaaagcattaaaaaatgtcacgaatgtaagaagatagaggaaaaggaggaagaagataaataaaaaataaaggaaaaagcctgggtgtggtggctcacacctgtaattccagcactttgggaggccgaggcgggtggatcacctgatgccaggagttcaagaccagcctggtcaacatggcaaaactctgtctctactaaaaatacaaaaattagctgggtgtgatggtgcacgtgtgtaatccctgctactcaggaggctgaggcacaagaattgcttgaacctgggaggtggaggttgcagtgggcagagattgtgccactgcactccagcctaggcaacagaatgagactctgtctcaaaaaaaaaaaaaaaagggaagaagaaaaattttaaatttaaaaataggaaagaagtaaaaggaaggctaggttcatcatctctgctttgtgttgtaatttgtcttgcagttttgtgtaaatggacttgatgacccagggatagggttaataaaagtgcctgtctctggaattaagagctatttttctagagtggcctagccagttctgtcacaaagacatccttgctctatatttgagactcttgccccatctgaacataagctaagaattcaggcctccttctttaagtacaacggaagattggatgaggaggttactatcttagtttagctccacataaaaatactagttcattggtgtccagttctgggctcccaaatcttggtaactggaaaggcataaaaagctgactttttttgaatgcaggataccttttcactgggtacttaaacgtttgaagatgtttaaatttggtgccatcaataatattctccagtctcatcataggaattctagataaaccttcaaacttgctaacgataatttaacttggcatctcttttattcccctactgctttcatttatctgttatttaaacattttcacttaagcaagcctggaataggagtttaggattgagaaagagactggaaatacaaatcctttacagttgatgaaattaataaagaaggcaaatagcctcgctgaaacattttcttggagccaaggaacccagccttatagttatgccccatcagatagctcaggccctaaaaaatgagagaagcttagtaaacatgtgttgaggccaggcatggtggctcatgcctgtaatctcagcactttgggaggccgaggcgggtggatcgcctgagcttaggagtttgagaccacccagggcaacatggtgaaaccccgtctctactaaaaatacgaaaaaattaactgggtgtggtggcttgcgcctctactcccagctacttgggaggctgaggcaggagaatcgcttgaaccccaaaggcaaagattccagtgagccgatgtggcaccactgcacatcagcttgggctacagagtgagactctgtctcaaaacaaaaacaaaaaacaagcaaacaaaaaaaacactcgggctacagagtgagactccgtctcaaaaacaaaaaacaaaaaccacaaacatatgttgagtaaaagaatgagcaaatactagtaggctgatttagttaggaaggaaatttaagtttagtaccttaagttgctgttaagtttttgttatactaatacaatctgtgaggcggaagaatggcgtgaacccgggaggcggagcttgcagtgacccgagatcgcgccactgcactccagcctgggtgacagaatgagactccatcaaaaaaaaaaaaaaaaaaaaaaattatactgaagtgtccatttaacttacttttttggggaaaagtctagccttagattctgaagggaggaaaaacagtaaaattgtcaacggtgttgcctttcatcatttgcagccccctattagtgatgaatttggaagaaaaagacattcctctacttctggtgaggagagtaatcgtcatagacttccacctaattcctctacaaagccaccaaatgctgctaaacctacatctaccagtgagcttcaggtaccaataaactctcccagaaggaatatttcaccggagtccagtgacaattcacattaaacagtgctgcctgtgtcctgtggtctcaagaaatggtgaaatgcctgagaaatagactcttatgaaagttctttgtccttgaagtcaacatttacatcagtatttatttggggaaaatcttctggtgtttaattgtgataataagaaagaagaaaaagaaagaaaagtggtagcattttttctaacaagataaattctaaaaatgttttccctgatttcacaaacaaggatagtcttggtgaccttttatagagatcttctagtaatgtattttgatctcagatttctttttcaaagccatggttttacaaaaacagcattccttaaatatatttaaaaaacaatacaaggaatgcctaacatttcagctcatacttcttaaagaagatatagtatgttgtattctcttcttagagctttcttaaagaatccacaatccaattaccccactgtcaattcatatttgaacttaccaaaacaaaggaggattacgtatatgttttttaaattcaaaaaagaatatgaaattatacctttagtatccctttgagacatatagtttaaagaaaactttttttaaaacaaaagtaggaatatatagtaagattgtagttacaatgagtatatgcacttttgatgctaggttttgcttttctccccccagtcatatctcatgatttccacagttgttgtattggtgtggagttttctgaattggctataagctgattacatattagaggtttatttttatgattctatataaacgtgcacgagtaatttaaaacctgcattgggattgattggaatattgtcctaaattaattaaatcttgcactgttttgaatgcatctgctatttatacatctgcaagtgggtatgtcataaggagtcagattatctttaatttaaaatgaatacttagttttacctttttgtttattttttgtttaattttgtttttataaatgttttcaagagttatagcaaattgatttctaatttttattgctattacaactgatgtaaatggtagtttcagtttttgtgagatttaaaaaaataaagcacttattctgaa

SEQ ID NO: 83 - DNA, 19593 bp, Homo sapiens
tgaagttgaggaattatctacagaacactgtttatttcaagtccaaaacacaaattactcatttttcttaacagaccgcataattttttctgcatgaatatttagggtttctctattcacaagtacagtttattactagactttaggcttgaatgattcatatatatagatatcagtttactacagaggacatgtacttttaacattttttgtttagaaaatattttacataaaaacacaaagcatttaccaacactccacaaccagtcttcagcaaagatttggctgaagataactttctacaaaacactccaagactgaatagaatgtagtattttacatactttagcttattgttgcagttaaaagctcccccttgtttgatggcttctgcatgtatctacaaagcagaagtcttaactggtgacctgttaaataacattgcctttttaagtgaacttgtccccagcccggaacctaagtagtcataatgaaataaagtaattgatatatgaggggcttttagtaagggctttttcaacctaataaaataataatttagtatctatcagtgcaatattcttttactgttttgtgttcaataaccacctggagtgctaattgtctagtataatcagttggcatcaaaatagaaagtaaaaagatgtacatttaatataccaattcttacctgaataatcttggatttctggagaatgttccacaaagtggaatttcttcctaaagttatgctgaatgtggtacaatgtgtacaacttggttaaccagtgcctgcttttcatttccaagatttttccttatcttgaatcaaatgcacaatcttacaactgtatcataatgcactggcttacagttctgtatataaagtccaactcaagcttattttggtttattgtacatgctttattaaaatggtacttgtatttacagtatctgcagaaagagtcccttccaaggcctcacacattcagacacatccatactgacacccactccacagccccatgcacccacaccagtgagatgtggagggtcagactcctaaaattaggcagctgttggggataagagttgatttgtttttcaatttttttgaaaacagaaaagcatgggggaatgcatttggccattacaatgctaattgagtttgtgtatattacatatatggcagttaacactgtaatattccttttacattctatatacacagaatgatatcaaggttttatggtcaacagaatattccaacttcagtcttaatgctgcttgtagtgatttctgaattcattataggggctttccctaaaaataattcaagtctatgttaagtgaaataaggcacaattaatattgatttgatttagggaaagggaaggaaagagaagggataaaaactggtttcaaatgatctttctgttggggaactagctctgacttaaacccacctgaaattccttctcctaatttccaaagatttctttataaagatatttttcttttccctgacaaagccaaaaagaaaagtttgggaattcacattttaatgtttcagtagcctgaacaactcaaattgatgtgtacccccacctcccctgatcaggtcgcctccctcacccatgttaaaataaaaacacagtatgtgacacaggagtcccttgatgtttcttgaggagatctgtacacttgagtagcaaatacatatctggttgtcttcaatatattttaaaaagaaagaaagagaaagaagaaaggaaagaaggaaaaaaggaaggaaagaagtaatattgtgactttcttgctctttaaaaaaatccctgtctccttcttttcaggatgatgaagccccactagacattacaaacaactgcaacaaatgagtttggcagcataaataatgtctagttattcaaatcttcatagtgagattaatttatcttgtacacaatttgttgaatgtttttcgcagcaggtgaatcaaacccaaagactccggacagtctgtgaaagggagtaagaattgcagttctgaaggcccctgactttggttgtttacaaagttcaatcctgtttattgtgatccttggtatcttcttcatctgtatattctgatggttcttctcctggttttaggagtctgcctacataatcatatttttctgaaagatacatcaaaagaaaatcagtggtgatcaaatttgtttcactattccattatacagagaaaaggcatttgtctgttttagaatcatataaaatatgattattagaatattatctaaatattctaaaattgcttcaccatggctggtctttatacacatgtaaagcctgaacaaaagaaaacaggattagggaacttataaggcttgggaattctttgcaagagggtgttctgtaccagtgattcttagttggatactgcatcagaatcacttggagatcttttttaaaaatgagtaagtccaggacccatctcagtacccagctaaaccagaacagctgttccaagggacccaggggtcagataaacagctgggacagcatcacacaagtggtaaaaactgatgttatgagggcataagaaaggggaaagatattttttatctacatttcgagtgttaagatctgtaaaatcattttggaataaattatagtattgaaatcagtaatcaactcagttttaaatataagcctgtatttttaaaaaactaaaccttaatgaagaagctgactgtaagtatcacaatttttgaggcttagaatttgtaacaagtcatttttttaaatattgattttcaaaataattatcacatgtaacaatcatatttttatttagctattttttgcaatttctttttttggacaagtctcactatgttgcccaggttagtccttgaactcctgagctcaagggattcccatcagcagctaggaccacaggcatgtgccacttcacccagctttagctatctttaaaaatattatcaaataatgatggcaatgaaaacggatgacatccttaggctcttaaagcatgtaaaatagtatatattttctttgaacaaatatttaattttccaaagaatccaacaaaataaaaatacctttaaactgcatttcccattctcgaacactctccatttgtactgcattcaaatctgagagatcatcatattcatctctaagtgcatctttatctaggcaaaatgtggccagtcctctggaggcatccctaccagcaaatattccatatggacccgctggaaaaaagaaaataaattatttagatcacctaacaatattttagaatgtctcaaaggaaaaagtaaaaaaaaaaaaaaaaaaacacaacaaagaaaaaaacccctcataattcacatttgtatatacccttaatttcaaaacatgtacagatactagatggaataagaaaagaaatttgttggaaatctgccttttgacccaagtaaagcttttcacttagatcttaaaaccctcaatttcaattacttcagatatccccaaacttaatattcaaaatgaagactgtgaggtaatgagggagaagaagaaacttaagtggttaggtttagaagccagtctgcttgaggggaaataatgtttactggttgctgttaatagtggcatcaaaaaaataaaaataatcaacagaacatcatgtattatgtaaagactcagctgaacttgaatctgtaacatttttctttctgctatccttatgaaggttgtaattctatgagaaaagagactgtatcatctttgtggtcccagtgactagttcagtgctcaacacgcatttaataaatctttgctgagtggtttaataaaaaaagacccatattcaaaataaatcatctgactaccataatatatatacaatgatctatataaactaggaaaagtcattaaggaaaataatagctcttacttgtcatgacttttggaaaacagaggaagtagctataaggaataattcttctggactgacacattaagcaataattagcattttatccaaggaattgggtaccattctctctgaggagaaatggcatgactgatgtgttgacaaaaaccattcccaaggtttgtccttgagaacagcaatttgttcatcaattgaggatttgtatcctcaatgcctagcactgtgcctggcataaagtaggaacgtaataattttcttccaaatgacttagctgtagttccgaataaaaagaaactcaagattctgtaaacagattcacttatggtaggcaaagacactattatgaacaacaacaacagagtggtgaaaaacagggcttataaataaaagaacaaagtatgttctgataagtaaacaagcagaaaaaactagaaattccttgatttttaaatgagcgaaatgattatattcatatataaaagtatttaggaaactgaaagttatgtgtcaaaaagtctctgtaccttctgagagtagaaatcgaggtttcacttaaatagatatctaagcatttatgagtattaatttgagttgctaacagcactgtactataaagttaaccagatgtgaaattcattctctgaaaagtttactgcatggaactagaagtagcattagcaataattttaagagtagcattcataggtattgatacagtaacatgaaagtaaagctaacagttccagtaaagtacatttgtattctgcttttcttattcttattgcattttccatattgctacatcgtatcacatgactatcaacaattatttatcattgaatggttatatattatcccactgaatggatgtgtacctgtaatttatttaatcagtcttattaacataggctaccattttatactttcaaatgtgtcttctatataagaatatggaacacaatttaccactggccaatattcgtaaccttcaaactttttctatcatctcaactgacattcaaaagggtattaaccaggccaggtgcggtggctcatgcctgtaatcccaactctgtggcagcagtgttgaggtcagcagtttgagaccagcctggccaacatggtgaaacctcatctctactaaaactacaaaaattagccggctgtggtggcgcacgcctgtaatcccagctactcaggagtctgaggcaggagaattgcttgaatccaggagacggaggttgcagtgagttgagatcatgccactgcactacggcctggccgagaaagcaagactccttctccaaagaaaaaaaaaaaaaaaaaaaaaaggtattaaccagttatgtctgtgtgtgtacatgcacatgtgcgtgcaaaattctacacactttgtggcaatgggtgttttcaggaggacaaggagagagacagagacagagaactagtgtgtttaaaaataaaaatttctaagaaacaatgataaaaaaaatctataaacattatatttacccttaatgctgactagaccaatgcttataaacttaaaaaagcaaaaagtgaaacatacaaaaggaaaaataaaactaataaaggccataacaatctacaaatggaaaattataggttcaatttttaaaagaattttccagcaacctcacttttctctctcagagtttcccaaagtggaagggacagactgccttccccatttggcagataaaaaacaggagcggaggcattcagtgtgatttgcctaaaattactgacagaactgagagtactatttccactttcctaaatcctccagtgtacctcaagaaaacacatagaagactcacaagcccaaagatggagtaacgaccatgaaaactggagcattttactacttacaaaatttcaagggaatgaaaattttagaatacttattaaatcaaaatggaagagaattaacaaaaaagctctacttaatagcttttctaagcattctattatagtatttatctccatggcctgcaaacattaatctacttcaggcacttcagagtataagccataaaacacatttaaatgatacaaaggagagaagataaaatcattataaaaacagcaatcagaaagccctccatctttgagtatattaatatataccagtgcattctctattaatttctctaccaacttccctaagaaagcttcaacactgaatgaataataataataaaaaatttcataaaatatgctctttctggggtactgggggtagggaatgattgacttggtaagagtgaacttgagtcaacagttaataatccaagccaaattccagacaaatgatgttctgttgactcttgaatagaaaagaataattcagtgattaacatattcccccactccctaaactatattaagctgtcttctccatatgtttagaatttccctcaggaagcatttaacttctgcaaaggtctttttagtaataattttctatgctctttcctgtaagaccattaaaaaaattttttttgttgttttttgagacagggtcttactctgtcacccaggctggagtacagcggctcaatcatatttcactgtggcctctacttcctgggctcaagtaatcctcctgccctaacctcccaaatagctgggactagaagcatggcccaccaggcctgcataatttcttttattttttgtagagacaaggtctccctatgttgcccagctgatcttgaactcctggcctcaagcaatcctcctgcctttgcctcccaaagtgttagaattacaggcctaagccaccatgcccagccttctgtaaggccattaaagaatataacattaggaactaaagttggaactggatgggttattctgaggaaggatttgatgtctaataaaaggagatttccctgcattcataatacaaccaggagcttatctgaaaagtcagcaataccttcccattccgttatccccttacataaaaaacctaaatatttaccaattctaatatttggtaagtatacttggctattcataatactaaaacaatagggagctccccaaataaagccaatttgaaatggtttaagtctgttgcatggtataatttatttatttgtattagtatttttttttgagacagagtcacactctgtggtgtgatctcaactcactgcaacctctgcctcctaggtttaagtgattctcctgcctcactcagcctcccaagtagctgggattattgggtgtggcaccacgcccagctaatttttatatttttggtagagagggggtttcaccatatatggtggacaggctggtcttgaactcctgacctcaggtgatccgcctacctcaacctcccacagtgctgggattacaggcatgagccactgtgcccagcctaatttatttttaaaaaggctagtttacatgatctggttattttttattattaaggctcatttagacactaacagttcagtagtaactagaagaattaaattctgttgctttatcaaatattaaaatataatgctgatccaaaaacagcctcccaattttaagcaaattcgtgctacaaaaaatgaacagcattattcagtcaaagcaaatactctgaaatatacttacataacaaatattcaaggacatcattttaaagataaattttatttcaaagctattgttaaatataccaacaagaggcaggcggatcacgaggtcaggagatcgtgaccatcctggccaacgtggtgaaacccagtatctactaaaaaatacaaaaaattagtcgggcatggtagtgggcacctgtagtcccagctacttgggaggctgaggcaggagaatggcgtgaacctgggaggcagagcttgcagtgagctgagatctcgccactgcacaccagcctaggcgacagagcgagactccatctcaaaacaaacaaacaaacaaacaaacaaacaaacaaaacaaacccaacatgaagtactatactagtcagaattcagatttcatttagttttcagtgtcaatccaacttgtggtcaagatattttaaagttcaataaacctatttgttaccgtatcctaaaactgcttactttaatacaatcagttagaatgaggtgacatattcttgaaacagcaacaacatatgctcattgtaaaatgttttaaatattaatttaataaacagaaaattccaggaggaagtaaatatgtagtaacagataattttgtgattattaggatgattatatagctaccttagtgtttctaaagggatattttaattattctcacagtttaaaaaccatatctctcagagatgaactttaattaattaaagtttatcaacagtgcagttttcaggcctgttttgacaataatcttttgtgattataaattgagtaactaataacacttagtattgggtaatttatttcaaataagattataatcagcctatcaacaaatgaggcaatatgtaaaagtgattaactgaactaataaatttttttatgcttaggtccagtaagtcccaagacttttagagagaatgcagtatggtaaaactgaaataatacctctcaagaagacagatacttgggttctagaggatccactcacaatcaacaagtctcgatttccatagtccttagatccctcaaatataaattaggaaaattattttacctgcctgaagttgagaccaaactaaataatctcttgaatagtatgattctataagtgactgaaagtgcaatcttgcttctgaaatttgagctactgtcaaaagcgctcagcaacattgtgaactgagcatatggccttaactccagggtgcatgggtaggctggggtaaagaaaagacagaaaaattaaaagcccaggcccgtgccacttatgggagtggggcctgagtttatgcaacccatgcagaatgaaaattccaaggtgaaaaaatagtatgaactcaaatatctataagaattaatgaacactaaagataatacttcaagtattaggaaaaagggattattcccctgttggggaaacatgttgggacaactagataaccttctgttaaaaaacacaaccccttgggaggccaaggcgggtagatcacgaggtcaggagtttgagaccaacctggccaagatggtgaaaccctgtctcttatactaaaaatataaaaattagccgggcacggtggtgggcgcctgtaatcccggttactcaagaggctgaggcaggagaatcgcttgaacccgggatacgcaggttgcagtgagccgagatggcgccactgcactctagcctgggtgacagagcaagattccttctcaaaaacaaacaaacacccaccaccccaccaaatttggactctaatttcacatcttaaagcaaaatcaatttcaaatggaactaaaaaactgagaccacagaagtactaaaaaaactacagatttttaaaaacaattttaagtgcataaagtctttaaatataatacataacttagcagctataaaagaaaagataaatttgaatacataaaaccaaaactttgtgtggttcaaaaaaacaccataaataagtaaaaggacaaactagaaaaaatatttgcggcaaaggctgatttactttataaagaacacctaaaatctgtacgatcaatatgatgattgaaaaactgcagcagggctgggcgcagtggctcatgcctgtaatctcagcactttgggaggctgaggtgggcggattgcccgaggtcaggagttcgagaccagactgaccaacatggagaaaccccgtctctactaaaaatacaaaattagctgggtgtcgtggcgcatgcctgcaatcccagctactcgggaggctgaggcaggagaatcgcttgaacccagcaggcagaggttgcagtgagccgagattgcatcattgcactccagcctgggcaacaagagtgaaactctgtctcaaaaaaaaaaaaagagaaaaactgtggcaaaggatatatgaataaacaatttgtagaaaaggcatcataaatgactcaactttttaaaaagaagtccaacctcattaagtaaatgagaaatgtaaatttaaacaaatattgagataccattttaacctctcaagagtgacaaagaccaagaagcttaataccacgtttttggcaagaagtgagaaacaggcattttcatcaagtgtaaattggtccaacctctctgaagggcagtttagaaacaagaatccaaattaaaaatatccataccccaagcctcggtaattttatttccaggaatttactttataatcataattttacacacatgtgtaaaatgacatgtacatatttattgcagcatcatgcaataacaggagactgaaaacaaatgttaacagtggactgttaaattatgacttattcataaaatagaatattatgcatgtattcaaaagaataagatggctctctatactgatgtcaaaggctcttgtgatattaaaatattgtgaagggtatgcatagtatactataattagtgtggggggaaaggaagatatccacatgcttgtacttgcacccaaaatagctctagaacaatacgtagactggtgctttgctgctatggaagggaacatggtggctgggactagttgtgggaagtagacttatttttcactgtatatccttttgaattttctattttgagcatgtattacttaatttaaaaaatcattgttttaacttacgtgaggccctattttgcaacatacccaaagcactttacctctttcacaacttagggctcatggaattttacaggaaatactccaaaattaaaaaaagtaactactgaagataataagttcacaataaaaaatataaactacatgaagaaacaaaccatcatggaggagtgggcacatataacagatacagaagcagattaaagaactaaagtaaatttgcttaaaattattaagaaatggtacaaaaggaaagattaagagacattaagaatagaatgaaaacctaatgtatatctattaacagttccagaggaaggaacagagataatggaagaggcaataagtaacagcaaattttctgggaaaaaaaaaaaaaaaaaaaaaaggacaatatatccacagacttgagtagagtttggtacatggtaaataaaatcaaatccatacctggacaaatcctagtaaaatagcaaaaccccaaagacaaaaagatctcaactacaaccaaaaggaagaaaaagattaataaaagtaaagagaaactacaagccgactcctcaccaacaagtggaagacagtggcataacgctactcaagagttgaggtataataaggtcaatttacatttttttttgagacagggtcttgctctgtcacccaggttgagtgcagtggtgttatcaaggctcattgatcttctgggctcaagcgatcttaatacctcagactcttgagtagctggggccacaggtgcatgtcactatgcctagctaattttttatatttttgtaagagacagagtctcgccatattgcccaggctagtcttgaactgctgggctcaagcagtcctcccaccttggtctcccaaaaatggtaggattataggcatgagccactgcgcctggcccaatctacaattttatattctaaacccaaactattattcctgagtgaggaaaaataaaaaattttttcctgccagtgaaaaactataggacacacctcactaaaataaaaagtgaaccccaaagaaatgagatgcaagaaacaacagtgaattaaaaaaatgataaccatgttagtaaatttaaacaaggactatattaaaaagataataatttcatcaattttggggtggagtttgaaaaaacaaagtgaagctaaagtctaatagtgatactgtggaaaacaggatgggggaggaatcagagttaaagctttctaaccagggcctcaacatatgactatgtacaacgcaggggatactatccatatttgtagtcatggcagttttgcttatttattaagaaataatctgtcaaatgtcagtaaagtatcttaaagaggcagctttttcaaattgacactaaaatgatgtttggctaaaattcttatattgttcagaagcataggatagtcatctatagcaaaaacttaaggaaatcactaaaaggatagaaatagaatacatccaaatcagtagaggagagaaaatggaagaaataaaaaaatcaatcagagaaggaaaaatagtgggaaaagaggcaaagaaaagtaaggtgaagagaaatcacaaaataagatgatagaaataaacctaaatatacccgtaatcacaaaacatatacactaattaagctattaaaggacatagtgctaatattaaatgaaaaaatccagctatatgtcattaatgtgagaaaaataaaacaacacagattgactaaaagggatggaaaatgaaatattgtgttaatactaatcagataaaggctgaagtaaaatctgaaaatcaacagtgttaaagaggtttctagtatgatcagttctagatctactgctagatggctttgctcggtatagaaagcatagtaacaatctcacttcagaacattctcatacccaatctttgtatggctggctctgttaggtttttgcttaaatgtcgagccctttttctcgagaatctaacataaaaaaggtaaccttgcttagccacttaatctaaataaagtcctttgttaccctctattcccattctattaatttcttttatagcatattacagattataattacatactgaaatccttgtttactgcctctcttccttaatagactattaactccatgaggataggaacacatctgttttgaagactcagttaactccatttctcatctcttaagcttttactgtaatgaaatccagggaagtcttcctcagtatttaaaaatggagctgaaatcctattattaaagatcctgagactggatataggctccaaaagaatacaggagttatacagtcatgtctgtcttgggtgcacagggaaaggagtggtctatgtcagagtgttgaaaaaacaattaaaagaacttgaatggctaattccagatgttattaaatctactcctttcttccaccctgaataacagcttctggtttcaagctatccttttataatatgctttaggatttaacacaaatacgattccctcaaagattaaaaacaacgggatgatgttgaattcagagccaactaagtagttataatagaaataactagtagaaatttgagcagaatataaaaaatcatcagaaaacctagctaatccttttatcttactggtaggtaatagatgcatatgggcattagcccaaacaacaaagccagttggcttcaaagcaagaagctgggatgagaggtgggcagtggcaactttaggacatccatgaagaaataggtaagattgggtccagtttttatgatgcaactctgcaaacacagagtttccaattctgcaaactaaagtgttaaataaaagtgaacaaattgaagataaagtttaaaatggaggaaaaacacttcaaggtacatgtgttcttttccccaacctcctaaatattaggcatctcatggggttcttcttacgtgacttttttctttcagtggaatttaaaaggtaagttggaaaaaatatagctttggtatatgtcaaagaatactccacctggaataagggagcagcagtattgcaaggttcaacaacgcaaaataaactatcaaaaagtcaagtgtataattttttgccattccaaaaaaataaaagcactgttttggtaaagttccattgcagtaatattaaataaaattgttaaaaattatactagctgtttgagtcttcaaaacttatgattctgtaaacatgtgaaactgaatagactatgttgtaatacaatgggaaggattgaagctatgaaaatctggatttaatttttagtgttgccacctactagatatgtggctttgggcaatctcatagggctgtttgaaaattagcgatactaagctcaataaatggagtttcctccttctcctcctctgacctttagaatcagtgttgttttcaacaactctctgggaagacagaaatactctaagaggtgccttgttagtgcagtaggtggcacgccagtctcacaatatgaaaatatacaaagtgcactgtccaaaatggtagccatggtgggctcagcactttatatgtggctagtgttactaaggaactcaatttttaattatatctaattttaattaatttacttttaattagccacctggggccaccattttgggcagtataacataaagccataaaagcattttttttttttttttgagacagagtctcgttctgtcatccaggctggagtgcaatggcgagatctcagctcactgcaacctccacctcctaggttcaagtgattctcttgcctcagcctccccagtagctgggattacaggcacccaccatcaagctcagctaatttttttttgtatttttgtagaaacagggtttggccatgttggccaggctggtcccgaactcctgacctcaggtgatctgcccgccttggtctctcaaagtgctgggattaaggcatgagccaccgtgcctggcctttatttttttatttttatttttttttttttagtagagatggggtttcaccatgttggacagtctggtctcaaactcctgacctcaagtgatccgcttgcctcagcctcccaaagtgctgggattacacgcgtgagccaccgtgcctggccgaaaggcatgttttttttgaggctttaaatccttggatttatgggaaccagggaagagtataaagaaaaacaacagtaagattctctacaagtttatcacaggatgcagtttactagaaatagtatagataagctgtgtggtaatatccatctggatttattagacatacatgtaatccaagccaatttacctaaaatacctagacctcagactccccacctgtagagcaggaatacttaccaacttcactgaggaattatggagataaaaaaattaatggatctgatattgtgggtgcttaacgaatctggttttctttctcctcctgtattcagttttttacatgaccaaactttcctcacctgctggccaagtgcctgatctgttactaaatttaatattggcaaatacagttaatgccaactgtttgccaaaatgtgtatactccaccaaattacactgtcaatatttaattaagagcctgaactttaaaaatgtatgactaaaaataaacacatgtttagcattatggaaaaatctcacaaaatttaatcctaaaaccattattgtgaaattagggtagatattggctaggcatagaaactaacaattactgcttctgaattattctgctacaaaactgcttaatttatgaggatgaaaataaaaattaaaagcaaaactgaacttgtatctgttttatagccagaaatttggctttaagattttttgaaaagtactacttattacattttctattaatatgcaatatcaacatattctaagcccataaaatgatctggctttctttaaggttcctttcaataataaaatattcaaatatctgttatgttgttgatcaactgtagaatactaactgtatatcactcttaggctgttcaacagaacctaggaactggcagaaactaatctaaaactgacttctccattgtaatctcaagagcctccctcagtgcacataccataaaaaagcaatctaccacctatgactcttaatttttaatttttttttataccgagtctctctctgtcgcccaggctggagtgcaatggcgcaatctcggctcactgcaacccccacctcccgggttccagcaactctccctgcctccgcctcccgagtagctgggattacaggcacccgccaccacgtctagctgattttcttgtatttttagtagagacgaggttttgttatattggccaggctggtttcgaactcctgacctctggtgatccacccgcctcggcctcccaaagcactgggattacaggcatgaaccaccacgcctggctttaatttttaatttctatcacagaacaaacgtttgccactggaggctgccaaactgtttctatgactgtctctcttagctattttcagatactgccaaggcataatgtgtgaggactaatacgattctttgtactaatactttgttttcttcagtggcagttcagacagggtacaaaagctgatcttttagctgggtaaggtctatattaaaaatttaaacctgtacaggatttctaatcacttaacacattttaataccaatgggggaaaagcttgaactaggtataaaatgctgtctaaatccttgatttaaaaaaaatttacttcgcttggcctgtttaaatactgtactttggccctgttctcttgtcccacgtgtgcttaagtaaacaaaaatgtattaaccatttcagttgatataagtaggcagacaccttgtgttcacatttatgtaaccagaagcaaaaactctgtaagctatgtatttacttggttggattaaatgtgtatatatacacagaagtacaaacaactaagaaataaattacataattcaacaccaaaaatctcctatttcttatccctattccaatgaacaaactacaaaccaaagcacttctaaaatatcttccagctatcaagcactgaaatcagaagtatatatttttaagtgtcaataaatcttatacacctacagattaaattaaggagaaaaccagcttacttccagactgccaaccctatgactttaaggcttggaggtactctctccaataacaggtcactttaggtctctaatttaattatttattcttattgtagtcaccacttttttttaaagcttagtattaatcagtgcacaaccaggatgcacaatgttgctcaactgtatgatataccaacaggttccatgagtctggggtttattaacataatccaaaatgtatgctacaaccacactgtaaaaaaagggcgtctaaatcaactaccctacacaaagttccctgaaaacaaagttctctcaaaacaaagttctaaaaatctttaacttgcataactggcacatgggggtataaatctacaactcttctaagttttttctccttagttctgctaagtgaaaacacaagtcattatcaacgtgtacttgaaaagagaaaaaaaaagaaaaaagaaaccagagacacgcctgctgggtataggagctccacccccaaaactcaaggtgaatatccttaccagtctttaataagctctgcattctggtctgttctcatcccacataccttgttaatcatggaaagcaactccgaactaaaactggtttaaagagagtccgaggtgttgcttatacgtctggacttcagagactggagggttgggactttacatgcccctaaacgtggccttacggagtaatacagcgagggaaaaaaggagatcagtggcaaaaaaaaaaaaaaagggggcaaggaaaagaaaacggtgaattacagagcccaaaactttagtttaggtcccaacttcagaaatctcccttccctggtgccccatccatcccaggaatcaggagactcaaaaaaggttaagggccagcgttgacctgtgacaactaaaacgattttgaaaaatccagccaaagaaacaaaaaaaaaaggctgcgaggagaaatgggatggaagaaagatgaatgctgagagctggtctctggggcgccaccggggaccctggtttcgggggaagaactggaggtgcccgtagctgcggggggacggtgtgtgtgtaggggcgggatgggccgtcccaggtgcggcggccgaggcgcgggggtcccggagacgagaaggctgggcaaactaacccggtgcccagaggcctccctgtccgaagggggttgtgcttcagctgcagggggtccttcccctccccttccaactcctcacccgggccgtagaacttgctgcctttggtcacgtcgaagactttcccattgaccgcgagcaggatgcgcgggttgcgggagccgtcgtactggcgcagctgctccaagctgaagtcccgcttcttcatgcgaggcagagaggtggcggggctctcctcgcccgccccggccccggcccccagaccccgccgcccccagcgcacccacagccggtaggcccccagcagcaccagagccaccagcgccacgttcagcagcatttccccgccccccgtcagaagcgccaacgccgccgccgcccagcctcccccttccgctgccgctcccgcgtcgcctggactctcgctgccgccgtcgttgctgctctcgctgccactccccagggtgcctagcttcacgtccccatcaccagccgccatcactgcccgccagcgccttcctcctcctccccgccccctgccctccccaaccccacggccggccccgcccatctgggggcctctcagccaataacgtgagaagagggggcggggtcaggccggctcctgattgggtgttgacggggtaacgttgtctcggatctcccgccccctcccttctttcgctggccgcgcacgcgtgcaacgccccgcccacctcgccccacacttccctgctctcactccaagcctccgctaggttaagtagacgagccgggcgggtctgaagaaaagatgctacgacggccgcgcggacgctcatgggcggggcgagaccacagcgcgtgcgcgggctcctgagcgccacgcgctcgcctttcgttcgtaacccctgcgggaggcacgccccgcccagtctccaggctctgcgcgtgcgccctggaatcgcttcccttcctaggcctgcgttcgcgtccgcaaactcccgcctccttgcgctccccccgcccgggagcttcacgtgcgccttggcggccgcgggggcaggtccgggctggacgcctggcggaggacgcgggcaggtggcttgtgggaggctggggcatagttgagctgcaaggcgcaaaccgatgaggggcgtctgcttttcaccagggcgccgtcgcttttgtcgggaaaccggcagcgtaggcgcgcagaccgggaagcggcaagaagatttggccacgagctggggtcttcctggaacggagagaaagcacggaacccgcaccgggcttctctggcatcggcagtctacgtgctcctcgcgctggcaccgagcagccactccccgctgggtttggcaaaggctgctcttgtagaattttaaaggatttagagtctcattattccttgaatcataacttctgcggccgtagggaagtggacaggttgaggtggtctttctattcgtcattcactcttatttgcaggttctgtttcatgtacttggacgtcttttagcctctcacaccttgaaattctagtgtgaaaaagt

SEQ ID NO: 84 - DNA, 44751 bp, Homo sapiens
tgatattcaatatagcatctttattaccacagaaactcatttatgtccttaatcattgtttaatataatatataagcatgtttaacacaaacatatcaaggatcgggctggaatcttttccattctatagaaaagcactaaccatccattaaagcaggtagctactttcagagcatgatatgagctgcaaaaaattgccctgacttatgccgcccccaacacaaccactcaccatatctaaaattacacccttgaagacattcattgtggttatggtagcatctaacaaagctgttcctattccagatattcggactgagaattccacaataaatttgagatacactcagttaaataaaaatgtctttactaaatctttggcaaactgatcatgtatactttgaattcctcaaaagtagatttttattttattttatttgagactgagtttcactcttgttgcccaggttggagtgcaatggcaaaatctcagctcactgcaatctccatttcctgggttcaagcaattctcctgcctcagcctcccaagtagctgggattacaggtgcaagccaccacgcccagctaattttgtatttttagtagagacagggtttcaccatgttggccaggctggtctcaaactcctgacctcaagtgatctgctcgccttggcctcccaaaatgttgggattacaggcgtgagccaccgtgcctggccaaaagtagatgttttatgttttgcttcatttgcctattttcccaagaaatctttttttcaaataccatcgagaattaatattccttgaagcaaacttctggagaatgttgaatttaggggtcaaacacaggctttctggaggtatttggtgcttgggaaaagaaacactgacctattagcaaagatagattttgtaataaattctaaataaactttatttagaattgtgaaaaatagaatcttcataatgaaggtggtctagaatttgctttcagaaactatcttcatctaatttttattaggattattttaccttgcagaattaattggtaaaatctttaggattatctattccttaaagtttttataagtatcagattttttaaacagggagttcacacacacacacacacacacacattttttgttaatctatttgggttatacggtgagttaattgtaaaacatattccttttgggggaaaaatgcaatcctacatttttacttgtactggaatgaatatacacgtttgtgcatgtgtgcatgtatagttttaccatattatgtttattatttttgagacaggttctcactctgtcacccaggctggagtgcagtggcgtgatcttggttcaccgcaacctctgcctcctgggttcaagcaattctcctgcctcaggctccccagtagcttagattacaggtgcccgccaccatgacaggctaatttttgtatttttagtagagatggggttttgctatgttggtcaggctggtctcgaactcctgacttcaagtgatccacccacctcggcctcccaaagtgctggggttacaggtgtgagccactgtgcccggcctagttttgccttataattttaaaaatctgcttgatataatctagagttgtgtctcttttatcatcattaatactctaaatgtattatctttcattttctcttccttgattataactgccaaaatctaatcactattaacattgaatcaagtctaatattctccattctcttaatttctactttctactgttacttggctgttcctttttttttttttttttttttgacagactcttgctctgttacccaggctggagtgcagtggcgcgatctcaactcaccacaaactccgcctcctggattcaagtgattctcctgccttagcctcccaagtagctgggattacaggcatgcaccaccatgcctggctaattttgtatctttaatagagatggggtttctcagtgttggtcaggctggtctcaaaatcccgacctcaggtgatccacctgccatggcctcccaaagtgctgggattacaggcatgagccaccgcacctggccacttggctgttctttacttgggttggttttattttgttgtttcctttttcttgacggaaatacttattcattccctcaacacattcatctgtgtgacaggcctggtgttgctgctgtgggtaagtgaagaagatgaagactgtatccacaaataagatttccttaccacattacagggcattaatttgtcactgaacagaactttgattatatctgacaaggttagatgtgcaggcatctcactgtcattcatttctacatagtctataattttggttttgattttaaacattttattattgaaatttcaaacacatacaaaagtagaaatattagaacaataagtctccatgaacaaaacactccacttaaattatcaacatgttgccaatttagtttccagctctctttgccaattatttcttttgctagaatattttaatccaaatgtgtctatcttcatttcatagtatgtatctcatatcatacgatcttttattttttataatcacactgacataatccctaaccaaattaatatatgtaaatatcatttaatatttagtccatgtccacacttccctcactgtctccaaaatggctttttatgttttgttcaaaccaggtccaagtaatgccaacatactgaatttagttgatatgtctctttaagtctcttttaatctgttaatggttgcccttccccttgtattttcatgctacctgttagttgaagaaatcaggtaatttgctctgtagaatttcacacattctggatctgtttggcttcttccttgtggtgccctttatagccagccctccatatgtgcagattcaaccaatctcaaatagaaaatactcaaaaaaaaacaataaaaataaaatacaataaaaataatgcaaattgaaaaatacagtataacaactatttacatagtatttacattgtgataggtataagtgatctaaagataatttaaagtatacaggaagatgtgagtaggtaatatgcaaatacatactatgccattttatacaagggacttgagcatcctcagattttaccatcagtggaggatcctggaaccaattccccatggataccaagggatgaccatatactgttcatctagtccctgtctgctttcagttcattattccagcaataaggctttgtagatggtggtgtggacttcctattgcattacgtcaggaagtgtgttgtctgatagacccatttttattaaggttaaaacagatcaaagggttcagaggtggccagtttgatagatccaccataaaaatctcgctataaaatatttcacctattagttgtagtacccattgaagatcatgttttctggacccattattccattaaggtctagaaaatggtgatttttctaatcctctaattccttctagatttattagacttcttcaaaaaagaaaaacccattcaaaaaacaaattttttttttgagacagggtctcactctgtcacccaggctggagtgcagtggcacgatctcagctcactgcaaactctgcctcttgggttcaagtgatcctcccacctcagcctgggactacaggtgtgtgccaccatgcctggctaaattttgtatttttagtacagacagggtttcaccatgttaaccaggttggtctcaaactcctggcctcaagtgatccacccaccttgtcctcccaaagtgctgggattacaggtgtgacccctgtgccaggccaaattcatttgaatttgatgaacttctggtgaccctgaaatttggttcacatgggaaaaggaaactaaatgacaatttttcctctgatttattgatttcaagaataatgagttgggctgggtgtggtggctcatacctgtaaccccagcacctttggaggccaaggagggaggatcacttgagcccagaagttcaagaccagcctgggcaacatagtgagaccctttctctaaaaaaaaaaaaaaaatttaggtggaagaatcacttgagcccaggaggaacagggtacagtgaactgtgcttgtaccactgcactccagcctgggggacaaagtgacaccctgtctcaaaaaaattatacattggtgctctagcatctttcataggttaccaaattatgcagccacaatcaagtaaactatcaaattattggtgggatcacatcaaaaactcaacttgaaacaactcctactggttgaagatatggcattttgagcatccaaaagtatactgacttatagaatgatgttttgtttctttcccacaggagttttatacacacacataaatatacacaacaatattaaattcctaggtggttaatttcttttaagccacatttttgatagtttctaattaattttaaactgtggtcagacaacagggattgtaagccttttgctttctggaattatgggaaaatcatttcctatttccctctaattcttcaacagctgtattactagtgacctcacattcatgaaattcatttttggcatgaaatttctaatgcagctcaagtgctgaagaacttcctacattcactacaatctaaattttacctagaataaattatgtttaataatttctgagaggtgacaggaggcatttctacatttattatgtctacagatcttccttttacgtgaattcactaatactaatgacaataataacaattacagataatatttacagaatacatgctatatgactgtgattcctccaagtattaactacttactccttgcaacaatcctattccacagtgtggcaggctgactctaaacaggccccccagtggtcctgtctccaggacttattcacactcttgtatcatcccgttctcttgagtgtggactatcctagtaacttacttctaccagtagaaggtgagggaatgttacttccatgattagattacacaagatggtaacttccatcttgctagcagactgtcctcccttttggcttgcatgccttgatgaagcaagcagccatgttgatgaggctattgtggccaggagctgcagtcagcgttcagccaacagccagctagaaactgagaatctcaatgcaacaggcctcacggaaatacattgggtaacaactatgttagtctggatgtggatccttccccagttgagccttcagatgagacctcagccctggctgaaatctgtagccttgcaagagaccctgaagcagaggacccaactaagtcatgcctatactcctgatccaaattataagatataattatatgttattttatgctactaagtctgtggtaatttattacgcagcaataaataactaatacatataagtactattattaccattttacaagtcagcaaaatgaggcacagaagcttagtatcttgtccaataaatcaaactggtaatcaagtggagaaagggagataatgacagataaggctaaagattttcctacattcattacattattctctcataggaatttgctgaagataaaccatgtttaaatggtgttggaaggcttttaaatcaacatattctttctctaatataaaatttattatgcttggaattgagcatgaaacacattttctcaaaaatgaattttctgatgttctgtaacatcatatacatttgaaggctttcttctattaaattccattatgaatcttctgatgctgagtaaggtgtgaatgctgtctaaaggccttcttacactccttacacttgtagggcttctcaccagtatgaattctctggtgttgagtaagaaatgaataaagtctaaaagccttaccacattccttacattcataaggtttctcaccagtgtgaatactctgatgttgggtaagttgtgagagcagtctaaaaggttttctacattccttacattcataaggtttctcaccagtgtgaatactttgatgctgagtaagttgtgagagcagtctaaaggcctttccacactcttcacattcatagggtctctcaccaatatgaatgctctggtgtgaaataagctgtgagtaactactaaaggtcttccaacattccatacattcatagggtttctcacgagtatgtattctctgatggcgaactagttgttgtcttaatctaaaagtcttcccacattccttacattcgtagggtttctcaccagtatgaatactctgatgaacagtaagttgttggcatattctaaaagcctttccacactccttacattcatagggtttctcaccaaaatgaattttctgatgtactctaaggtctggaccacatacgaaggctttcccacattccttacattcatagagcttttcagcagtatgaagtctctgatggcgtgtaaggtgtgtacactgtctaaaggtctttccacagtccttacattcatagggtttctcaccagtgtgaattctctgatgtcgagccagttgctgatgtactctaaaggcctttccacattccttacattcatagggtttttcacccgtatgaagtctctgatgttgagtaagttcttggagcactgtaaaggccttcccacactccttacattcatagggtttctcaccggtgtgaagtttgtgatgtcgaataagatgtgcacgctgtctaaaggcctgcccacattccttacacttataaggtttctcaccagtatgaattctcaggtgttgactaagtgttgagcgacgaataaaggtcttcctacactccttacactcatacaccttttctccattatgaacgatctgatactcagtaagaaaattgtgccttttgtaagtggtcattttttcagaggtaattttcacttgcccaaaatatccctcttgttgttccttttccccctcaatcttgcttttgcattcccaatcattcctaaaaatggaaccctgaaggctatagcttttaattctttccattatatcccactgaaatgaatatatttcataaatgtccttttctggagataaagtattggtcctgtatctggactccaaatctgaaagaaaacaagaaagcaaatacatactgttttcctgttccagaaagaaaaaacaaacaaacaaaaaaaccacttctatagagaaaaggcacctaaaataatgcctgttacaaattgaatggattagacagatctcaaacatagacatttctgccacaatcttatatatgtgtacctaaaaaaccttatcttctacaaaagtacacactaaaaattactgtgttcagaagaaaaataggcccggagcaggaccacttaattttttttttttctttggagatggagtctcgctctgttgcccaggctggagtgcagtagtgcgatcccggctcactgaaagctccgcctcccgggttcacgccattctcctgcctcagcctcccaagtagctgggactaccggcacctgccaccacgcccggctaatttttttttgtattttttagtagggacggggtttcaccgtgttagccaggatggtatcgatctcctgacctcgtgatccacccacctcggcctcccaaagtgctgggattacaggagtgagccactgcgcccggcgaggaccacttcattctatgcctttttttttttttttttttttttgagacacagtcttgctctgtcacccaggctggagtgcagtggcacaatctcggctcactgcaacctctgcctcctgggttcaagcaattctcctgcctcagccctcctagtagctgggattacaggcacacacccccaagcccggctaatatttttgtgtgtatttttagtagagacagggtttcaccatgttggccagactggtctcgaactcctgacctcaggtgatccgcccgcctcagccttccaaagtgctgggattacaggtgtgagccaccatgcccagccaattctatgcatctttaatcagtagaacactaacaaataaaatagttgacatctaaagggataaaccaaaagacacctcagcacttcatgtgtattaaaatgcacaaaaataaagagacaatgctagacttcaggtcctgagacactgtacatgaaaataaagcccagagccagtgaggacatcattaaggtgggagtaaggtaaagtgcagcctgtctttagataagaggccatgcaaggttgatggtatattcctctggggagggagacctgggtgcagacatttattattaattttcttaaaacgggtgaaagggctcctgataataaagcatcatgtagaaggcctttgtctttcctactgaacattataaatatacctccactaagctagctccactggactagaaaaattactcataagccaatcatctacattatacacaattcttttgccactattctgctaatgtgtaccatgggacagattgcactctcatcattttgaaaaagggaaacacagcaaataaagagtccaggagtgcaggcagggctggtgattaggaaagcaagtcaaatcagtgaagccctgttttaagtgtggataagaatcacctagagatttgtttaaactatgcagaggtgtttttaactgactgaaaccatctataggacaaagtcctgggcaagtaattgttttgttcttgtttatattcttcaagaaattattgggatgctgatcaatatttgagtctctctgtttaaatgttttcaatgctatctctttaccattataataaaatataaatacctgagcataaataataaagctgctgcttgtcaacaaatatcttctcccatttgttctctctgttcatagcatactggcctctttcaacgcacaaaatgccccacaactgttccaaataaataggactcttcacaggctgctccttctttgaggaatcctctgacactgcatggttggctggttttcattctcagcctcaaatcaaaatcacttcttcacaaaggctagtcctgctggccctatttaagtctatgcactttacgcttgtcttactccattttctgttgcttataatgaagtatctgaaaatggataatttataaagaaaaggaatgtattattattatttctactctactctgacggattaaggagtttatttcttaacaattatgggggctgagaactccaaagttgagggactgcatctggtgagagccttcttgctggtgacaaccctgcagagtcccaaggcagcgcacagaccatcaatgggtaatgggggctgagtgtgctagctcaggtgtctcttttgcttcttacgaagccatgtgtcccactcccataataactcattaatccattaagccatgaaagcccttgtgacccattcacccctcatagatcccacccattggggattaagtttcaacatgagttttggaggagacaaacattcaaaccacactctcttagcacactctttctcttttctttgtttttttgagatggagtttcttgttgcccaggctggagtgcagtggcacaatctcagctcactgcaacctctgcctcctgggttcaagtaattctcctgcctcaacctccccagtagctgggattacaggcacccaccaccaggctcggctaatttttctgtatttttagtagagacggggtttcaccatgttggccaggctggtctcgaactcctgacctcagatgatctgcccgcctcggcctcccaaagtgctgagattacagtgtgagacactgcacctggccatgcacattctttttcatatttataacactttctccaatttttgaatcatatgtttattaattttctcatattattctgttagtttagttagtctgttagttaagtgttatccttgaactacccccagggcagaaacaatctctattatcaccattaattagcaaatcccaaatacataatagatattaccagtttaattctcataattatataatcattaattaataggtatatctgcctctaatctttataccagaggtccccaacccccaggccacagaccagtccatggtctgttgggaaccgggctgcacagcagaaggtgagcagcaggtgagcgagcatgaccgcctgagctcggcctcctgtcagatcagcggtgactagattctcataggagcgtgaaccttattgtgaactgtgtatgcgagggatctaggttgcacactccttatgagaatctactgcctgattatctgaggtggaacagtttcatcccaaaaccacgtaccattttctcccgccccagtccatggaaacattgtcttccacaaaactggtccctggtgtcaaaaaggtagggactgctactttataccatattataatgatttacttatctctgctagaatttatactatgacttatcaatgctacacttactcaaacttttgttggccgggcactgtggttcacacctataatcccagcactttgggaggccgagggggcagatcacctgaggtcgggagttcgagaacagcctgacccacttggagagaaaccccatctctactaaaaatacaaaattagctgagcgttttggcaaatgcctgtaatcttagctactcgggaggctgaggcaggaaaattgcttgaatctgggaggcggaggttggggtgagccaagattgtgccattgcactccagcgtgagcaacaagagtgaaactccatctcaaacaaaacaaaacttttgttccttcatatcctccccatgtgtggtcctatccattcccatgtagccaacgcaactaaagtattttttttcaatcatgctaacattgaaaggcttatgaaatcctgagcaaaaggtcatggtaaatgtcaagtacagcagaatgactatcaaaaatggaagggcatctggggtcacctgaatgcaacagagtaaaaataaaggctatgttggatgtgggcttgaagatcatgatccagatggcgtactttcatgaagaaaatcgaaaatgctgaatgaagtaagcaaagacatgggttgagatggtataggaaaggaggagaatttttttctgtgactacagtataaatgtgtaaaactggtgaaatgacccaaagaatagtttgtgatcactgcaagacaaaataggaaaaaacaaaatcatgaaaccaaaagacatcttcacttcagattttaaaactctttcctaaatatagaacagtaatattgaaaaatacattatagagaacctatgaaatatagctacagatctcagaagaaattttatagatacatttaaattcttagagcaatagaaatgaaggaaaatatatgagtatcccacacaaaagttagaaaaagaacaacaaagtatactgaggaacaaagaatgaagaaatagattaaaatgaaagcagaatttcattaattagataacagaaatgaaagacatataaaaaatccaggttggccaggcacgatgactcatgcctgtaaacccagcactttgggaggctgaggctggaggattgcttgagcccaggagttcaagaccagtctgggcaacatggcaaaaccctatctctacaaaaaattagccaggcatggtggtgcttgcttatagtcccagctactcgaaagactgagggaaagaggatcgtctgagcccgggaggcgggcattgcaatgagccatgattatgccactgcctgggtgacagagcgacaacctgtctcaaaacaaacaaaaaacccaggttgtttggaaaacaaaaacaaaaacaaaacaaaaaaacaaaaaacaaaaacaaaatcagtggaacataaccattagctaagataataagagaaaaaggaaagcattcaaacaaaataaaaaatggccactagctattcagtgacaactccccatagagctctcactttttttttttgagacagagtcttgctctgtcgccaggctggagtgtagtgtggcgcagtctcagctcactgcaacctctgcctcccgggttcaagtgatcctcctgcctcagcctcctgagtaggtgggactacaggtgtttctaccatgcccagctaattttttgtatttttagtggaaacggggtttcaccatgttggccaggatggtcttgatctattgacctcgtgatccacctgcctcagcctcccaaagtgctgggattacaggcgtaagccactgcgcccagccgctctcacattttttgtacatcttgttggcagaagcactacctacctttgttctgggatatcttttcaagaatgtttctatactataacaaacagccttgcaaggtagagataacgtctctgtctggatcaataggcaggttcgcttgcttgttcaggataataaaggtaatgtctccttccaagctaaggctacgtacacttattgcccacgatgaatgatttgggttcttcaagctcagtgttccttttctataaggcagctcactgcatgctcaggaactatctagacccatccttatcagcctcatgtgacttgcaggcaaggaggaactgctggctgtgctgagagcaatcaaatcctttgtctttgactgagagcatgtgtttcctgccagcatccatgacactacggcaagctaacttgtcagcttgcaagtagggtgaagttgtagaaataatatagttcttgacacatgtaaataactaacaaaacagaatattttgaaaattataagggactactatgacaaccaaggctaattactaacaaagtatagaaaaagtattcaaggctgggcgcaatggctcacgtctgtaatcccagcactttgggaggccgaggagggtggattgcttgaggtcaggagttcgagaccagcctggccaatatggtgaaacctcatctctacaaaaactacaaaaattagccaggtgtgctggaaggcgcctatagtcccagttactcgggaggctggggcaggaaatgacttgaacccaggaggcagaggttgcaatgagccgagatcacgccactgcactatagcctgggtgacagagtgaggctccatctcaaaaaaaacaaagaaaagaaagaaaaagaaaaagtaatcaaagacccactccaaaaattattttgaagattatcaaaacttgagaaagcactcaattatatttaaagtggcccagaacattttataaagcctaatactccaagttatctttgagtataaaaatgaaatcaggctgtgcgcagtggctcacgcctgtcaatccagctctttgggaggccaaggcaggcagatcacctgaggtcgggagtttgagaccagcctggccaacatggtgaaactgtcatactaaaaacacaaaaattagctgggtgtggtggcacgtgcctgtaaccctagctactcgggaggctgaggcaggagaacctcttgaacccgggaggtggaggttgaggtgagccaatatcatgccactgcactccagcctgggcaacagagtgagaaaaaaaaaagtcttctttctctttgcccacacatattcccttagaaaagtcaatttctaatggctttctttggtcaccagatagtcacatagaataggcaaagcctacagaacagaaaaataagtaattgggtgccatgtaataatactacagggatttgaattaaggattgacatttcattttaaatgaaattgtgtaactggcttttaagtacattttaaaaggattgggtaggtacttgggtcgatacttctgtttgaggtgttcaagccacaaatatacaaatatatagctatcactgataaacctgggaagctgacccctttaggctaagttggccttcatgagatcagaatgcccagcacctgtgtatcagggtaacaccagctgactccttgatatagaggttctggaggatgtcttaccaggacagtcagggaagtcaggattttgtttgtttgtttggagatgaagtctcactctgtcacccaggctggagtgcagtggcacaatcttggctcactgcaacctccgcctcctggattcaagcgattctcctgcctcagcctcccaagtagctgggattacaggtatgcaccaccatgccctgctaatttttgtatttttggtagagacggtttcatcatgtttagccaggctggtcttgaactccagagtcaggatttgaccccgcctgtgctgcaaccttctgggacctcctgtaggaagtgctatacctgctttggaagaagcagctctcagaggaaataacaccaatgggttcctccccaagagatcccagaaaccagaggtggaacttaagctggcttgtattttttttatcaatgctctgactctgtatctcagtggaaaattctattcaacaagaagaggagggctgggcacagtggctcacacctgtaatcccagcactttgggaggccgaggtgggcagatcgcctgaggtcaggagttcgagaccagcctggccaacgtggtgaaaccccatctctactaaaaatacaaaaaattagccgggtgtagtgccacatgcctgtaattccagctacttgggaagctgaggcaggagaatcacttgaacccaggagaggcggaggtttcagtgagccgagattatgccattgcattccagcctgggctataagaggggaactctgtctcaaaaaaaaaaacaaaaaaaaaaaaacaaaaaaaaaaaaacaggaagaacataatttctcctctagaactaaaaaatatttgtattttatcagaataatataccagtttaattaataattcccttaacgccctttgaaaatgtgaatttacaggctgggcacagtggctcacgcctgtaatcccagcactctgggaggctgaggtgggtagatcacctgagctcaggagtttgagcccagcctgggcaacatggcaaaaccccatctctactaaacatacaaaaaattagccaggcgtggtggtgtgcacctataatcccagctacttaggaggctgaggcaggagtatcacttgaacctcaggaggcagaggccacagtgagccaagatggcaccactgcactccagcctgggtcgcagagcaagactctgtctcaaaacaaaaaaaaaatatatatatatataatatatatataatatatactatgtatattatctataaatattaaaatgaaaatgaaaaatctaatggacagctttaacaacagcttagacttagcacaagagaagactagtgaatagagacatggatttgaagaagatttcaaggttgaaaggaataaaaaagaacaatagataggctgggcgtggtggctcacacctgtaatcccaacactttaggaggccaaggcgggcagactgctttgaactcaaactccacaagtttgagaccagcatggccagcatggtgaaaccctgtctctactaaaaatacacacacaaaaaagtagctgggtgtggtggtgcttgagcccgggaagtggagtctgcagtgagctgagattgtgccactgcaccccagcctggaaaacagagccacactctgtctcaaaaaaacaaaacaaacaaaaaaaaaaaacagaaaagaacataaaagatacatgggacaatgttaaagtgtctaacatatgtgtaactcacacagagaaaagaacaaaaatgagaaacaaacactatctgaagatatagtaaccagaattttcccaaactgacaaaagacatcaaacccaagatttaaaaaaattcctagctgagcctagtgactcaggcctgtaatctcaacaatttgggaagccaaggagggaaaactacttgaggctaggagttcaagaccatcctgggcaacatagggagacccccatctctaaaaaaatacaaaagttcactgggtgtggtggtgtgcacctgtggtccaagctacttgggaggctgaggtgggaggatcacttgagcccaggagggtgaggctgccgtgagctgaaatcatgccactgcactccaacctgggcatccaagcaagatcctgtctttaaaaaaccaaaaaaaaacaaaaaacagcttcctaaatacttcaagcagatgacaacacaatatccaccacactacaaaactacaccacaatataattgggatttttacatttcactgcaatataaaattaggcacaccacagtaatctgttaaaaaaaaatccaaaagcagctaacgggaaaaaatacctctaaaacaatatctctgaaggagttacaatataagtgacaaactactactcaatggaaataatgaaagccagaagacaaggaggggatatttgctaagagaaaataactgccaactcagaattctattctccacaaaaataaagacaaaattttgtaccctttaaaaattaagacgtaataaagatattttctaataaaacctaagataatttattgccagtggacacaataaaataaatactaagtaagttctttgggtacacagaaaatggttccagataaaagcaatgcaatgcagaaaataataaggagcactgtaaaaggtaaatgtgtgggcaaatgtaaaaaaaattcactacttattacaataagaaattaatgccctgtggggattaaaatgtggaattaagatacatgacaacagagctgggtacagtggctcaggcctgtaatcccagcactttgggaggctgaggtgggcggatcacctgggatcaggagttcaagaccagcctggccaacatggcgaaaccccgtctctactaaaaactacaaaaattagccggcatggtggtgcatgcctgtagtcccagctactctagaggccgaggtgggagaattgcttgaacccaggaggcagaggttgcagtgagccaggatcccaccactgcactccagcctaggcaacagagcaagactgcatatcacaaaaagaaaaaaaaaggcatatgacaacaaatgcacaaaaaactgaggacacataaaaggaattaaaatactattaagggttgcgtacagtggcttacgcctgtaatcacagtactttgggaggctgagacaggaggatcatctgagaccaagagtttgagaccagcctggccaacacagtgagacccccatctctaaaataaaacaaattagccgggcatggtggtgtgtacccgtagtcctacctacccaagaggctgaagtaggagaattgcttgagcccaggagtttgaggttgcagtgagctatgatcacaccactgcactccagcctgggtgatgcagtgagaccttgtctctaaaaataaatgaatacattttttaaagattctattaagatccggccgggtgtggtggctcacgcctgtaatcccagcactttgggaggccgaggcgggtggatcacaaggtcaggatatcgagaccatcctggctaacatggtgaaaccccgtctctactaaaaatacaaaaaaattagcggggcgtggtggtgagcgcctgtagtcccagctactcgggaggctgaggcaggagaacggcgtgaactcgggaggcagagcttgcagcgagccgagatcgtgccactgcactccattctgggcaacggagccagactctgtctcaaaaaaaaaaaaattctattaagatccctacaattttgaacaagatataaagaagctaatttcagattcaatgcaataagtaaataatgtacttgttattgtctaaggcaaccacaagaagaaaaataaatgtatgtataatgatcatgttataaaaggaaaaactagaataaaaatgcttgattaatccaaaaaaggcaggagaatgaaaaaagtaagaacatattaagcaaacagaaaaacactgggaagacagcagatttaaacccaaatatgtaagaaaattaatgaaatgtagatgcataaaatacatcaattaatagacaaaaatgactgggcacagtggctcacacctgtaataccagcacttcgggaggccaaggtgggagaatcccttgaggccaggagttttagagcaacctggcaacacagtgagacactgtctctacaaaaaatgcttaaaaattagccatgtgggctgggcgcggtggctcacacctgtaatcccaacactttgggaggccgaggcgggcggatcacaaggccaggagatcgagaccatcatggctaacacggtgaaaccccgtctctactaaaaatataaaaaattagccgggcgtggtggcaggcgcctgtagtcccagctacttgggaggctgaggcagaagaatggcgtgaacccgggaggcggagcttgcagtgagccgagatcgcgccactgcactccagcccgggcgacagagcgagactctgtctcaaaaaaaaaaaaaaaattagccatgtgtggtggtgcgcacctgtagtcccaactactcaggaggctgaggtgggaggatcacttgagcccaggaagttgagccatgttcatgtcactgccctccagcctgaggcaacagagcaagaccctatctcgaagaaaaaaaaaagatcttccttacccacactggggatgggatgctgtttccattactggaggcagcctagtgcaggctgttgcagtacaagcacagtaagggaagtattcagagaagagcagcccagcatgtaccaggcaaacctatcaggaatctaacattttctctcagccttccactagtaccattctcagcaaaaccactatcatcttcaatgtggacaaatgaaatagcctcctagtgggtcttcaaactatccatcatgcccttattcaatctattctctgtagagtggtaattatttaaaaatcagctcatgtaggccgggtgtggtggctcacgcctgtaattccagcactttgggaggccgaggcaggcagatcacaaggtcaggcgttcgagaccagcctgaccaacacactgaaaccccatgtctactaaaaatacaaaaattagctgagcgtggtagcgtgtgcctgtaatcccagctactcgggaggctgaggcaggacaatcgcttgaaccaggaggcggaggttgcagtgagccgagattgcgccactacactccagtctgggtgacagagtgagactccatctcaaaaaaaaaaaaaaaaaatcagctcatgttactcccctgctcaaaaatctccagcagctttctactacacttaaaataaaaaaaagtcagatgcagctgagtgcagtggctcacacctgtaatcccagcactttgggagactgaggtgggaggatcgcttgagcctaggagttcaagaccagcctgggcaacatagcaaaactcccgtctctacaaaaaatacaaaaattttccagcggtggtggcatgcgcctgtagtcccagctacttgggaggctgaggtgggacgatcacttgaacccaggagttcaaggctgcagtgagtcatgatcacaccactgcactccagcctgggcaacagaacaagaccctgtctcaaaaaaaaaaaaaaaaagccgggcacagtggctcatatctgtaatcccaacactttgggaggccgaggcaggtagattacaaggtcaggagttcaagaccagcctggccaacatggtgaaaccttgtctctactaaaaatacaaaaattagccaagcacggtggtgggcacctgtaatcccagctacttaggaggctgagacaggagtatcgcctgaacctgggaggtggagattgcagtgagctgagatggtgcaactgcactccaggctgggcgacagagagagattccatctcaaaaaaaaaaaaaaaaagtcaaatgccttctcctatgatatacaaaccattacatgatctcgctcttgcctaacattatcttgtttctacacctttcacttaccttttgaataagcatcttaatcatcttgggcttcttgcagttcctcaaaaatacaaagctcccctcagcccacccaaagcctttgtatttgctgttctctgccaggaatgccgttgctttagatattcatatggcctgggctcttttttcatgtcactattcaagtatcacctcctcaaaatgtcctgaccaccctatttaaaacatccctatctctacttgccaacttccattctcacccaggctggaatgcagcagcgcgatctcggctcactgcaacctccacctcccaggttcaagcgatacttctgccttagcctcctgagtagctgggactacaggcatgtgccaccacgcccagctaattttcgtattttcagtagagacaggtttcaccatgttggccaggctggtctcgaactcctggcctcaagtgatcctcccacctcagcctctcaaagtgctgggattacaggcacgaagccactgcgcctggcccttcttacttttcttaatacttgtccctacctaatattatgtattgatgtacttgtttacttcatgtccttactcctattaagatgtaagcaacatgattgctgggacccatgattctcattcacatctgctccactggtgtccagcacaacacctagttccaactaggcactcaagtatttgccaaataaataaaggaatatatttctagccaatgaaagacatatcaacctaatcataatagaagctagaaagaaactgggtcctaaatatggactgaactctgttcccctaaaatttgaatgttgagccctaactaactgtatgtggagatggggcttttaggaggtaattaaggttaaaggaggcctagaggaggggtcctaatccactagaattactggccttgtaagaagaagaagagggccaggtgcagtggctcgcgcctgtaatcccagcaccttgggaggcagaggtatgaggatcacttgagcccaggagttcaagaacagcctagggaatacagggagatctctgtctctataaatttttttttttttaaatagctaagtgtggaggcatgtgccagtaaacccagctactcaggaggctgagacgggaggattgcttgggcccaggagttcaagactgcagtgagctgtgatggcaccattgcactccagcctgggcaacacagtgaagccctgtctcaaaaaaaaaaagaagaaaaaaaaaggaagagagtgacctctttctctctctgtgtcatatgaggacacaacaagaaggcagctgcctgcaagccaggaagagagacttcaccagaacctggcaccctgattttggacttccagcatctagaattgtgagaaaatacatatctggtgtttaagccacccagactatggtattctgttacagcagcttaagatgatacagatttaaatagagatgaaactgtagtcaccgatcaaaaaaaagagtagcccctctctttgtcaaatcttttccccattcccctcaacagcatccttaaaattttttttattttaaaataattatagatccatgggaagttgcacaaaatgtacagaaaagtcctgtgtagacttcacccagcccctcccagtgttaacatcttaggtaagtatagcacaatattcaaaacaagaaattaatggggctgggcgcagtagctcatgcctctaatcctagcactttgggaggctgaggtggatggatcacctgaggtcaggagttcgaaaccagactggccaacatggtaaaactccctctctactaaaaatacaaaattaggtggtggcgcatgcctataatctcagctacttgagaggctgaggtaggagaatcgcataaacctgggaggcagaggttgcagtgagccgagatcccgccactgcactccagcgtgggtgacagagcgagactgtctcaaaaaaaaaaaaaagaaagaaattaatgttggtatattccatagagcttacttagacttcaccagttctatgtgcactcatgtgtgtttatttgcatagctctatgcaattttatcacaggtagcctcgcaaaaccaccaccaaaatcaagatactcacctgtaccatgactgcaagatttcctcatgttacccctttctaacccgaaccatcctctacgccctacatccctacccttggaaaccactaatttgtttttccatctctatgtgattttgcaaatattacataaataaagtcatgtagtgcataaccatttgtgattgattttgtcactcagcataatttccttgaaattcacccaagttgttgcatgtatcaagagtttattgcttactgttgctcagtttattcatggtattggtgtgcctttcaatcagttttaattgggctacttatcatttagcactgagctgtgtatatactagatactggtcccttgtcagatatgttttaccactattactctcccagtctgtgactcacccattcatctgcttattggtatattctgatgagacaaagttttcaatttggataaagtctaatgtcttaattttttatttatttattttgagacagagtcccactctgtcacccaggctggagtgcagcggtgtgatcttggctcactggaacctccacctcctgggttcaagcaattgtcctgcctcagcctcctgagtagctgggattacaggcgcatgccaagacgcccagctaatttttgtattttcagtagagatcaggtttcgccatgttggccaggctggtctcaaactcccaatatcaggcgatctgcccgccttggcctcccaaagtgctaggattacagatgtaagccactgcgcccggtctgatttttttatttttatggttattgttttcactcaagaaacctttgcctactcccaagtcataagttgggacactcatcactgtcctgtttccctctaaaaactttatgattgtagcttttatatgtaggtctaaaaaccatctcaaattaattttggtatgaggtaaaagctgagaggtttgtttatttgtttccccagttattccagtactatttgttgaaaagcctttcttctccccattggaatgctttggcatctttgtcaaacaataaatgaccctttagtgcgtgtgtggcagggtatgtttctaggacctctgttgtgttttgttcggtaatctttgccaataacatactgtcttgatcactgtagttttaataaatcctgaagtttttgttttttgtttttttttttgagataagagtctcactctgtcacccagggtggagtgcagtggtgtgatctcggctcactgcaacctccgcttcccaggttcaagagattctcatgcctcaccctccccagtagctgggattacaggcttgcaccaccatgcctggctaatttttgtatttttagtagagatagggttttaccatgttggccaggctggtcttgaactcctgacctcaggtgatccacctgcctcggccttccaaagtacagggattccaggcatgagccaccatgcccggctctgatctatctatctatctatctatctatctatctatctatctatctatcatctatctatctatctatctatctattttattttttgagatggagtcttgctctatcgtctgagctggagtgcagtggtgtgatctcggctcactgcaaactccgcctcccgggttcaaccaattctcccacctcagcctcctgactagctgggattacaggcgtgcgccactacatccagctaatgtttgtatttttagtagagacggggtttcaccatgttggccaggctggtctcgaactcctgacctcaactgatctgcctgccttggcctcccaaagtgctaggattatatgtgtgagccactgcacccggcctgattttttaatattaaccttatatcccatgaccttattgtgatttttcaattattacttcgaatagttgttgtcttgattccttaggactttctatgtacacaatcatgtcatctccaaatacagacttatgtcttcctttttgatctttatgtctcatttctttttcttttgataatggatttttatagtttataatgtattttttaaataggtgccccttaccagattgaggaagttcccttcaatttctagtttgctgagagctttttatcatgaatggatgttggattttgtcatatgctatttttacatctatgaagatgattgctatggtttgaatgtttgttgcctccaaaactcatgttgaaaattaattcctaatggcaatattgagaggtggggtttttaagaggtgactgggtcatgagggctctgctctcatgaatggatgaacctattcatggattggtgagttaatcgattaatgggttatcacaggattgggactgatgactttataagaagaagagaggcctcaactagcacatttgcatgttcagcccacttgccatttgatgccctgcaaagcctcggaattcagcagagtccccaccagcaagaaggccctcaatagacacagccctttgaggctggacttctcaacctccaaaacggtaagaaataaattccttttccttgtaaattactgaatttcaaggtattctgttataaacaacagaaagtgaactaagacaatgatcatacggtctttcattttttctgttaatatggtgaattaacaggtagaaagaaatcctaatcatcatttttgtatatcattatatttgatttgttaatattttattaaaatttttgtatctatgtatggaaaagatgggtttatgctttttttgtaatgtctttcttgggttatggtatgagttatgttggcctcataaaatgcattccttttctgaaggagtttgtataatactgctgctatttcttccttagatgtttaatagaattcaccagtgaaaccatctggggctggcattttctttgtggaaggtttctgataatgaattcaattactttagcagcataagggtattcaatttcttttttatcttgtgtcagttccggtaagttgtacttttccagaaattttaaaatttcatttaagttatcaaatttattggcataaagtaattcatggcattctcttattattcttattattcttcttttttggagtcggggtagagtctcactctgtcactcaggctggagtgcagtggcgtgatcttggctcactgcaacctccgcctcccgggttcaagtgactcttgtgtctcagcctcctgagtagctgggactacaggtgcccgccactatgcccagctaattttcgtatttttagtagagacagtgttttgctgcgttggccagactggtttggaacccctgacctcaagtgaccagcctgcctcggcctcccaaaacgctgggattaccagagtgagccaccacgcccagcctcttattattcttttaacggctataggatctaaagtgaaaatccctctttcattcctgatgttagtaatttatgttctttaaaaagagagaatgtaaattactaggtgtttaccatctttgctgatcttttcaagaaatcaatttttggctttattaattttctttatttcttttctattttgctgatttctgctcttatatttatttattttttcttctaccaggaatagttcttctctttaaagtaggatagaaatatgaaagatgagaaacagtgttgcattcaagatcaatagaaagttcctttgctagtccaggcttaaaagatcttaatttgcttcaagtcccaagccctgcctccataggccaggggctttttgaagagagaccccaacatctcaagggtgtgcctccaccctaatcagtttagctattacctgcagtagtgatttctcaatgcctgctcagccctcactcaccagggcagtatcttcttgtcccttccctcacaaccatcccaggttccttcctttcttcatccaataaggtaatcacatctggtttagaaatggaaggtcctgcttaaaagaaaaatgtgacatggaattatacaccagaaaatctttagatttagatttggttaaatttataattaactacagatcaatatggcactttataaagcctaggagcgaagaattgcaagggagttgaagaatgctcatattaaggtaacttgagggtcacaaggaatagcctgtatgaggttaaattaagtatactaaggccattatattaaccatctggtcaagaacaggccttaatataatttaacctcacacaagctctgttgaaaggcagtattgtgtagagggaagaacacagactggatccagactgcctggcttcacatcctgcctttgtttctgtgttacctagcaaattattaaccttttgtgtctacgttttctcaaataaaatgaagataataatatcttctcatagcgttgttgtgagggttaattaataatgaacaatgcttagaataatgtttaagcccaaatatatggtgatgtttattaacatatacacataatatatgtattagctattagctatttactgttatcattttgatgagtgcatactaaaaggttttttgagacattcccagatcttttctaggatattcattcaatgttaaatgccaggcttttagattttaattttcaattacaaagtaggtagaactgcatatgtctgttacaggaaacagaatgtgtttcagggttttttctgtttgagacagagtctcactctgtcacccaggctggagtgcaatggcgcgatctcaactcactgcaacctcagtctcccagcttccaggaattctcctgcctcagcctcccaagtagctgggattataggcatgcgccaccatgcctggctaatttttgtatttttagtagagatggagtttcaccatgatggccaggctggtctggagctcctgacctcaagtgatccacccgactcggcctcctaaagtgctaggattacaggcatgagccaccatgcctgaccttgaggtttttttgagatggagtctcactctgtcgcccaggctggaatgcagtggcgtgatctcagctcactgcaacctccgcctcctgggtttaagtgattctcctgcctcagtctcccgagtagctgggattacaggcacgtgccaccatgcccggctatgagttttaaataacctttctggatccatctcacactatgttctacagattcctttgatttttagagaaactcagaacccctatgtctaggtattctacttgcagatggtgtgaagcatttatgtcaattctgagctccaatataaggtgaagtctggtttcttgaacaatgcttttgccatattcaaatccatccccttggatactaaggaaatcaggaattacagagtctgaaggaagtctgaagggcatagcagactggacatgatgaaatggagaggcctagttccaacctgacaaagcttaaatcattcctttgagaatagaaagtagttttagagagtttttctaaatatagtcctgaaattgacagcagagaaagctaatatcatttgggataaataaccttacctagtgaaatgaagttgctgtagttctcccacattacatccctatataagtccctctgagcaggatccaggaattcccattcttcctgtgagaagtctatggccacatccctgaatgtcactgaaccctgaaaaaacaaactcaggtattacttgtgaaaataaattaaatacttttaaaatggaaagaggggagattgaggattgcattgcagagaggggtcagatagcatgcaaacagcattgggctgaaaacttgtgacatgagtaggggccagtaagaaaattagtatttctcaagcactgagcctacatgttcttgaatagtcctgtggctatagatatgattacattttcatccaaacatttctagaaatgagtacataacccaaaaaaatcctaattaaatgaaatagtgcacgcaagccttttgaatactatgtgcctccaccataaattctttaaaaatatgaggtcttgaggccaggtgcagtggctcatggctataataccagcactttgggaggcccagatgagaggatcatttgagcccgtaagttcaagaccagcttgatcaacattagcaagaccctgtctctacataaaaagaaatttaaaaatttaaaaatttaaaaaaaaagaaatatgaggtcttgggctctcttttccctttaatgatcatttaaaaacattgataaaaatttatcccacatgtgctacaaaatccaagaagacagattcaaattcatcacaaactcgggttttattataaacactttctcttttataaccaattctttagtaaactttcaaaaattcgttcgatggcagtctacatttttaatatattagattcttttttctttagatattttaattcaataaaatctcgaaagtcttccccaattctcaacgtctacaatatctaatctttatggatgtgaataatcttcttgcttgtcactatctatcatctcttgaacattgtttttttgttcctgagttacaggacactgaatcatgaagatatcataaagatatcacctggacaccattatcaatcatattcttttcttttcttttttttttttttttttttttgagacggagtctcgctctgtcgcccaggctggagtgcggtggcgtgatctcggctcattgcaagctccgcctcccaggttcacgccattctcctgcctcagcctcccaagtagctgggactacacgcatccgccaccacgcccggctaattttttttgtatttttagtagagacggggtttctccgcgttaattaggatggcctcgatttcctgacctcgtgatccgcccgcctcggcttcccaaagtgctgggattacaggcgtgagccaccgcgcccggccccctgtatcaatcattttcaatgaggagtcattttgctccccaaaagacatccggccatatctggagacaattttggttgtcacaatcggaggaaagggtgtgagtgttacaggcatctaatgggtagaggccagggacactgttagacatcctacaatgcacgggacggccccctacaataaaagactccccatcaaaatgtcaatagttcaggccaggtgcagtggctcaagcctgtaatcccagcactttgggaggccaaggcaggcagatcacttgaggtcaggagtttgagaccaaccttgtcaacatggtgaaaccctgtctctactaaaaacacaaaaatcagctgggtgtggtggtgggagcctgtaatctcagctactcaggaggctgacgcagtagaatcacttgaacccaggagacggaggttgcagtgagctgagatcacactactgcactccagcctaggcgacagagtaagactcggtctcaaaaaaaaaaaaaagtcaatagttccaaggttgagaaatcctgctctagaccagcacatcctgtaaaaatacacaatggacctcgttcctggcattcttctccgcaggaggaaatctccattgattgaggtatctatttgcagtcctattctgatcacatcctattcaccctgttggtgaagaagggatccctgccctaaaaagtacaagacaatcaaatagcccacactggacagatgagattgacagcaatttgttcgatgcatatattcagagcctgagagaggacatcatacatcacgcaggggcacaaggggattgcatttaagaacagcatgaacaagcaggggtatgggaggcaggctttacagtaataacaaggtgaggtgttccctggttcctgcagtggtatgtgattggcttgtttgaataattccataggctagcagggaggtgaaacccattaggttgaggacgacgaggggtgtaactggtctagctcataggagaactagctgggtaggaagcctttcccgctgggtgtgggcatatcgggtaagagcaggggaactcatggttaggcctttagggtcttgacaaagttgtcaaggcacacatgaaagtttaggccttatcttataaggcccaattacatccctacccaatccacctaaaagccttacatagtatagggtctcaacatacataaaaactaaggtcagtcaacactaaatcctatcctatatacttgaaaaactcagatctgtggagaagtttagagttttccctataagcagtcagataagaccaaattctctctttcatcaaatcacagatcttaaggaaagctcaaaatagggacctcccacttaacatcagtaatccattcctgaaaatcagacattctaacgattaaccaggtacctattttcccatcattttatttactttctttccttccttcctccttctttctttctttgctttctttcctttttctttttctttttttttttttttttttttttttttttgacagggtctcactctgttgcccaggctgttgcctaggctggagtgcagtgatgtgatcacagctcactgcaacattgaattcctggcctcaagcaatggcctcccaaaggagggattacaggcgtgagccactacacacggcctcccattatgtgaaatcagagcattataatgagttatatgtcaattccatccctccaactagctttgcacattttcctccaatatagaactatgggacacagtgggtcagtacacacacaacatctttgcttttagtattttaatcatctcttttactaaattcatttttctcatttgcttggtttctttctccacaattttcttcaatacttttccaatcttttaggaactcattttacactagacaaaaatgagggctatatgtgaagcacagtatggaaaagtgtttccaacaagaacgtgatagcgggaacggctgacactcaggatggtgctctgttacctcctcagtcactagcagcaccaggtacacacatgcccttgaatgatagttatacacatttcaaaacatctgcagatggttccattggtctaacaactgtatttgggatataacaagatttttcctggatgttatttttgttttttaaaaaaaagcattgtattggatcaggtgcggtggatcacacctataatgccaatactttgggaggctaaagtgggagaatcacttgagcccaggagtttgagttcagcttaggcaacatagtgggaccccatctctacaaaaaattttaaaaattagccaagagtggtggcacgtgcctgtagtccccagtactcaggaggctgaggtgggaggatcacctgagcctgggaggtcggggctgcagttagttgggatcataccaccgcattccggcctgggtgactgagtgagaccttctgtcaaaaaaaaaaaaaggctgggtgtcatggtggatggtggctcatgcctgtaatctcagcactttgggaggtcgaggcaggtggatcacttgaggtcaggagtttgagaccagcctggccgacatggtgaaaccccgtctctacaaaaaaaaacacaaaaaatagctgggagtggtggtgggcgcctgtaactccaggtactcagaaggctgaggcaggagaatcgcttgaacccagaaagcggaggttgcagtgagccgagatcctgccactgcactccagcctgggcgacagagcgagactctgtctcaaaaaaaaaaaattgtattgaactatatgattccacttgaacaaagttcttgttttgttttgtctttttgagatagggtctggctctgtcatccaggctggagtgcaatggtgcgatctcggttcactgtaacctccacctcccgagctctagtcattcgcccacctcagcctcctgagtagctgcgtctataggtgtgccaccatgcccagctaggttttgtattttttgtagagacacggttttgccttgttgcccgggatggtctggaactcctgagcttaagcgatctgcccacctcagcctccccaagtactgggattacaggcatgagccaccacacctgccccacttgaacaaggttccaaaaataagcaaaattacattatagtgttcgacatcaagacagtggttaccctgggcagtaggtgggtggggagtgactgaaagcatctgaggtgatttcctttcttgacctgatagcatagatgtactcaatttatgaaaattcatccagccatacacttatggtttgtatatttttttgtatatatgtcattcctccacaaaaaatttcaaaaacgttttaaaaatgtcatattgtggccaggtgcagtggctcatacctgtaatcttagcactctgggaggccgaggcaggcagatcacctgagatgaggagttcaagacaatcctgtccaacatggtgaaatcccatctctactaaaaatgcaaaaattagccaggtatggtggcgggcacctgtaatcccagctacttgggaggctgaggcaggagaattgcttgaacccagaaggtggaggttgcagtgagccgagatcatgccactgcactccagcctgggtgataagagtgaaactctgtctcaaaaaaaaaaaaaatgtcatattatgtattggggacacctattttttctatgtaaaactaagacaaaaagcactgtactgagaaaaatatactttttctggagtttaagttttaaaatgaaaagcggttccactggaagatgttaacaggaggacattctgcagagaatgccttcaattttctcaaggcatctcatttccgctttctcacagctattgacagaagattttgtaggtaggagatgctcaacattagtgggagaagagatagccacataggatactgggctatctgtcccaatcctcacaggagggaaaagaactggagtaggttcttttttttttgagatggtgtcttgctctgtcgccccagctggagtgcagtaacgcaatctcggctcactgcagcctctacctcccgggttccagcaattctcctgcctcagcctcctgggcgcctgccaccacactggctaatttttgtatttttagtagagacagggtttcaccatgttggccaggctggtctcgaactcctgacctcaagtgatccgcctgcctcggcctcccaaagtgctgggattacaggcgtgagccattgcgtccagccatggagcaggttcttggatgaagctctggtaagcaggaagtttcagaataaagaatgaatctatatacatgatacagaaattgacagtatttcgaaaaggacagagaaacattaacttacatgggccatggttttagaactgcaaaaactggtcagtccttttcaagatttctctgttggagaactatggagtcctgataagccagagctgaaagaagaaaaagaaaccatgaaataagctgcgccacagagctcccaaaatgatgtacatcataaatatgaaaacttttttctcttccattccttctcccaaactacttccattggcttttccaaagtaccacccaccactatgcccatccctatcctatacccacatataactggggaaaagtatagggagtctaaagagaaacaagctctggccgggcacggtggctctcgcctgtaatctcagcactttgggaggccaaggcagttggagcacctgaggtcgggagttcgagaccagcctgaccaacatgcagaaaccctgcctctactaaaaatacagaattagctgggcgtggtggcacatgcttgtaatcccagctactcgggaggctgaggcaggagaatcgcttgaacccaggaggcggaggttgcggtgagctgagattgcgccattacactccagcctgggcaacaagagcaaaaaagaaagaaatacaagctctgaagaaataggtgacaaatgatgaacttggtgtagaagcctagctacttctgcaagaggatttctgaccaggtcgccctctagcaatgtggatctggtccagacactggattactcagatttgttctgagcagctcctcctcactctaggacaacttttcaggactgagaagggccctgaatcctgcccctagaatcctgcctgaactacctaaacacagcaactaaaagaccacacagattgaacctggcagcttctgccaatgtgaggctacccttgccttccccagccaggaaagctcgccactccagttttccaatcagggcctcccataccatgacatccttcaccactccttctcttttattgattaatttttttttagatggaatttcactctgtcacccaggctggagtgcaatggcacgatctcagctcactgcaacctccatctcccgggttcaagtgattatcctgcctcagcctcctgagtacaggtacatgccaccacgcccagctaatttttatatttttatatttttagtagagacggggtttcgccatgttgaccaggcttgtcttgaactcctgacctcaggtgatccgcccgcctcggcctcccaaagggctgggattacaggcgtgagccaccgtgcccggccccactttccttttagtatccaagctggggacagaagggattcatgattcctgcagttggtcaacaatattcattgagaacctctatgtgttgggtacttcatacacattgtcagttgtcctcggtactgttctgcaatgtagtgctctccttttaatagctcaggaaactaatgcccaggggtcaaatcagttaagttgccaacatttgttttgaatctacatttctctaactaaaaagcccgtttcttttttctttttttggttttgttttttttgtttgtttttgcagacagagccttgttctgtcacccaggctgaactgcagtggcatgaccatggctcactgtaacctctgcctccagggttcaagcgtttctcctgcctcagtcttccaagtagctgggattacaggcgcctgccactacgcccggctaatttttatatttatagtagagacagggtttcaccatgttgcccaggctggtctcgaactcctgacctcaattgatccacccgcctcagcctcctaaaatgttgggattacaggcgtgagccaccacacccagcctaaaagccagtttctctttcaactcaggtatttgtctctgaagcaaggatttctacttcaccaggagaaatctgatcatcagcaattcactaaaaaaaagaggaataactaacagtaggttttgttttgttttgttttttcaaaaacacggtctcactctgttacccaggctggactacagtggcatgatcttggctcacagcagcctcgacctcccgggctcaagcaatcctcccacctcagattcccaagcagttgggactatagttgggcaccaccatgcccagctaataatctttcaaaaaatgctaaatctcagaagatagcaaaatagttctttccatctatggtccacctgcagaaacatcagtttgagcaattatccatcaacaaaaatgccttcacaatagctaaggcaaccaggtgagagatcgcagtactgggttgtagcacaataataagaaaagaagcattgaagagtgcaggaaggacggctcgacattacccatgtcacccctccccagctcaaggcagcacagtgtagacagaggtattgcccacttggggaaaagtcagggaagtgagcacagaactttgcctgttccctaacaccaggcccgccatagtaaaacccagcaacagggagactcccaaccccagactccaggccagtagccacagactgaccctctagacctgctctggcatcaggaaagatcatgcagcccaggcttcaggcttgcatgatgaactccatctccaggctgccaccaccatcaggctgacatcagaggccctgggctccaacagcccttagcaacaggcaagcctcagtggcctctgcaatcaggcacataacagtatggcaccagtcacagtggtctcaggctttgagcgtgccccagcactgcaccagccagagtggccctgggcttggggcatgctatgtgcaacaccagagaatgtggttccagccttttggagcatcccagcactatacccaccgtagcagccccagccttaaggaccaaaccagacaggctgcccagaaccactgcatgggctattgatgggctttcccagatgaacctcattctgcaaagactggaataaatacacagtcctttcaagtgtgcagacatcagtgcacggtcacaaagatcaacaacaatcagggaaacatgacatcgtcaataggacaacataaagtgccagtgattgactctaaagaaatggagatgtctgaactgcctgataaagaattaaaacaggctgggcacagtggctcacacttgtaatcccagcactttgggaggccgaggcaggcggatcacgaggtcaggagatcgagtccatcctggctaacacggtgaaaccccatctctactaaaaaatacaaaaaaattaggcgggcatgctggtgggtgcctgtagtccagctactcgggaggctgaggcaagagaatgccatgaacccaggaggcggagcttgaagtgagtcaaggtcgcgccactgcactccagcctgggcgacagagcgagactctgtctcaaaaaaaaggaaagaattcaaataactgttttaaggaagttcagtgaacttcaagaaatacagagaactttaaaaagtgagaaaaacaatatgtgatcagaatgagaaattaaatagattgaaataatttttaaaatcaaacataaattctggagctgaaaaatacaatgaaggaaattttgaaaatgcaagacagaacatcaacagcagaattgaccaagcagaggaatgaatctgtaaacctgaagacaagttatctaaaaatatacagttggatggaaaaaaggatgaaaagaaatgcagaaagtttataggattcatgggacagcatcaaaatagcaaatatttgagcagtaggagttaaaaagggagaagagaaagataaacaagtagaaagcttatttaaagaaataacagcaggcacagaggctcatgcctataatcccagcactttgggaggccaaggtgggattacttgagtccaggagtttgaaaccagcctgggcaacatagcgagactcatctctacaaataattttttaaaaataagccaggtattgttgcatgtgcctgtagttccagctacatgggcggctgaagcagaaggatcacttggacccagaagttcaaggttgcagtgagctatgatcatgccactacactccagcctgggcaacagagtgagatgaaaggaaaggaagggagataagaaggaaggagggatggagggagggagggagggaaggagggaaggaaggaaggaaggagaaagaaagaaaaaagagaggaaagaaagaaaaagaagaaaggaagggagggaggtagggaggaaaggaggaaggaaggaaggaagaaaggaaggaaggaaggaaggaaaaaagaaagaggaaagagaaaaaaagagtagcaaaaaactttccaaacctggggaaaggtaagtatccaggtatggcccaaagttagaaggaagaaaataataaagattagggcagaaataaatgacacagaccagaaagccaatagaaagaatcaataaaattaagagttttttttttgaaaaaagaaaaaacccacaaaattgacaaacctaactaagctatactaaccaagagaaaacagaaaatattgaaaatattcaaataaaactagaaatgaaaaaggagacattacaactgatacaacagaaatagaagagactattatgaacaaacatacaccagaaaattggataacctaaaataaatgattaattccctgacacatacaacctaccaagattgaattatgaagaaataaaaaatctgaacaggctgggcatggtggctcatgcctgtaaccccaacattttgggaagccagtcattatgacaaacagtatggagaggcctcaaaaaactaaaaatagaactaccatatgatctagcaatcacactactgtatatatccaaaggaaatgaaatcagaatgtcaaagagatctctgcactttcatgtttattatagcattattcacgatggccaacacatggtgtccatcaatggatgaatggacaaagaaaatctgctatgtaaataaaatgtaataccattcagctatgataaagaaacaaaacctgtcatttgtgacaacacagatgaatctggaaggacgttatgttaagtgaaataagccagaaacagaaagataaacaccacgtgatctcattcataagtggaatcttaaaaagttgatctcgaccaggcgtggtggctcacgcctgtaatcccagcactttgggaggccgaggcgggaggatcacctgaggtcgggagttcaagaccagccttaccaacatggagaaaccctgtctctactaaaaatacaaaattagccgggcatggtagcacacgcctgtaatcccagttactcaggaggctgaggcaagataatcacttgaacccgggaggcggaggttgtggtgagccgagatggcgtcattgcactccagcctgggcaacaagagcaaaactccgtctcaaaaaaaaaaaacaaaaaaacaaccaaacaaacaaacaaacaaaaacaacttaatctcatagaagtagagagtagaatggtagttaccagaatctggggtagttgggggtggggggaaatggcaaggttgaggagatgttggtcaaacgatacaaaatttcagttacataggaggaataagttcaagagatctattatacaacatggtgatatagttaacaatatattgtattactgaaaaaagctaagacctgtaaagtgttctcaccacaaaaatggtaactatgtaaaaggtaattcatatgttaattagctagatttagacattccacaatgtatatatactttaaaacaccatgatgtacatgataaatacatgtaattttatctgtcaaaaaataattttaatactaaagctcggtattaagaaaatgaccagcctgggcaacatagtgagaccttgtctctacaaaaaaattttaaaaattagccgggcatggtagcgtgcacctgtagtctcagctaccaggaggttgaagcaggaggatggcttgagcctgggaagcagaggttgcagtgagctgagatgatgccactgcactcaagcctgggcaacagagtaagaccccatctcaaaaaaaaaaaaaaagaaaaaaatgaaagaaaaaagaacagaaaaaaatgaaagaaaaaagaaaagaaaaaaatgaaagttaaagcaaacaaaatgtacctttttacaatgactgcattgcaagacctaaaagactgatgatgccctatagtagcaaggttgtggggacaccgacactaggtcggtccacatttagagctatgtgaagcagcatttcaatcctgtaaactctgaatcagaagctccacttctgacactaaagggactgtatctgtacataaagattatgcagagctatggccggggcagtggctcacacctgtaatcccagcactttgggaggccaagacaggcggatcacctgaggtcaggagttcaagaccagcctggccaacatggtgaaaccctctctctacaaaaatacaaaaattagccgggcatgatggcaggtgcctgtaatcccagctactcgggaggctggggcagaagaatcgcttgaacccaggagacggaggttgcaatgagccgatgtcgtgccgttgcactccagcctgggtgacagagggagactctgtctcaaaaaaaaaaaaaaaaaagaaaagaaaaaagattatgcagagctatgctgacagcatggtttataatgaattaatggattaaagttgaaaagaacctaatttcggaatgattcaataacctgttgtttatccataccattgaaaatgatgcaaccattaaaaatgatgttgccttaattttgaatgggtgaagccagtgtgttaaaaaaagaaaataccagcatgtgtagtgtgaaactattttgacagaaaaaaaaatcatgtttccctagcaggaccagttaaaatgtttacagtcacagccagcaacacgcaccaccacattaaacagagtgtgagcctgaaatacccaaatacttcaaataagactttcccggctcaagttctttcagtcttccttttaactgagaaaaaaagctaaggatactgtaaaaacagatgctgttttttctgagtggcttttttttttacttcggcttctcattcatgaaccaactctatgatttaatttgcccatgtgtgttggagtacggcctagaaaagaatggcaaaaagtctctgactgatgtcttctaagcactgaaggcagccccatgctgcttcctttcacatcttcctgataaacaggtttattttgcttctgaaccagttcttttggctaagatgcctatgaagccctccagcagatgttgggtctccttgaccaactggtctcactttgcatataacatcattaaaataaaaactgtaaggcatacatctgtatgaaacccagttacctccataaagaccctgtagcttcagtataatctggacaaaacttgacagtgtgtgccatcatgagattgatatctcttcccttcatcgtgagattgctgaataaagcaggaaggaatttttttttttttttttttttgagacaaggtcttgctttgccacccaggctggagtgcagtagcacgatctcggctcaccacaacttccacctcctgggttcaagcgattctcctgcctcagcctcccgagtagctgggattacaggcgcatgccaccacacccagctaatttttgtattttcttttttttttttttttgagacggagtcgtgcccaggctggagtgcagtggtgcgacctcggctcactgcaagctccgcctcccgggttcacgccattctcctgcctcagcctcccgagtagctgggactacaggtgcccgccaccatgcccgggtaattttttgtatttttagtagagatggggtttcaccgtgttagccaggatggtctcgatctcctgacctcgtgatctgcccgcctcggcctcccaaagtgctgggattacaggcgtgagccaccgcgccccgcctaatttttgtattttcagtagagatggggtttcgccattttggccaggttggtcttaaactcctgacctcgggtaatgcacctgccttggcctcccaaagtgctgagattacagacatgagccaccgcgcccggccagatttttttttttaagtatgcataatgatgatatttggtatactgttgtaattaccaatatatgcttttatttttctgcatgatattagacaggttactttccagttccccatatgaaatggtgagaactacagtttctacctgaaaggattgttatgagaaataaataagatactacatataaggcacttagagtagtaaataagcatttcataaaagtcagctatattaataaagatgaagaatactacatatgcttcttcccacaattatttttaaaattctactcaggcctgtaatcccagcactttgggaggccaacacaggcggatcacttagatcaggagttcaagaccagcctggccaacatagtgaaaccccatctctactaaaaatataaaaattagccaggcatggtgatgcatgcctgtaaccccagctacttgggaggctgaggtaggagaatggtttgaacctggggcgggtggctgcagtgagccaagatcgtgccaccgcactccagcctgggtgacagagcaaaactctgtctcaaaaaaaaagaaaaaaaaaaaattcttcgcagccctgctcttgataggcaatccttcttgattatcaacaatttacaaaaggagggtacaaagataaaacaaatgtggtaggataccaatttttggatctgggtgatgaggaaaaatattaaattacaacctaacggtaacaaatctactgtgcacttattatgtgccaagcattagctaagggttttgcatatattaattcctctactcagagccatcctatatagcagggtctatcattatcctcattttgcagatgatgaaactgtggcacaaagagattaaataaattgccccaagctcaggcagctttaagtggcaggttgaggactagaacccccctactttagctccataacccatacgactgtcactgtactaaactgcatctcatgagacctgataaatacgtggcctgaaacactcatgctgtcaaaaacttcaagccactttccaaatttctactgtcttcccttcccttctaataaccccttcccttgttaacacagacctctccactaaaaaccccatcgtattgtcactccttaaaagcctcaaaagcagaaaagatcctgtcgccaatcaaaccacctcctttccctgcttttgaactcagggcggtggggatcaaagagacctagtgggtaattccatctaaactgtaaactcctcaactaatcaccatcgaatgaaagttctacgtggtggctcacgcctgtaatctcaacactttgggaggctgaggtggaagaattccttgactccaggagttcaagatcagcctgtgcaacataaggagacctcatttctacaaaaaaatttaaaaattgcgcgtgggaccacgtgcctgtggtctcagctactcaagaggctgaggtggaaggatcgcttgagccagggaggtccaggctgcagggagcgagatcacttcactgcactccagcctgagggacagagtgagaccctgtctctaaaaaaaaaaaaaaaacttaagtaacaaaataaagctctgcagttagcttctcttcaggaggtttacttccagaccatccaaatgattagaaagaggcagctcataagagaaactaaattactgccaaatgctcatgtcaatacctactggaggccgggtgcggtggctcatccctgtagttctagctacttggcaggctgaagcaggagaatcctgcttgaacccgggaggcggaggtttcagtgagcacatcgtgccactgcactccagcctgggtaacagacccagactccatctcaaaaaatacaaaaaaaaacaaaacaaaacaaacctactggaaaggggtaggaattggaatctaccttcatcaccccatcattcactgggaaggaaggccaaagcaccaggtcagtggacaggacatttcaggggttaaagtctaactagctgaagattaactggaacaagcccgcatagtctgacaaaatcatatctattgactggcagaaagggagaaaattccacaggaagggttggaatagaatggacgagagagacgagaaaagctctttcgtaaacggttgagttccagctgaaagattctaaggaggatctaatgacagctgcaatctggaatggctgctgtttccgaggtgagattaggagaggcagggattaatgagatattgaatgcaatcatgagtgtaatcaagagggtatccccagtaataaaatgaaaacagcaaagcaagtctagaacatcactggtaagaaaactgtaatctctcaaagagggagtcattatgccattttacaactactgcaccacctggggagaaatcatgttttctattaattttgcaactggctttatctgtctcttccttcctagcctgattaatgacagagctgcttcattgttcagtccgagctgattttcattccacagaagaggaaagcaaatgcccccacgcccagaaaaaataaaaattacacttcatggaacaaaacggaaacacaaactcatctggatgttgacttgtctatatgcaacagcaatcatttcctcctctccccgctgccttcctaaagaacagcaggattgggaaaggagacgggaatcttgagaccgcgggcctttcctggagccggccttggctgagcaggacacacccccgctagcgcacttgctccctccgtctactgcgcgcaaaacccgatggaaataacagggagcctggaataaagctgaccctttcccgtatcagagcgaaaggccaggtacacgaagacggggctgggatctgtctccgagttccccgcagtttccatgggagggagctcgggtaaagctgtgcaatctgcagttcttcagactgcgtctttttgtttgggggccttcattcactccggggttcctgtatctaactcggagccattccgggccgctggacctgggcggctctgaagcgagaaggcagaggacgcaacagggcacccggcgcccagtcagcgccacaaactccacagctactgcctcctggctcacactgaggtctgcgccgcccccgcgccacccccgcgcccattgcctcggtgcaagcgaccaactcacctctcggagccgacaccagcagcgaagccggaaagaactgc

SEQ ID NO: 85 - DNA, 151176 bp, Homo sapiens
gtgtttacgtctgccttcatccccatcctttccgctccagcataagcaaaattataaccccgcacaccgacttgcatgcaattatcatagcccgagtgctcctccgttgagagacttcgcccccgagaccgctgactgtgaatgacaaatcaaaagtcagggttgcagaatcagccggactttcctgctcatttgcagcagagggaggaagcagagaatgaaagattctgaaaataaaggtaaggggcggactgcagaaagatggctaagagagggctaaaggctaaaagatgctagggatgcgatgtcactccacagacatatttagtttgtattaatggctagtttaaaattaccatacctatattaacattctagttatataataaacatgatgactttaaaaaatgactagcttctagtttccaaatattgtgtcattcagctttccatttttatagtcctaaatataaccctatttttgcattcttaatcttggctgagtaacacagctttcatagatttccttagactagctcccagatttttgataattttattttgggggtgttcacaatagttaataatgaatatacaggttttcaatgcattatgagaattggaatatctgaaataattgggacttaaaacagtttgggttctgaaggcaaacgctgacggagaatcctttaatgaacattaatctttttagaagcgctccatggggagccgtcgctgaccttcagaactgtttatcttgcaaagaaatgctgggatgtaaactacccccactccatcagcctccacaccttacctccccctcacctcccaacactctaattctgttagagggatgggggaagagagaaacgaatttaaataaaaactcaaaaaaggaaagggctaaccgaaaaatgagccaaccaaattttaagttcaacaacaagcattctggaggattctggggttttaaattcggaggctccttaaatattctgccgcagttgggggaggagcgatggacccctaggtctccggaggctacacgtgttccccgatcccgtttccagggggagcccttccttcctattgcgctggtcgtgctcctggcccgcgtgcccaggaagggcgcagcggagtcgcgtgcccgtccgggcggaggacgccgtctccgcgcggcggtgccgggcccctgcttccggaacgctaattttagggttcgccggcccccctttcttttcacccgctttccgtgcgagccgctgcgcagcagtctgcgcttcgagtgcgctgtgttttaaggaggccccggcgcttgccccttgggctcgggggcttgggtgcgcaggtgggggctggcacgcagcccgttgggcaggtttcgcgcagcgaccctccccacgccggagctaagttctttgggtgagacgtgcaacaacgcaggccccaaagctctctgcgcgcagcgccgcggggcttggccttctccagtcctcgggagtcagccaccgtctctggcttgttataggattcccacctcgtggtgggcaatgatatatacatattcaacattagaaaaagaaggaaaaaaaaaccccactcacaatctaatgccaatggagagaatggtattttaatctacgaaactgtaatgaaggctcttaaacaatcccactttccataattgaggctttcaaaagggccaggtagctggtggtgtttgtattaacatctcataggctctggatcattcacagccacgtattgatctatgtggttttgacgtttaaattttaatgaagcagccttagtggggaagaaaacagctatgcatgtgcctggtaagggggaagaggacctgttcactcctgtttctaagccagcatcttaagagtaggtattacctgtgtgtgaaatcaaagtattttaaaattaactctaggaagaatgttggattttcctgtgttgttttcagtggttggagaaagggtttctggagagaaaaaaaaaattgcttatttgccaagtcatgctaggccatggacatgatttagaaaaaaaattaaagctgcttgaattggaggcccaggttaaggttaatattcaacattgtttgaaatggaaacactcctggtttctcagtgtatcagtgtgttttaagctcagatccccagcctttttctaaggagagttggtatttagaatttttttttttttttttgagatggagtcacgccctgtcgcccaggttggagtgcaatggtgcgatctcggcccactgcaacctctgcctcccaggttcaagcgattctcctgcctcagcctcccgagtagctgggattacaggcccatgccaccacgcccggttaatttttgtatttttagtagagatggggtttcaccatcttggccaggctggtctcgaactcctgacctcaggtgatccacccgcctcggcctcccaaagtgctggagttacaggtatgagccaccgtgcctggccggtatttagaatttttgttttactttgtactgggaagagccttgggttgggagtcaagattggtaggctctggcttgttcagttataactcatttgtgacctaggacaggactctatttctttgggtctcagtttctttatcgctaaaatggagagctattagactagattcctgtttttcagattgtgagtggtgagaaagcaacttagtgagtcttaggcaacattttagatcgatgaaatagaacagaaactgtcagaaatcattgcacatagcagaggtaactactgtttcctgaaacttctgttatagatatttatctttatgcatgtgggtataagccgtattctgacatcacatcggtttttttttttcctgtgagtttcagtcaaagaagtttgaggaacactgaaataaatcatagctcagtaatggttttcaaggagtctgtgaaatgcagctttatatgcatatatatacagacagagagagagagaaagagagagtcaatagttttcctcagatttttaaaggattctaagactccaaataggttatgaattactgtatttctaaggtcccccaggccttttccaagcctagttctttgagagcaaagtatccctttagggctgctgggagatgggtatgtgttgacagagaccagataagtgtatggtgtgaggtggtgtgtgtgtgtgtgtgtgtgtgtgtaggtgtgaccatagcaaccagaccgtgagagccattcctgggtcccaaattaccagttggtgtcctgaatatgagacataaaaacactaaaaattagagtctctgtgttgaaaaggaccacaacaaaactattaaaatattatgaattgtttggaagtcaattctttttgtaaagactgaaaaagagaatcaggtaaaattataagaggttgatggggcaaagaaatcaccaggatgttgcaggttcagaaagtgaatttttgtaagctaccatcacatgagtggttcagtaaatgttgacttgtgccttaagaactgcctgcctgccttttccatctttttagttcatcttagggacaattcagtgaggtttttaaatacaaaagacattgtgtaacattgatctagcatatctcaaaatgttttgcaagccaggaaaaagaaattaagtataaggcaactaaaaagaaaatagttgagtgagttaataagtagatattggcaaacatgacagctaattataacaataagaaccatagctcctatttaattaacaactgttatgtgaaaagctctctgggaggtgctttacatattgtcacaacactgcaaggtaggtggtattttattctgaagaaatagattaagaattttgtacagggatacatagctagttaatggcagagccatgattcaaaatcaggtctttttttatctccaaaaccattcacatggtaggcaagtacttgaaaataagtagccctgtactctgtaaaattacagtttttaataaaattgtcaacatttttagaattaacttacctatataaaaagggagatgtgaaccttagaaaatgatggcttttgactaattttttaggttgtttttatttggaaaacagatattttaactcttcaaattcagctccaaattttctttttactaagttctttgagtatgttatgcagcaaggtcttagaggcacaaaataataagaatgaagactgaaaatttgggtgaatttttttttggtctataagaggtcaaagaaaatagttctcattccaatttttctgttatttttctagattttattttaaaatggcaaacatggcatttgtttagcaaacaaagttacacataacattttaatagtaggatttaaaagttgtcatgactgggcgtggtggctcaacctgtgatcccaacactttgggaggctgaggtggcagatcacttgaggtcaggaattcaagaccagcctggccaacatggtgaaaccccctctctactaaaaatacagaaatgagccgggcatggtggcatgcacctgtaatcccagctactggggaggctgagacaagagaatcgcttgaacctgggaggcggaggtttcagtgagccgagatagcaagactgcactccagcttgggtgacagagtgagaccctgtctcaaaaaaaaaaaaaaaagttgtctatgccaatggttcctgagataacttttcactggaagttattacaaaatctaattgggtttgagcagggtcagattcagacttttaggctctaaatattaaaaaatagtgtggtgttcatcctccaatctgtaattcaaaataagtgtaaaaaaatttttaaaaagttgtgatttttcttaaacatcttgactactttgatacttttagagaaaactcaaattctttcaaggatttttgtcactgctgcatgtgactgggtgagttggtgaaatgatactttagctggggtgatctgtaaatgactgagtgacttctcaaagcttcaggggtagcatgtggttaagctgggattagagactggtctatgccagtggtaatcaatgggtctggtattgctttttgggctacacactggaaatctgcaggtatgttatttgatggtcatatgattgaggggcgctgccattggcagaaactagaaatgatagtgccctccggtgttctgggctgttccattcaatgatgaattagctcatgtcctgtgcaattttcaaatgttttgctgaagatgtagtaaaaccttctatacttttctgggcttagaacataaattggtttcactgtacactgaaacttccaggattaaaaatgctgtgtaaatctaaggaagattatactgaattttgttcaggaaatcacttacccaaagcaatgccacttgtgttttagacaccagtacaacacacctgaatcataaaatctatatacaagtgcaagtagctacctacttaattatgttttctaatatagtcgtctgagcatttgcatattgaaatacatgttgctttattgtaaataacttatttcacttctcttttacattacagttgaaacgtatatgtatatatatatacatatgcatagtttaattttgtgttaggttatttcatctttaaatttcattttgagatactaaacaagaaaatacaaaatatttttatatgttactcagagtttaaaaatgacttgatttttacccctgaatgttttaaaataatttgaaccaacattaaaacttttggagactataggttcaataaggtatttatggcttctttaataaagattagagcagtctgcaacaatgagattgagctgagtataaattaccctctttaaagggcagatatactgggttataagggttataaatctctaaaagtgatgttactggtcgttgattatttttatgctattgttactgccacttacatttttattttttgttttactattattatttttgagatggagtcttgctctgtcactcaggcaggagttcagtggtgcgatcttggctcgctgcaacgtccaccttccaggtttaagcaattctcctgcctcagcctccctagtagctggaattacaggtgcacaccaccacacccagctaatttttgtatttttagtagagtcagggtttcaccatgttggccaggctggtcaccaactcctgacctcaagtgatccgccacctttggcctcccaaagtgctgggattacaggtgtgagccacttggcctggcaaaatttttttaaaacattttatttatattctctcagcaggacaatcttcctagcataactgttgagggcccctccagtctcaggttttgaccttgttttttatttttttttattaacttaaaaaacattattattttttcatttttatttttgacttgacgataactgtatatatttatggggtacaatgtgatgttttgatagaaatctactacattttggaatgatcaaatcaggccgattagcatatttatcacctcaaatatttatcatttctttgtgatgagaacatttaaaatcctcttttagtaattttgaaatatacaacacattattattaaccccagtcacagtgctgtgcaataggacagcaaaacttattcttctaactgtaactttgtgcctattgatcagcattgcccctttccctgcccatgcccccacctcccagcctctagtaaccaccttttgattctctaattctgtaagtttggcttttttagattccacacacaagtgagatcatatgatatttgactctctgtggcactttagaatttcattttctaattgtttattcctgggatgtagaaatagaattgattaggccgggtgcggtggcttatgactgtaatcctagcactttcggaggtggaggcaggtggaacaccagaggtcaggagttggagaccagcctggccaacatggtgaaaccctgtctctactaaaagtacaaaaaaaattagccgggtgtggtggtgtgtgcctgtaatcctagctactcgggaggctgtggtgggaggattgcttgaactaggaggtggagattgcagtgagccaagatcacaccactgtacactccagcctgggcaacagagcgagactccatctcaaaaaaaaaaaaaaagaaagaaatagaattgattttatatgttgaccttatttcagtgaccttgctaaattcacttattaatttcaatagtttttagattttaggggccttactatgtagaccgtttatttttctgtaaataatgacagctttttcttctttctgatccttatactttttcccctttgtctcattgcactagctaggatctctcttataatgttgaatagaagcagtgatggtgagtattcttatcttgttactgatcttaggggaaaagctatcacattttcaccattaagtacaacatttgatgtgggatttatatggacacttaaaaattagattaaggaagttaccttctattcctactgtgctaagtttttatcatgaatcagttctgagttgtaacaaatatttttctgtattatgtgcatcatatgattattttattctgttaatatggtgaatttcagtgattcttgaatgttaaaccaactttgcacttttggaacaaacaacttcgttgtgatatctttttatatattgctgtatttgacttgctaatattttgttgaggattatctttgtccatgagagagattaacctgtgatttccttttgttgtggtgcccttgccacattttggcatcaaggatatgttgaccttgtaaaatgaattaggaagtatttcctatttctctattccctggaaggtttttgtgagattagaattattctttaaatgtctggaagaattcactggtgaagccatttgggcctggaaattttgttcttggaaggttttaaaatatgtttttttgtttgtttgtttatttattttacttttgtaaagatgaggtctcactatgttgcccaggctgatcttgaactcctgacctcaagtgatcctgccaccttggcctctcaaagtgttgggcttacaggcgtgagccactctgcctggcttcagttgttttaatagtgtatgttattcagatttcctatttttgtgtgtgttttaataaattctgtttttttaggaatttgtccatttcatctgaatttccacatgaggttttctttatattctcttatgatctttaaaatgtttttaggtggtgtggtcctgtccttgttttttatttctgatagtggcatttctatttattgtcctggtaattctcacttattttgatgcaatattgtcaaggtcttatacatttgagtagtctctgtaatcttttactggttaattttttgtattatacatttatttttcatctcatgagttcttgcttttgtctttattatttcctcttacactctttggctataacttatgacttattttttagttttttgagatagaaggtatctttgattttcagcttttcttttaaaaaatattttcatttaaggctacacattaatatcctttaagccggccaggcgtggtggctcacgcctgtaatcccagcacttttggaggccgaggcaggtggatcacaaggtcaggagtttgagaccagcttggccaatgtggtgaaaccccgtctctactaaaaaattacaagtattagttgagcacggtggtatgtgcctgtgatcccagctactcgggaggctgaggcagaattgcttgaacccgggaggcggaggttgcagtgagccgagatcacaccactgcactccagcctggatgacacagcaagactctgtctcaatgaaaaaaaaaatcccttaagctatatatataatatcctttaagcatagcttttgtgtacacctgcaagtattgttatattttcattatttagtttaaaatattttatacttttctttttgatttttttgacccataaggtagtgtaacaacatactttttaatttttaaacagttggggagtttctagttctctttttgccattgatttctagcttgctttcactgtagtcagagaatatattttggatgacttggaaatgttttagacttgctttgtgacccttcatatgatcaatttttatatttatatgttgtacttaaaagaatgtgcatactaagatagtttggttccatgttctatatatgttaattatttcaatttgttaatcctgaggtgcggatcttctgtatcctcactgatttttttctcattctgttggttcccaagagagggcaaactcttccattataattttagatttgtctatttttccttttatatttgccaatttttgctttactttgtggctctgttattaggtgcataccatatacagttatagttgttatatcttcattatgaaatgtctttccttatcttgagcaatactcccttataatctacctttttgatattaatgtagctataccaactttctttgtgttaatagatacatggtagatcttttcccatttgtatactttttcttttttattattattatatatttttttgagatggagtcttgctctgtcatccaggctggagtgcagtggtgtgatcttggctcactgcatcctccgcctcctgggttcaagcgattctcctgcctcagcctcccaagtagctgggactacaggcgtgtgccaccacactcagctaatttttatatttttagtagagacagggttttgccatgttggccaggctggtctcgaactcctgacctcaggtgatccactcaccttggcctcccaaagtgctgggattacaggcatgagccactgtgcccagcctatactttacttttttctatacccatatatgtaatctgtatcttttagaagcagccataagtgaatttttaaaaatctagtctgacaatatggtctttagtttgaatatttaaaccatttaatataattattgatgtgttaagtgctatagctaccatgttactccttgtttcttatttgtgtcccatctgttttatataccactttcttttggattaatcaagcattatttttaactttccaacatattctttacacatttgttttcattttacttttctttgtgtgtatgtgcgtgtgtgtgcctgcgtgcgtgtgcaagtgattaccccagtgcttcttatatttaatcatgtttcagacaatgttaggcgcttagaagactttaactccatttaccctatcttctccctcacctcactttctgccttttgtattattattgtattttgttttaattatacatttattaaagccccataggacactgtaatgattgttttatggaataaatattcatttaaatttacccacatatttaccctattcattgcttttcatttctttcggattttttgtgtattccctctgggatcttttccttttgcatgaaaaaaactccctttaggatttcttgtagtgcatatatgctagaaacaaatattctcagtttttatgatctggaaatgagttgattttgtctttgcttttgaaggacaattttactaggtgtatagaattatggggaagcaggtgttcccccagcactttaaaacatgttatcccattgtcttctggttttcatcctttcttggaaaagcaggctgtcagtcagtcttatgttgttatttggtgttgcatcttttttcttcggctgttgttaagacttttctcaattgatttggttttcaacacttgtcccaggtgtggttttctttgtatttatcctgcttggggttttcagtccttcttgaatctgtgcggcttgaggttttttgtaattctcataattccctgccattatctctccaaacagtgttttgttcctttctctctttctgggactccgggtacctttatgttagaactttttaccctgtcccatatattccttcattttctgtatacttagcccttttctttcttttttagttttgttatttttttgctggcctatcttagagcttactggttctctctgctatgtttaacttgttgttacagaaccattaatttcttaattttgttttgtatttttcagttctagagttactattagattctttttttttttttttgagacagagtctccctctgttgcccaggctgcagtgcgatcctggctcactgcagctttcacctcctgggttcaagcgatcttcagcctcctgagtagctgggattacaggcatgtaccactatgcctggctaatttttgtatttttagtagagatggggtttcgccatgttggccaggctggtcttgaactcctggcctgaagtgatccgctcaccttgacctcccaaagtgctgggattataggcgtgggccaccgcgcccagcctctattagattctttaccaaaagagattcttcaccttgtcatctgttttctcaaatacatacatcacagtcatcttaaaaaactttgctcagtaacttcaatgtgtgggccacttgtgagtctttttatctcttctgtttttcttcttggttgtctttcttcatatgcctggcaattttttattatatgtccagtattgtgtatgaagatgctctggatgatgtcatctacctgttgagagtatttttcctactctttgtcagaagtagaacagagatcacttcaatcaggcactcagtctaattaaggctgttttgcagacttttaaggtttagtctacttctggttctcctaatcccaggcccctagggaaactgactgagagtctgagatgtttctcaccaccccttccccttgacagaccctaaactctaatttttgtctctctaatactgtgaacttgctgaaaactctactcagcaaaatgttcattgtgcttttcatttgctttctcgttggcttcttagcctctgctctgggcagctgagtcaggaatatctgaaggagaaaactcctgtcaggctgtgagttactctaggatatgccttttcagtcctaaactccactttttgtctctgcagcccttgaaactgtctaaaattctgcaggcttctctgtgtcttaacagctgccccttgcctggcttttcagcttcttaccccatgctaagaattggcatataccctaaataggaaaatgggcttgcagaaagtcaggctcacctcagtgagcctcccctctctccaagatctggttcctcaaatcgtggctgattagtagctttcctattacttcacacagatgtttaaaaattttatctggcttttctaatttccctcatcagaaccagtctgctacaacctactctattaaagctggaagttaaacacgtctgtttttttttgtttgttttaagtggattatgttaaaaaataaaaatcacaggccaaaaaccaaggtaacaatgtcattttaaacatgtaaatttaataaaggatatatgttgatttttagttactctttcttgccttattaaaagcttgtcagtaccttttttcatatgtactctgaaattcttacaaatatatgttgctttgttccagagaatatgtgtactaaaagactataatttttctgagtctggttctccattcaaatgttttaatacttttgtgattttatgatttgtaattgtcgactctcacctcccaattcaacatgatcctaaaatgtacaaaataatttgaatgattgagtttcaaaaagttttagaaaacttgatcttgtaacttttattccaaagctttgttgagggggagaagtacaggcttctgcctttaagggtactgcttcacttttggggcaaaaaagcaagggttttcaaagggggacttgacatgaatggcatgcaggggagggggtgagccagtgggggtctcaatgacttgctttggtgctttatctaccaggtggttgagctggtgccctcgcgggcagaactaggtggtaaggtggccagagtcttgagatactctccaagtgggagtgagtttcatcatgggcatactttaggttataatttgttatctctcgaggcagtctcctggtcgaagagacgtctggctctggagcttctaagtaagcaagagcttccaagtaagcacacagataagcttgccctacagggagtgtctggtgaaggaaaggtaaatgttataattgcatttctaaagagctaagtaggaagtggggaacaagggaaaaggaggaaacagaaaagaagaaaaaagtattttttaaaaaagtaattctttctcttagaaaaaggtgggtacttggttacagtctaaaccctttaccgtggctgagtaggtattttttcagcctctttcccaggttgcgcgctgcgtttagtgctgtcattctcatgtgcttcatgtcactgccaatgtgttcagcctctcaaatgcaagctccgttcatttactcattcatctcatatgtttttgatcacttatgtgctcaggtctcctttttcaaatcaatattatggcaattctagtaaatgatcagggaaattaaataggtcaattcatgtgacatagttctgaaaggcaacagagtgattggtggaattgtggaaatgtttttcacatttctccaaattttcttttaaaatcagacaaacaaactgacacttacttttcagtcttttcagatatgttccccaactctgactctagtacttgaaaatgtactaagtaagagggctttgggatgccagaaatagtctgttacttaatctggctgctggtttttaaaccagtttgtgaaaattcctggagctcagcacatggtttgttcacgtttcagtatgtctgttatactttaataaagaaaatgaactttttactgatagagtaacaaagaaagtgccaaagagaaagaaagcttgagaacctctgatcaagttcagcctcttcatgttatggacgagggaattgaagcttgggaaggaaaaattacctggggactgggggaatgtctcataaccaggacttgtactcaggccttctgactcctagttcatctgactttcctaactcattgatcaggaaaggggtggggaagaatctggcatgcgctaacattggagctgggcgacattctcagaatcccagatgtatcctgcgagtcagcacttcactccctactctttctgccctcctccatccccttccccatggcagtttaaaaacagacacttttatttcctgcaaacctggagatacttgtttcatcacctaagaatcatttgactgcatatgctgagaaaaagggaaattcgtgcctgtgaaatctaacaagagcccagcacaaggtatgtttgatcctcttttaaagccatttttagtttggtgctgtgtggtttaaatttagaataacatttctacaactttgggggaggggcggtgatggtggcgtgcagagattgaacccagctgtgactcctgctgctgtgagataaatgggaaaatctgggaaccagtgttaaaaggagagggctctttagagaggtagctgcagggaaggggacgtgccttaattgggatgggggtggaggtaaggccaagaaacagtgggagctgtctcctccccctcttgccctgtgggatctgacctactgaaaacagagtgaagactatttctgatctggtttggaaatccagaatttaatattaaaatacacgttaaatatttcaataaataaatattaatatgttaatattaatgttaagtcagaatgttaaaatatacatctaatatatatacacatacatgcacatgcatgcacacacacacagcttggaattggtagtgtcatcctggcttcattttacattctcaaaggctagatgttgggtttccagagtgctgtttcttctgcctgaaatacattttctctcctatttgcctggctcagttctgctcctctttccagtagtagcttcctctgactctaggtctccttcccactcgctgcctataacaagtttccagagcatcctgtgttttcccttttgtgtcacttcccgtatttttaattattagatgaaatttgggcacggcatatgtccttaatacatagagaaaagaagagaagacaaggagtcagggaagataaaagaaagctacccttggatcgcttcttttaaacttagcaaggtagacaggttccttaacttctctgagcctcagtttcctcactttcaaagtgaaaatagtaatacctaataaggttgttgtgagattagaacctaataaggttgttgcgagattagaaataatatattaaaggcacctagcataatatctaacacatagtaggtactcagtgtaacataatttaaaatgtatatatactcttaaaaggaaattatgaaaattcagaaaagcacagagaaagcctgtgaaaacattcattgtcccgtctcttagagataattgctgttaaattgagtggattctttttctgtgtgtatctttatgtatctatataatgtactgagttcagattattcatatttttttttcacttaatatgacggcccaaacactctccacatttttagtgtctgtaaaatactgccatgttatattttgtaataataactgggccttcagttattaaaagaagatttagaaactgacacttgatccattcaaactctacttttaccaggacaatatgtttacgtgttaggaggataattcatatccctgggtaaacaaatgatgtagtggacaaggtgcaaaaggactcctccctccattccttcttctctctctctttcagcctttcttgcttatttccatggataggagggttattttgatttttaaagtaatgaggcaactaggtgaaatgaagaaatccattggcctggaagttaggaggtcagaaattttccttcttacagtccagtcactgactcactttaaggcagtcttttcattttttggtctaatttttttcatttgtaaacatgggagaagtgggttttattagagagattttcagactgggcttttctgagtgagtgttagagttctgtggagatgttttttcatattaggtagatttcctctcaagggaaaattacatggctaaaaaaaattaagtttcacgtttcaaattttattttattttttagacagggtcatgctctatcacccaggctggagtgcagtggtgtaatcttggctcactgcaacctctgcctcctgggttcaagcagttcttgtgcctcagccttctgggtaggtgggtgctcgccattacactggctaatttttgtatttttagtagagacgggctttcaccatgttggccaggctggtctcgaactcctgacctcaagtgatgtgcccaccttggcctcccaaagtgacgggattacaagccttagccactgtgcccggctcaagtttcaaattttaaatgaaatctcagtggactttttccttttttaaaattgagatataattcacataccataaaattcaccttttcaaagtgtacaactcagtggtttttagtatattcataaggttgtacagtcatcactactatctaattccataacgctttcatggaaaccattaatagtcgctccccttttcctcctccccctagcccctggcaaccactaatctatttgtccctgcggatttgcctattctggacatttcctgtaaatggaattatagtatgtggtctggctgccttcacttagcgtagtggttataaagttgatgcatgttgtaccctaagtacttcatttcttttttccattccttttagttttttttttgttttgttttgagatggagtctcgctctgtcacccagactggagtgcagtggcacaatcttggctcactgcaagctccacctcctgcgttcacaccattctcctgcctcagcctcctgagtagctgggactacaggcgccagccaccacgcctggctaattttttgtatttttagtagaaatggggtttcactgtgttagccaggatggtctcgatctcctgacctcatgatccacccacctcggcctcccaaagttctgggaccacgggcgttagccaccgtgcccagccctgtttaaaatttttattttactcatttatttattttgacacagagtctggcccagtcaccagggctggagtgcagtggcacgaacatggctcactgcaaccttgaccttctgggctcaagctgtccttctgctcagccacccgtgaagctgggaccacaggtgcatgccaccatgcctggctaattttttcatttttttgtagagacaaagtctcacttttgcccaggctcaagtgaactccagggctcaagtgatcctcctttgttggccctgcaaagtgctgggattacaggcatgagccttcacacctggcaccattccttttttacagcattttagaaaaaatttttttcaagtttggaaaaaaaaagttttgtcaggctgttagaattcccgtagcagtagaatgcattatctgcagtgtttgttgagatgcaaaaacaatttcagtacttcagacttttaaataaaaggctctatttagttcatgtgaaaacttttaaagctctgcccttcccccttaaagctaagagactgatatactgattgccagtcttgttttcctcctctgggtttaggggaggggattagggccagactttcattggataaaggtagttgaggctggggttaggctcttttcagaggaaaaatcaagatattaacctgtcaccagaaggaggagggatggatggtgggtgggttaaaacaacagatgtcaggtgtacataactgggatggactttatctgctgcactattggtgcaaaatcctttcctcttatgtgtctcctggtgttcctaaggaaagtataaggaagtcacctgcagtttgtagggaatgagctatttactcatgcatgaactgtgttctctagttaaaaagggattgaaaagaagaacaatatcagagtccctatccaaattatgaactccttgaggtcagagattgtgtcttgtcacaattatacctccagtgtttgatatggaacctggcatacatgagtcattcagtgaatatttgtgagattacttggttttttgccttgttgacttaagaaaactttttattttgaaataatcatagatttgtccgagagattccaaagaaatgtacaatgatatcctatgcatccttcatcctctagcctccctgaatgttcacatcttataccaccatagtacaatataaaagccaagacattgacatttgcacaatccatagaacttaaggtttcaccagtcacacatgcactagtttatgtgtgtgtgtttatgtttgtagctctatgctatgtactatgtgaatacatgtaaccttaactaatgaccacggtgatcaagatgctcaaatatcaccacacactctcttgcattacccctttatggccacctccatttcccggtccttaacccttggaaatttagtctgttctccatctttataattatgttatttcatgattttttccagaaatgaaaccatgaaggtatccccaagattgccttttttttactcagcataatttccctgagttgcatccaagtcgttggatgtacaacatgcaccaacagtccattcctttttactgctgagtagtattccctaaaatggatatagcataatttgttaaaatatttatccattgaaagacatttgggtggtttccaattcttagctactaggaatagagctgctgtgaacatctgtgtacaagttcctgtgtgaaagtaagtcttcatttctttgggataaatgcccaatagtgcgattgctggattgtatggtaagtccattttcaattttgaaagcactgccaaactattttccagaggggatataccattttaaattccaaccattattgtatgagtgatccagtttctccatatccttgccagcaattggtatagtcactatttttctttttagcatttgtggtgggtgtgtagtgatacattgactttttgccccttctcctaccaaacaaatatgttaagttttgaactcagcttcccaactctcagtggcctggtctgtgatttccataggcctctatacttctgacctcctcctacctccatgaccttgacctgacttctctttcttctctccccagcctgggtcccggggtcccctttttacctcagaatcgctttatctcaatcctgccatcttcccaatgcctggagaaagtcacaaaagtgctctccactgctgccaggcctctgatgttacagctcctgggcagtcctttcctttacctcagtgatgtcaccctcccacttctgacaggctctgctccatacagtgaggtcttctctcagagaggaccttaccacctctcaacaagagtgagactgttcagtctgaagcccctcagcatctcctttctccatctctgcctttctgtttcttgcagaagccaactcctcatgtgtgcttatgttcccagagagcctccagctccccagggtagggatttatcagaggagtctattttcagacttcccttcgtctgttctccttttcctcagagtgtccttaatggaacacccacacctctcctctagtactgagtctgttgaatcaggatctctggaggtttgcagggcggagagtctctgtttttatcagtctcctcaaggcctccagtggggagtcagattcagagacggctgcctcagggaccctctgggcccctcttcttcacactacccctcagtagtgttttccccaaattttggagaaccaaattattttgttctggactcactgttttttgtttttttttttgagacggagtttcactttttttgcccaggctggagtgcaatggtgcgatctcggctcactgcaacctctgcctcccaggttcaagcaattctcctgcctcagcctcccaagtagctggaattacaggcacccaccaccacgcctggctcattttgtattttcagtagagatggggtttcaccacgttggccaggctggtctcgaactcctgacctcaggtgatccgcccacctcagcctcccaaagtgctgagattacaggcatgagccactgcgcctggctgactcactggttttaactctgtggttttccatctggttcctgcatttctgcccagctcctttaaatttatattaataattgtaattatcaggttgctttggttttgtagtcttattggctcctgctttgcagtgtcatcagtttcatctttacaaactctgatgctctaactttcttgcataaacagcagcaattgctcttctttccttgcacagaggtaggagtgttctcaatatgaccaccatctggtttcccagcctaggttttcacaaatctcctatacatgatttatgtggcccctgaaatgcctggcgtacaattgctcagaccatgttctttttggattttgttattgggcctcatcttattgcccctgccttagaagtacacctcccaattcagtctttggtcaactgaaatttattctttgtcaaagaccctttcccacagtttattccctgcaacgttttatgaattgttgcctgaactagatgttcggttctaacaatatatattacacatgatgccaagcactgttctgagtcatggtcatataaggtgattgggaaatgatcctcacccccccaccagtgttcccaaccatttttcccttctctagtctcccatagctttctctccccgcactatgattgttttttcattttcagctgtattttaggttttttgttttgttttgttttttgagaaagagtctcattccgtcacccaggctggagtgcagtgctgtgatctctgttcactgtagcctctggctcctggattcaagtgattctcgtgcctcagcctcccgtgtagctgcagttacaggcatgtaccaccacaccggctaatttttgtatttttgatagagatggggtttcatcatgttggtaggctggtcttcaactcctggcctcgagtgatctgcccgcctcggccttccaaagtgctgggattaaaggcatgagccaccatgccccactttattttaggtttttgagaggagataatttgtcaaacccagcactctgcctaccacaaaagttgatgtgcaggatatatttacggaataatttaacatatccctctacctccctgccccagcaacttggaaggtcaatgaacatgtgctgaattaaccccactcttgctgtgtgtgtattcttctctcatacaaccaaaacctaacttttgttaattagggttcagcattagccatttgaatagcagaattctaagttatgtagaacagtagttatccttttttttttctttttgagatagggttttgctctgtcacccaggctgaaatgcagtggtgtgatcatggctcactgcgacctcaaccactgtggcacaatccatcctcccacctcagcctcccgagtagctgggactacaggtatgcactaccacacctggttaatttttaaattttttgtggagacagggtctcactttgttgcccaggttggtcttgaactcctgggctcaagcagtcctcctgcttcagcctcctaaagtgttggaactacaggtatgagtcactgtgcctggccagttatcctttttgtttgtttgttttctgttcacctacagatcactttttagggttgaaaagcccatgtgcagaagactacaacagaaaagatggtaggagtgtgttggttttggagtaactctagtgaggtgatgaatgtaaatttaaaatcttaagtatacgaaacaggttactaatacatttgagaaacaataaaggtgctgcttatttatcttttaccatgtgctagaattgtgctaagtgcttagcatatattagctcatttaaacctagtactaatcctgagaggtatgttcattatattgatgaaggccttgaggatcagaattgtgaaataacctgctaaaatcagagagctaatagatagtgtagccaggattcccatataggtttctttgatcccacaacccatgttttctatgctgttttgcctctctagataaaagcagaaactctcacattgtaaagttaatgcttacctaaaatgtatattttgaaagttattaaacttttactgacccatatgaaaatgcctaagtcagtgagtgagtgaaggaatgaatgagtgagagaaagagtgaatgaaagaatagggtagattggaagtaccatatgtactagtctgtcagatatcctaatacactgaaaatcagatatttgtggtggtatatttgtgggaaaattatcttaaaaggattaaaagtccattaaaaatgcaaacaaatgaagtagtggtaatgtaaaaacattgaggggataatgagcttatatacaagatttttaaaaatggatacttaaaagttcatcagtcagtagagtaataagatgctgttgtagttcattttggcctcacttccttatctccttctttaaaagtccttcctcagtacctcttgagtagtggttatttattcctattacaatgtatttcctttcatttattttatctttttagactttggagactaggtccattttattaagcttcaagagattgaatgaagaacaatcactcccccatttacctacctccatttactttgccatttaatctcttttatttatttttttgaggcatggtcttagcctgttgcccagaatggagtacagtggcgcacaatcagggctcactgcagccgtgacctcctgggctccagtgatcctcctgcctcatcctcccaagtaggtgggaccacaggtgcatgctaccatacctggctgatttttgtattttttgtagagacagagtttcaccatgttgcccaggctggtcttgaactcctgggctccaacagtctgcttgccttggcctcctaaagtgtcgggataacaggcatgagccactgtgcctggactaatttcttttaaaagggtgccattacatcccatgaagtgctgggaagaacactgggggtcttagcactgagaatgtaaatgcttatttgaattctgttttcagtgtaatactcagccttgtactctgcctggtgttcccctgtccattgaacctcttgttgccctctccagagaataaatctctagtcttctgttggggttggggaatggcaactgcccatctgcattgtctgaggaaggggatctgggggtctgtcttagtattgccttcacctgtctacattgccatcaaatcctgagtccttaggggattccacactgtaactcagcttgccaggttaggatttagcttaattcattctgtttttattttctaaaatttgttgctgttttctctgaattcataagaaagttttaaaaggtttgaaagaaaagcaatacagagaagcttaactctaacatgaaaaatttataactaatggcaacattgggaaaaagcaagattggcagcatatgaaagtaagaacattgcacaaatgggcatatttagtcagaattcttaggagatgaactgctaaacatcggtttcagaatcctacataatgatttgtgagtgtgtgtatgcccaaagaacattgaatttgtaggcgaaattttaagtacacagaaaagtgtaaagcatttataaagtgaatacactgtgtaactagcatccaaatcaagtaacaggaggttactagcaacccagaagcccctttctagttcctgacaaccctccaacctctactaagaataactaatgacccaatgttttacactgtagattcattttgttcatttttgaattttgtataaatggaatcatttagtatatgatcttttgctctcatttattttgcccaaatttatgtttgtgagacccattgtgtggtagttgtagttcattctttctcattcctatatagtattccattaagggaatatactaatttagttttttcattttggcagacatttccagtttgggtctgctatgaaaagtactactatgaatattcccatatgtgtcttttggtgcccatgtgaacatatttctgttggttatatacatatttctgttggttatatatgttaaaaattactgggtcacatggtatgtgcatattgagctttaatagatactgccaaacagttttacaaagtggttgtaccaagttttactcctctcagcagggtgtgagatttctagttattccacatctttaccaacatttgatactgtcagtcatttaaatttttttttttccccaagatggagtctcgctctgttacctaggctggagtgcagtggcacgatctcggctcactgcaacctccactttccaggttcaagcgattctcctgcctcagcctcctgagtagctgggactacaggcgcgtgccaccaagcctggttaatcttttgtatttttagtagagacggggttttgccgtgttggccaagctggtcttgatctcctgacttctgatccacccgccttggccacccaaaatgctgagattacagatgtgagccactgcaccaggccagtcatttaaattttagccattctagttagtgtatctgtcactgtggtttgcatttgaattttcatgatgactgtgaggttaagcacctagtcataagtttattgggtatttgtatgtagtcttttgtgagaggcctgattatgaccagcacttttatctagactttcccagccaccagaaccataagatacaaatatgtattgtttaagctatctggtctatgctattttgttacagcagcctgagcttactaaggcagaggggaagtgctattgtaccagtaccaaacataggcctaagagcactgtgtcattgttgtttttttttttttttgagacagagtttcattatgttgcccaggctgagatgcagtggcatgatctgggctcactctaacctccacctttcgggttcaagcaaatctcctgcctcaggctcctgagtagctgggattataggcgcccactgccacacccagctaatttttgtagttttagtaaagatggggtttcaccatgttggctaggctggtcttgaactcctgacctcaagtgatccacccgcctcggcctcccaaagtgctgggattactggtatgagccactgcctctgtctgagcattgtatgttaaaacaacacacgtatatatcttacagttctggtggctggaaaagtcaagataaaggtgccagcagattgccaaattttcagctgcgttttctgccttttttgtactgatttgtagattttcttagagatttatattgagtcctttgaatgtatgtattggaaaaatcttctgtcaatgtggtttatattttcactttcttaatggtgtctttggatgaaccgaaattctttaatgcagtctactttattgatttgcttcacagttcctactttttgagtactgtttaagaattctgtttgcgtcaatatcgtgatattactttatgtaggttttcttctgaaagctttgttttagagtatattgatttttaaaaaatttaaatgcatttgttcacatatcagcctgatctattgaaaaacacttaaacacttaaataagcttaaataataacttttccacaaactatctatgtgatcttcggcaaggcagttagcattttttgttgttgttgtttatttttaaattattacctttcctatggtgctgaagggcagttagcatttgaacttaatttctttaactatagtatgataataataatatccatcttagagtattgttgtaagcatcatgactatctaaatgttagctattattaaaaagtcagctattagcaaagacattttcagagacaattggagatacttagatatagattggatgttagatgacagtaaggaattattaattttgtgttgtgtaggaaaatgtccccattaggaaatgcatcatgaaaaattaagaggtgaagtaaaatgtctcaattcattctttaaaagttcagcaaaaacaataaaatcccaaatatctagataaagcaaacttgcaaaatgtttcaaattattgaattttttgtttgtttgtttgaagtggagtcttactttgtcacccaggctggagtgcagggcactatcttggctcactgcaacgaccgcctcctgggttcaagtgattctcttgcttcagcctcatgagtagctggaattacaggcatacaccaccacacctggctaatttttgtatttttattagagacggggtttcactatgttgaccaggctggtctcgaactcctgaactcaagtgatccacccaccttggcctcccaaactgctgggattacagatgtgaaccaccatgcctagccaaattattgaatttatacattagatatgtagatattcatcatgtgaaattctttcagcttttttggtatgtttgaaattttcataataaaatattcaaggaaagttagtaatgaatctatagcattcctattatttaacattttctccaaagctaaaggtgcagaaggacctaattaaatggatttgagtcacttagcctgttctgcctgggaaaggagattaaaatgaatttaaaataaaatgtgaactatatccctgcatacttgagtgggataaagctgagccataaaaatccaggttttactgggtgtagaaaaaaggagaaggtgaggaaggggtatgagatgtactgagtgctgttaagggtcagatactctgctgggtgctgtaaatatcacctatcattcataaagcaattctacgaggtaagcaatattagaaaagtttgatatgaaaagtttgatagaaaagctttggataacttgactaacacaactagtggatagtggagtgaggatttgtacccagatctgtgtttttgcacacagatctgtttttgcttttcttctttcgttcctactttcctctctccctcccaccgttgtcacttttttcccaccttcactccctttccttcgttcttcctttctttctgacttctttacaaatgtttttattttttatttactttttactttttgagatggagtttcgctcttgttgcccaggctggagtacaatggcgcgatctcaacgcactacaacctctgcctcccaggttcaaggaattcttctgcctcagcctcccgagtagctgggattacaggtgcctgccaccacacctggctaattatttgtgtttttagtagagacggggtttcaccatgttggccaggctggtcttgaactcttgacctcagatgatctacccaccttggcctcccaaagtgctgggattacaggcatgagccaccgcacccggcctggttttttttttttgttttttttttttaatgaatattacgcttttcattgtagaaactctggaaaacacgtttgtattaatttaggttttgctacataataaaccaccccaaacttttttcttttttcctgagacagggtcttggtgtattgcctaggctggggtgcagtggcatgaatgtggctcattacagcttcgacttcctgggctcaagcaatcctcctgcctcagtttcctgagtggctgggaccacaggcacacaccatcatgcctggctattttctttaatttttttttgtagagatggggtctcatcatgttgcctaggctggtctcaaactcctgggctcaagtgatcctcctgccttggcttcccaaagtactgggaatataggtgtgagccattagacccagccagtttttttattttttatttttattattttacactgtgttgagataaccacccccaaaattagtggcttaagacagcatacattcaggtcacaattctgctggcagtaatttaaatgggctcagagggcagttcttccagtctgggccaacctcagctgttgtcattggggctcactcaaacgtatgaggcatcagctgggatgtcaggatcagctcctccatgtggcctcccatcctacagcagactagcttgggcttgttctcttggagaaggagaagaggagccaagagagcaagcagaaatccacaatgctcttgggcctgtgtctggagctggtaaaacagtacttcccctctgcctcagtcagctcaggctgctgtcacagaacatcatagactggatagcataaacaacacacacttatatctcaccattctggtggctgggaaagtcaagataaaggtgctggcagattcagttgctatgaggacccttatcctggcttgcagaaggctgcttgctgtcttctcattgagtcctcacatgggggtagatggggtgtgtgtgagagagagccagagagacagtgagcacatgctctggtgtttcttcttttccttataaggacactaatcccatgatgggggccctacccacataacctcatttaaacgtaatcatcttccaaaggcccccatctccaaatactaccacactgggagttaggccttcaacataggaattttggagggacacagacactccccaacaccctctattgtacaaagcaagtcacaaggccagcccagattcaaggagtgaagaagtgtaccctacctcttggtgagaagaaatataaaataatattgcattgtgatatgggtggcagcaagtgagggtgagtgggatgaatgtttgcagccatttttgcaaacattttttcataacatacaaaaataaacatctactttaagtcatttctaataccattatcaagagctaattattgttaatatgttggtctatgcacaaataggggcagatatgcacgtacagaggcatagttttgtctgtacacatacagaggcagattgcttttaagaatataattttcatttagaatcaaacttatgttctattagtgtattttcccaggtattaaattttccttgaaaacatgtttaccctatgatgcaaaggaaatcaacataaattactatgttccaggcattgtgctaagcactttcactcagttatcttaactaaaaaacaagtttcttgttaatttgcagggttaatttgcatcaaaacaaggaattcatttgttgctacaaagaaaaagcaatgaaaggactttgtgaaaaggttcagagaaaatgataatggttaagacatatcagcaatacccatttttctcttgaaacctgacttgtgaactataacagaaaatacagaagataaatccttgtacctattgcccaccaatccagtctttccattttataggtgaagtcatgtcattatttatgtatttgtttgatttggctgtatttcaggatcatgttgaacatcagttcttattgtatgggtaacataaataagaagcagaaaatgtagagggcaaaggccaaagtttgatcctgggcttgggactgattagttgttgactatgaaaaaaaaatcacttaatttttttgagttcaattttatcatctgtaattacaaaagcttcaatcttcttaaaattggtgtgaagattgactacagcattttatatctgcactgtctgatgtagtagccactggctataagtggctattgagcatttgaaatgtggctagtccaattgagatgtgctgtaagtataaaatacacagtagattttgaacacttaggtggaaaaatatataaaatatcttattgattacatgttgaaatggcaatatattgtacccattgagttaaataaagtgttattaaaattaattcacttgtttattttttaaattcacttgtaaaaatttattttggctgctggaaattaaaatattacacatatggctcacattatatttctgctggacaatgttttgcttaaaaaatgttctctgtacaatatagagtacagcataaatgttagttatagccagaaaaaaagtataggaggtttagttgaatatgtaaggattctaagtggtagcatgatgcttattatttttgctacatttataatgtaagcttttatttaggcatctgaagtttttctttttatgtgttatagagaagtagggatggaagtgctaatccaattatgtgaggaaatcataataacttcagtgtattgagctacagtgatgcaggcattgtgttaagtactgtattaggcaggattcctttgattacaagtgacagagatgcaatctgaattaactaaattgaaaaagggggatcttgtaattgtatgaagcatgggagtgcatctgggtctcctgaatttctagaatataaacactgtttttcctatatacctatcttcctctctcaaatttacttctccctcctcagcagcattgttctctcagatcacttgtctccatatgtcagaaagaatggctccttcaacctctgtgtgtcatctttgctctagggaaggatagactcagacttgctctttctggttttaaatggaaaagtcctgtgaaaaagccatggttgacctagcttggttataggtacctatccctgggctatggcagctctaacccaaccacagaagagaatttcccagaaaaagggaccattcttcttggttgataaaagaataaatgtacactatagctactctagctaatttaatatgtacagccaatcagtagggtagtacctcaatgaacaaatgagaaactgagactcagaaaagttatgtatttcattcaagttcaaatatccaggctggaagtctgggtctgtccatctccaaagcccatgttcttaactaccacactgagaaagttctagtaaatggggtttgtgtcgacttaagttttactgaattatttaataggtctttgctatttttttcctcctatcattgcttcccattgaaagttaagatagattgaggacaagggaactggccccatggtaatactcagtaaatccttatggaattgaaaaccaacaccactatgctctccaatcttgtgaccaaggctataaaggcgttagaaaagcactgctatcattatctttgtaccatgagcttaagacatagttaccactacttggacatttcctttttgtaatttgcagtcttctgccttcttttgaaaacttcttatttttcaccaacacatggttccctatagtctataccacatgggcatagagatttcagaggcaaagatgaaagagtcatactctgttattcataaataaaatatagccaaagggaattttaaaaaatgatgatctgtaagtctttcagaaaaatggtctggagtttgtcagtctcctactcggatcaaaaataaagtcaaagttttcaactaaaataattgcaataggctacaaatctgtttgtctactttaatacagtagaaatggaaagtagaagtaagtgacaactttattggctgaattcatattaagcagtgtgatggaatgctgagaactctgacccggactggtcagaaaaccagtctcctatatgtagctctgtgaccttaatcagtaataagtacaaaggctaactaaccttcattgggtgctaaacagcgtagaacatcttttcataggttgttgactgactctgcccagtggcagtagttattcattcattcgacacatctttttttttttttttttttgagacggagtctagctctgtcactcaggctggagtgcagtggcgcgatcttagctcactgcaacatccaccttctgggttcaagcaattctctgcctcagcctcctgagtagctgggattaaaggcgcacgccaccacgcctggctaattatttgtatttttattagagacggggtttcaccatgttggccaggctggtcttgaactcctgacctcgtgatccacctgcctcggcctccaaaagtgctgggattacaggagtgagccaccacgcccagcctcattcagcacatctttatcaggcatctaccctgtgtcaggcatggagttaggtaccaaatatggttctgctatcatggagcttacagtctggtgtgggaagtcatacatgtaaacaggcaatttcagtgtagcatgttgtaagtgctatgttagaagaagtagactgttctatgggacctcataaaatgatatcaaacgtggttttgagaaattggatggtttcctgggacatgctgtccatttagggatctgaagggcaggctgggattggccaggtgggggatcacaacaaagctctttgtctggacttagaaagaggttgggaagggggaagtggtgaaggctgagggctgagtcttgagggaaattagctggtcctagaatgcagagtccattatgctgactacctttgactgagggtgataggaaacccttgaatagttttaagcaactgagtcacataattagatctgcattttagaaagctgagatgtgaatcaattttttcatttttctgtcttgattttcttatctttaaattgaaagggatagtctaccctttataactctgtccagctttagtagtccatacatttctcctattttggcaaaacttaatgaaactgcctttgcaaaaattataacagtgagaaaattatgacagtgacagatctgacttaatgactccattttgctattctaaccttcaagctgcccttgttcattgttgggcgcaggctgaactaagtttgggaggaacttagtttaaccttgaaacaaagatgataacagcccttcttgcctgaaaccagactgcccatgtaggactaataaattagctgcaagattggaaatgtaggtttaggagtcctgtagccggaggctgcaagttctgaacctcccccattgctccttggggtaacatcattattgtgaaacctaagattggtctgagatgtttttcagaccttgcattctgaggcaccagctggcgccacccagactggtaatctggcacaaccagttctgcagtgcctcccaggaacagaagacagcaagaagaacccactttaaccccctatgattccatctgtgacccaatcaatcagcactccccactccctggctccccctacgtgccaaatcatcctttaaaaaaaaccctagtgtctgaattttccagggagactgaatcgagtaataaaactctgatctcccattcagttggctctgtgtgaattacactctttctctattacaattcccctgtcttgataaattggctcttatctgggcagtgggcaaggtgaactagttggatgattacgttacttccatgctgattttgagatctgttgggcagcaaggcctaagattacaactagtacttgaaaatgaggcaagttttgtgggtctagggtgggtgaaggtgggaggtgaggtgaggacaagaagctgaatgaatgatgtgttgtttttactgggaaaaaaggaaatgggaaggtatgcagtttcctttgacagtctcctgaagagaaactggttaggaaatagctttggcctctcagcaagcaggtggaatggtactttgccacaattctagtacagatgaaatctgatagttacttcccccaaattatgaagtctggaatttgcttaacggtagtagttaggggtctatacatatgaaaaaagactgaccatgactttttttttttaaccgttcaaagtgtttgttaattatttattaagataaacaatttcttagcccacatattcatgtttcacagatagttcaggaacacaggtacagtgacaaacttctatgtaattcaacccaaagaaatactttatgttccaaaatcactttgtactctgagagatattagccttcctcatctcaaattctttaattcaattataatttctgtagaaatctgcatatgccttctttcttggtcaggccacagcaaacttacagagagctgcaaccccagggttataaggaatgctccaacaatatgaaatgacagatgcttggccagaaggccacacatcccaggttacaccaaggcactgagagccatggtagttattgtccttgacagggatgtcagcatcaacactaatgtctttcccggatgatggagaaatggaccaacttgataagtattgatgctgagtgatacatacaaagaagtccattatatgattttccctacttttgaatatgtttgaaaatttccctaatagaaagtaaaaagatagaataataaaataaaaatacccccacttattacctaagttttcttttagcacaaatggaaaataagtcagactctctcatttggccatattgaagctaatagtctcagaaccactgtgtcataacactgacattttgcttaaagctctgtatcacctttaatggcttaaaatattctagactgtattgagatcatgcaagtagatcaaagaaagagaattacacgcaaaggaagggatagctgtactagggagttcactggtaacagagtcaggggtccacagctctgggctgggtctgtcctgaaaggcagtctctggatagcaggatgagatggagtgatcactggctttggagtcagacacaatagactgagctatgttgaaggacaatgacaaataacacaatagatagcattcattgaaccctcactatatgccaggccttatgctaagctctttatgtactttatgttatgcaattttaataactaccctgtttttattagtattttatggatgagaaaacacaggtttagaggttatcaaatttgtccatgaccacatgaacttgtaattcccagtaaatatttttgtaaataaatatctgaaagtgtccaggcacggtggctcatgcctgcaatcccagcactttgggaggccgaggtaggcggatcacctgaggtcaagagtttgagaccagcctggccaacatgctgaaaccccgtctctactaaaaacacaaaagaattagctgggcatggtggtgtgtgcttgtaatcccagccacttgggaggctgaggcaggagaattgcttgaacccgggaggtgagtcaagattgcgccactgcactccagcctgggcaacaagagtgtgaaaactccatctcaaaaaaaaaaaaaaaaaaaagaaaaaaagtctgaaatccagtggttaatggtggtaggttgtaccccagttagtttggatgcacataacagaaaaaagcaaaataacagtggcaaaataataactaagtagtttgtttttctctcacctctaagtaatctagaggtaatcagtctagggttgctagggctctctggagctcggggttcttctattttactgtttcattgtgaatgtcttccaccctcaaggttaactcatggtccaagtacctgctggagctccatattccaactagaagaaagggagaaggattggaaggacataccacctaccctcctttttaaggatccataccagaaattgcacatattatttttgcttataattacaatggctacaacttagtcctatgtatgcatctagtagattacagaaaacttgcatgtggcaggtccaagacatgaaagagactgaaaaatatttatactatgtggccacatgcccagctaaagggcacagaagcatagaagatggagagcaacattgaggatcactagcaatcactgcttagcccacactcagctgcattccagagttttatctctttgggtatggtaatccttctcacgaaacctttcacattcgaatggataaatacatgaaaaacccatgcacttagtttagtgttcagaaaatgctagttccttccctttaattagatgttgtcaagtgagcagcagtgatttggtgctctggagactcagcaccctaagaatttgttccacctgtgtctggggtggtgactgccttctgcatcaccatcttagaggatttgccccaagttctacatcctctatggcccagcaccctgttaggtacaatggggttgcaaaatgaagcatccagattttaaggatcttgaacataaaatcacacataatgggctcagggccaaacatgggactatccaggatttaggaaaactttcacttcagtgttggtttgcagctgactttgggaaactatttaccacataaaaatttccagtgttttcttcaagactgagagaagtcgatcacagaaccagcccacttgagaagctgaagttttcctacttgtaaaatgacagatgaaaaggactgatgcttccatgagttgctcttgaaatggtaatgtaggtgtatctgtgtgtggaaaaacacactcaaagtgccttttcttattttctcacaacaaaaatcaacacaaattaaaggcttctgtgatcaaatgggcacttccccccccacaaacaaacaatcaattctgcagtggacaccagctgcgtgtcctccaattctgaaactatctaccaggagataagtgtcagataccactgacacagtccccaaaactgctcccccaacctaccacctccactttcagacaccagttgcaagtctgggcctctaaaacttctgatcgaccagattcaagtttgggttcccatgatcccctctttgggttgattaatttgctggagcggctcacagaactcagggaaacacgtttattgggttataataaaggatattacaaagatacaaggaaagggatgccaagctgccatgccctctctgggtgcaccatcctccaggaacctccacttagctatctggaaggtccccaaaccctgtcctcttgggccttgtatgaagacttcattgggtaggcatgattgaagcatggacaactgtgttaaaatgtgattcatggacaaaaagtatatgatctaaacccaataaggcctgtttagactctgtttgtcttctctgtgcagcatttcttcccccagggatggggcaggacaccctctgggatgagggtcttatgacccacaatcagataagagtcctgccttggacaggtgaaagtagggaggtagaacatcagagagagagagagagagagggagagaaagagaaagaggttttgtttactatgtcgagggctatgggagttatacaggaactgtggattttatatataatacgtattatatatattatatatataatatataatatatatatatatataaaaaatatatataatacgtattatatatatttattatatattatattatacatttatatattatgttaatatatacattaatatattatatcaatataatatactattatattgatatattaatatataatattatatatattatatattatataatataatatataatatatataatatatatgttacagtataacattgctgtggtttgaatatcccctccacaactcatgttgaaatttaattgccattctgacagtaataggtggtaccattaacaggtgattaggccataaggggtccaccctcatgaatggattaatgccattactatgggagtgcactcttgattaaagggagtttgcctcccccttaacccccttgctgtctcttcctttctttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctgtctcttcctttcttatcctctcttgccttcctgccttctatcatgggatgatgcagcacgaaggccctcaccagatgtaggctccttgatcttggactttctggccccagaaactgtaagaaataaatctctgctctttgtgaattacccagtctcctgtattctattatagcagcacaaaatgaactaaggcaaacgttgttatactatgagcatgtccttgaaaagtcaaggataagttaaatgttagcaaatggaaatgtgttttttaagtgagctcattaaagaaaccagagcgattttttctgtaaactaaagatggcttccaaaataaagttttttggtattttcattcaattagcagatacttactgaacacctattacttggcaggcactgtgctagacctcataaaacatgatgggtgttgtcttcacctgccagagttgctcaaaatacgtgaataataaattgacaaatatattctcagactaatatacggtcaaataataacatttgttacatcggttataaaagttttttaacatattaacatttaagaaatcttggggtatcttaagattgatagtatgtcatactttctttagtagcatatttttcttatgttgtgacttaaaatggatggtttcttagatttgataacatgcagtatttagggctttagtgtttattatgtgcttccatgcgcctcatttgattctctcttcttttttttttttgagacggagtctccctctgtcacccaggctggagtgcagtggcatgatctcggctcactgcaacctctgcctcccaggttcaagtgattctcttgcctcagcctcctgagtagctggagctacaggcacgtggcaccatgcccagctaattttttgtttgtttgtttgtttgttttttagtagagacggggtttcaccatgttggccaggctggtctcgaactcccgacctcaggtgatctgcctgcctcagcctcccaaagtgcaatttccataagttgcccaaaccattttccactgaccacacttagtaaggcaggtcagatctaaggaatgacctaaatgtccttcagctttcactttgatcagtggaattgcctctttaggctgcctcagtggccaaagcatgatcagaaagatggaggtttgaatcctaactgattgttgtgtaaccctgggccagttacttaacctctccaagtctgcctcaaaataagaataaaatctttagatttaaggtaggtaaggcacctggcaaatgataaataatcaatggcagttattttgttactattagagcatcaaggaaacacaggtttcatgatattgggttatcttaaagaaaaaaaaaaagccctacctgggaaatttgtcctattttctggaagacccagaaccccatcaaacaccaagaacagatatccccactcctaagaaacattataggaatagttcagattttcttctgttaaatgtcatccatcagctcacccgattttttccagcagacctcctcttctatcttgtgtgttgctttatatgtcgctcttgacagctgctactatttatgcatgcatttctatagcaaaaccttgattaactgggacacagcaaactgtagcacttaaatgactatggttttcccctatggacatcatttggaggagagagggaagtgacaactaaagttttgagaactgaagagaatcatgtaattccacatcttcgattttactgctgagagaaggagaatggatcaaggccaccctgctgattaagagcagagtcaggagaggattctcggtctattttgctttcttctggactgtggcctaaagatgtgtcttttggcatctctcttgggggtatttctccttaaggttttgccactacactgcaggtctcaaactcaaatgcctgcaagggctaactggtaataggaatgagtggaggaggctgagtattctacattgggaagtagtagtgaactatggtcctcagactggagcctatataccctctgtaaaggcatctaaactaaaatgtttttcattttaagaagtacaggaccgacaaaacacatctgggagtcagagatggcttgatgttccccagttgaagtgccttgcactatgtatatctataggccttattcaataaggagataatctggattatggccctcaggcacattgccaaagtaagtttcaatactgtgcattgatttatgtttgttaaaacagaaaattgaagagacgcattttagaaacctgatcataatatattttgtaacagagagaacagagtagaagctctggcttcatttactgtctgcttagccaaaactctttgtggtccaattagccaaatgaattcagatgtcacagtgtataggacattcataattgggaacactaggacctcttagtaccagagattgtcccataacatagacattcaaaaacatttataatcaggacacacagtgagaaatacatttatatcattactgagcagaaacatacacacactcatacatatcacacaaacccaaaacaatattttaagaaacaatatcttactgcgttccaaactctgatgttttccaacctatttcatttttatgaaaatactttataatttactcatcggctacagcatatagtttaaatcactggactaggtaatgccatgacatttttgtttattcattaattcagtagatatttactcaatatctaatgagagcgaggtgctctttggagtgtcatgggggacacaaacatgaacaaaacatggatttttgccctcaaagagtccaaatccaataggaaatacatacacgtgaatatttaaaaactcagggcaaaacaatcagttcacatttgacaaactgcttttatgttatcatagtcataatgataacaaatctcttaggtaagctgggcagatttaaacttaattttacagatgggaagttgcatttttgaaaaagtgacattttaaaaagaagtggaatgatagtaataatagatagcatatgttaagcacttattatatgttaggaactaatttacttcttactataaccttattatgatggcattactataatcctcactttacagaggagaaaaatgaggcagagaggttaagtaacttgcccaaagtcatagagccaggagtcattggaactaagaatcaatcataggcaacttcaatttttttttttttttttttgagacagagtctcgctttgttggctcactgcaagctccacctcctgggttcaagcgattctcctgcctcagcctcctgagtagctgggactacaggtgcctgccaccacgcctggttatttttttggatttttagtagatacagggtttcaccgtgttagccaggatggtctcaatctcctgacctcgtgatccgcccacctcagcctcccaaagtgccaggaccacaggtgtgagccaccacacctggctggcaacttcaattttaatcaatgtattatattctctggaaatgaaaatcacagatcaaaatcctacataggtcatggcatacataccttgatctcttagcccaccccaaaagtgatgtggcatctgctgtgacaggatagcatttggaatgaggtgtgtatgaaggggatggggtggaatagagcctggttcctcagtattcctcagtgtcactaatcttcatcaagttaataaagcacctgaaggcagcaagagaaaagacaaagggaatgattgctgtccccagaagagggcatcttatcctttgccgttgtctcatgtatgatgtagtatttttgagataagttatgaagtagtcttgagtttggaaaaccaagagttaggctgtaaatgttcaccttgtgtttgaccagtgccacctcccttaagcccaaattctcattcaaagttacaaagacaattttccattaggatatccctggaaaaaataatatttagcctttattgagcttttcccatttgaaaaactaagactgccaggcgctgagcttaaagctgcacccaagacagaccaataatggtaatagagaacaattgttaagtactactctctctctcaatctgtttctctctctctctctctctctctctctctctctctctctctctctctatatatatatatatatatatatgttaggtactaatctaattcttctatataatgatggtactcatattatgcttgttttatagagtagaacagtgagatattcattgataagtatatgaatttgatctttagcacagtaaagaaaattttaatgttgaaattggtgcatatccaaatttaggcccaagccctagtttttaggctgttgtaaattaacctagttattgtattttcctgccttaatatgcttcttatatcttcaattttataggattattaatagttatcctgattgactttatttatattaagtataaagataaaattcttatagcccattcagatttttctttacacttgcaaactccagagatagatattgaaaaatacaaaggcatatgtctcatctataatttctttcagcaatatgtctgcaagttgagcaaaaataactgaaagtgctctttttgaaaataataattttcacttttcaaaaatgatcctgtatttatttatttattttttgagacagggtctcagtctgtcactgaggctggttctaaattctattaatccaatgattatagtccagcatttgtcagggcacatgatgaacactaggtatttactgtccctgtgtgtctgtaatgaattaaaagaaaaagtacagagaaagattatttaagatgttatgggaaaagatttactagacttcacagaattattactttagtcaagtaactaaaataattcaatctgacagatttggaaaattgaaagtataaaaatttgttttaaaatttttattgcagtttttcctgccaccattcagattgtttgatcttgttataaatgagcattaactctgatttgcaattcaggtcacaccatacctcatcaaagaatgcagttgggaaagcaactggccaggaagtttaggtttccccagaaggactggaaggatttagaaaacatttctttggacttcttctggttgatgctcttcctacaagaatctgtgtttgggtgatccttgtacaggaaaatgtctcttagtccaatttattttatgtagaactgtgtagagctagagcttcccggaaactttctgagacccaaatcatctggactgaagtctcttagatgctattgtttgattttgtgtccttaggtgattgatataaggacagcaagagaaaaccatgtaagatgagaagaaagcaaagctggctttgtgtatgggctcaagtacattttacatgcacgtacttttttcctgttttggtgaggaaactctgtcaaatgactcttgacgggcgcctcacttagtccctccaagttttagtagagaaaatgataatttttaaccaagacttacttgatcttgacctaagatgatgagaatgagcaatccttctgaaatcttattattttaggtgaaaataaacattcgataattacattttaagacttaccagagtttatccaggttttgttcagatccagaacttatacaatgtcggagtcttcttttaagaatacacgatgacagatacaaaattaggtacacagcttaattaacttcatgataaattctcttctgattatgagttactgctttctttggccagaattgtgaaagaaaaataaggcgtgaggctagaggatggggaaaaaaaatccttgtctatcttgcttcccaagcaggccttcaagctagctaactgaaacagtcttttctccaggtcctaaggtaaatggtggcggatctgaaaatgcgtcggacttaaccttgcccttctccccagtttattcgctcaacaaagagttctaaacagtcacatctgctctctaggcagaacggacgctgcctcctagtattagaatacccaactctttgatatctcccttagggatcatccctattctggagaatgtgcaaaatattgctcttcctttatatcctagcatagatatattctggcacttaacatgcattctttttctgttgaattgagttacaagtcagttctctaggacggttaccgtcctggtggctttggcggaatcttccggtgaaaataggctaagttgcatgaaatgggtgtgtctggattttaccacaagacccctggtcctcaaagcttcgcaggccgagatacctcgcccctttcttctctgtcacacgcgtgcgaacacaccctcccaacccacgtcgtagtagtcccctcccccgaccaccccgccccgtttcccttcaacccccctcctcacgaacctcccctcccttcctacctccctttccttccctccccgcgggccagcggctttggcgctgccctgctgcgcggcggggcgacgcggcgacacctataggattgcttccgggcactcctcagccaggaggtgctggcctggggcccggagctcggcagggccgggcggctccgcggcgttggcccagaggacgcgcgcccccgcccggccgcgtctccttccctccctccctcctcccggcgccccgagccgagctcagcccagggcggcggcttcgcctcgcccggcgaagcttctctccggtggccgctccttcttttccctcctctttgcgtcatgtcgggcacttaatttttttttttttttaattccttcttcagccctttccaccttccatctcccttttcgcttcccaggttgattattttctcttttctccgggcttgcccatgagcctcctcgggagctaccggaaaaagaccagcaacgatggttatgaatctttgcagctggtggacagtaacggggacttaagtgcgggaagcggcggggttggcggcaagcagagagtgaacgccggggcagcggcgcggagtcccgcccgacagcctccggaccgcgccagcaccatggacagctcaggtagcgctgcccgaggggagtgcagcgctgagccccgcgcggcctccggagcctcccagtcgcccggcccgaggcccccccgtggtcccccagccccggtttgcgagagagccgggctggaggcgaaggcttctaataccacctgggtgtcgagtctctaatttctctcatccagggagctacgaaacgttagatcagtcctgaggcccagagactgtagcgagctcctcctaatctctctagactgctgaatacggcagctgggggcggggagggggagggaaggaggaggggaggggtggagaagagaggggagcgggtggggcgaagaacggcttgggaggagggctgggagaggcagctgctttcactgcccagctggatgagggggagaggtgaaggagcatgtgcgttgattgtttttgcagcatgcagacggtatttattccaattgttattcttgcaatgctgatgctatttgcaattctgtaaagctctgccacatcttaactcagccgtctgctagggttaatgttacctttctcctgcagtttttaacctgggatctagagctcttttacacagcttttactgtttgcacaatgaaatttatttcatgtgttggctttgatcttgtttgtccttttgcttgagtgtacagatttcataaacctttacatgtagggacaaggaaattcctctaaactttgtatcggggcttgcaactgtcttttataaaaggtttggcaagttagagtcctctcttggaactgctgttggcatttgcgatttcaatagcaaaacagtcatttaatatatccatgttggactaggagtattattatagctatttgcttacttctgcagggaaccaggttcggagaattgtttacagagatatttataattgaagtcctcagtggttggttctacactggtaactttaatactggacaactgaggattccagaggaaagattcatatggggtcgtttgaacagtaatgaaatcaaactgaatttaaatgccctgctttgcaaacaaatgcttgtttattttaattgtgtaatggctgtccttgggctattattttctattttccttgtcccaaagtgggatgaaatattgtccacagatgctcaaatgtcctgggctgaaaacaaattctactcattgaagctcttattgaagttaaccaagatattgatgggacattctcttagaccattttaaataaaactaaaatgatccccaagggattgatggtttcaggactgtttttttttttttttttttttttttttgaggcggagtctcactctgttgcccgggctggagtgcagggatgcgaactcggcggactgcaaactccgtttcccgggttcaagcgattctcctgcctcagcctcctgagtagctgggattacaggcacctgtcaccatgcccggctaatttttgtacttttagtagagacggggttttgccatgttggccgggctggtcttgaactcctgacctcaggtgatctgcctgcctcggcctcccaaagtgctgggattacaggcatgagccaccgcgcccaggcaggacttttttattgatgttgtatgtggttattcaatgtatgttttttcaaatctgtgatatatcaaagtgtaatccatcttttgactggatgtaatctcctttaaatcttaaaaagattcatgttctctgaatgatgccaccataataatgtttacatgtagtgagcatgtaaacaattgaaatgaaaacaaacatattccaaatgagtgtgaaggagcctcacttcaggaaaatgaaagaaatatgaaatacatatgttttcctttttcatagggattattattttaagagttgaaattggtttttgaaatatgttacattgtagaataagttcaacatacattttctgagcccagctatgtgccaagcactgtgagggaacacagtagtgaatgagatccttctggcctctaggggactctcagtgggggcagtaactataacacagagcagcctatggtaagtcctggatttttgaggattgtctttttcactaaatcagacttttttaataggtggagagaagaataatggattgctttaataatctgttgtgatgggaaagtgtttcattaagaatattgttatctctaaagtgctattgccaggagttgattcttaaacttgatcaaagtggtgttgtgtgaagaggctgcagggattccttttctcctccccttatccatcattcactcctatattttattaggggaatattgtggctttgttgtagaagtacagggtatcttacaatgattttgatgcatattttcaactgagaatgatttgtttggtttgaatgaaggattggactctgagagtaggattcttttactagtacaactatatgtcttgcctaattatagttctttcttctaagatcctcaaagtgtggcctgtgcagtgtaaatatatccatttgtttagtatatctaattaagttcatggatcatttctaaagtggcagtaatctgcccatttattcaactgattgtactgtgacatgctggataggatcagtggtttatgggacttttgctctgatagaaatattaatgagtggaaaaaatatgttgacatctcgctacatgatttaaagcttagtcttaataataccttaaacttgtaagactgtttataatagaacacttggacaattctcttatttcatttccccagaattttattaaataggttggggaagcagcatgtgtctgtgcttggagacttgggatcaaacctctgcattattgttactcgctgaaaaacctagtaacctttttcttttcttttctagacagatagctctgtcacccaggctggagtgcagtggtgcgatctcagctcattgcaacctccacctcccgggttcagacaattcttgtgtttcagcccctcaagtagctgggattacaggcgtgcaccaccacacccggctaatttttgtatttttagtagagacgggctcttgccatgttggccaggctggtctcggactcctggtctcaagtgatctgcccgccttgacatcccaaagtgctgtgattacagggtcttgctccattgcccaggctggagtgcagtggtgtgatcatggctcactgcagtctggacctcctgggctcaaatgaccctcctgcctcagcctcttgagtagctgggactacaggtatgaaccaccatgcctggctaattttttttttttttttctttgtagagatggggttttttgccatgttgcccaggctggtctcaaactcctgggctcaagcgatctgaccacctcggcctccctcccaaagtgctcggattacagacatgaaccaccatgcttggcctgttcccatttataaaagtggaatcataagagctgttcttaccacagagctttagttgaggctgaaaacaatataaaaatacatttgcagtttttctttactttgtatcttgccctttcaatttatcatatgaagaaacttattctcagaggtggtaggagacctatcaaaggtagaatagataatgacagccagacttaggtcttctgactcaaaggtttgagtttttccccattgaactaaacttttgggtagacacaatatcaactgattgttgaaatggaaacatttttatctactttgatttcccccctgtttttagataaaagaggggtacatgttcagaggaatgtaatggctttctaagtcaacagcctctcaagtggtagataccagagcagtctcctagccagatgtgacttccagagctctctgccttccctggctcactttctcttcattcaaattattctctagaaaaggttgtcatttaaaggtcatcctgtcatatctcaaaggcactgcactatcccaatgccgaaaaccccctatttctcttgtgtgcaccccacttttcagggaaagtagaaccacaaaagtagaactttcaatattgagctgctaaagtgttccaatattgggcttaatttaccaagttcataatgacaaactgaaaaagagtagtccaattaaaatctggaaacagatattaatactttttaaagaataagtataatgataggtaaggatttctcttttgattctcactttttaggctttgttctatatatttaaatatatagaaattcacatatataaataaacaaaatattgtatatattaaaaaaaaagaataaggataatgaacaatgctaaaataccatgtagtgtgagtctggttggaaacaaaaattacctttaacaaattctattttagttagtgtttaaacacagcatccacattttgaaccaggtttcaacattatgagatacgtgtttggataattgtatacttcatggaagtataataaacatatatgtactaataatcctttcttaagaatatctgcccattgaagggtcttgtaggttggaggcaaagtttatttatataacttattttttattttttttttattttttgagacggagtctcactctgttgcccaggctggagtgcagtggtgtgatcccggctcactgcaacctcttcctcctagttcaagcaattcccctgcctcagcctcctgagtaactgggattacaggcacccaccaccagccaggctaatttttgtacttttagaaaagacggagtttcgccatgttggccaggttggtcttggactcctgacctcaggtgatccgcctgcctcagcctcccaaagtgctgggattacaggcgtgagccactgtgcccagccaatttatataacttatttaatgtgtggttatagtttggatgtttctggataatcgtttaaagatgcaccagttactggattacagaataagatacgtcaatttaagtttcaaatttcaaatgcttggagactgccagatttcatagatttggaaggggaatccctggaaccaaatctcggaaagttggccaggtagccaatggtggacactttctgtgatggagctttagctactggggcagtgtctttgaactgttctcatcagtgcagagttctttttatttgggcaaaatcagcctttctgttctctagatacaaattatgtctaatccttctttcacatggtagcccttagacaacagatttttgagaacaggtactaattctctcttagtcttaattttcctcttttctaggccaatcaaacctaagttccacatgcttttttctctatataaaatgatttccatataattatcctaagctttgagaataatgttttttttttttattattttgcacaacaggggttttcaccaatttttattataaaaggttaaaaaagaattaaagattacagaaaggaataaaatgagaaaagttaagtattctctcccctccctgatcatttaggtccttgcctcagagataacttctactaaaagtttctggaaggactttcaacgtacaacatgagtgtgtgtaaatatatatgctttacacatatatgtatatgtatgtgtataccattagaattataataaaatacaaattcaaagtttaaccatgttcatatatgtacattgttcaataatgcttaatgacaaaaatagctacaatttaattattataattcagggattatgctaaacactgcatatggtgtcacatttaaccctcataagaatcctataaggtaaatgatagtaacggtcatcttatagttgaataaactaaggcacagagaggttaagttgcgtgaggttacacaggctctacttattctatattgagtaaaatgccatagagaaatgcccatacgattgcaaatgaagaatttagtggtgaatttttttatttgcttctttctctgaggcaaggaaaaataggagtgattgagagaaccaaaatgagttcagttgttttttaatcccatgaaagtacaaatatgttttctttacttaaatataaagaatttaaaaacactggaaatgaaaacagcaaaaacagcattgaataaagctgattaagacttgatacggcactgagagaacaatacaattgatgaagcattatatatttttggaaaaatatattgcaaatgaaaatggatccccactgctcttaggataaaatccaaggtattcttaacaggacatcagaagccctttgtggcacctgtgaaagctggcccaacaaaacttgttgtcgctccactggtagatcccctccccagcctgcacctccatctttatgtttttgcatacactgttctctcaactcaggccaacttatcccatagacccctggacacccacttttccaggttatctcctattcattcttcagggtttagctcagatattccttaatcgcaggctgcatgcaatggtcattctccatgctcctcagcagcctttacttccgtatcacagctctcatcacattgagttgtgacatgctgcctggcctgtctctccctctagtctgtaagtaaagttcagagcaaggctgggtcttatttgcctttgtagtcttgtcattgcttggcatttattaggagcctgataaatacttgttggatgcacaaaagcatgaatggattttgaatttttaaaagggcatttataatgaaatatgcccatccaaatctaaaaataagcatacagctaggttttaacagaaatgaggccaggtttgagagaaatgtaactgttggtcgaaagctagaccaattcagtaatgagcattttttcatatgtaaagacactggaagtgaaagaaagatggttaatatatagcctagatccttaacagttttctaatatagacatgtcaagaaagaattagcttaccaaaagattgtgctttttcgaccaacaaatacaatctactgtatgattcatcataaaggtcacttttttttttttagccaaaaaaggaaactcaaaatgtatacaatttttttaatgaactgacaatagatgactttcatctatagatctgtgtatttcttaatcggtgtcattaagttttaatcttagccattttcaggtttaatattaaaagttctttgtatcatctttggccgtctgcagttgtatataagctttgtgctaacttaactgcttttttaaatctgtgctcaccatcttgaactccttttggaaaaaagctatgtttgagatggatgaagaatgctggagtttagattgtgcatttccttgttgcgaaaggtgtaactctgaaaaaactaaattacagttattgtatattaaacagctattcctgaaatttacttggaagcttttgaaagagtagctcagtatctgaggagaagttcttcacggtccaagaaattaggaagttccataacatgtgccaagggatctggcaatttctactacctttagttgctttatcccacatgtcacaggccatagtctagatgcaaaaaatatctttttatttcaataacacatcagaacatagttttaaaagtgctagagatagaaactttaaattaaaattaaaatgcgtgtagtattaacagcgcaaatgtcaccaccaaggaagcaaccagatgagccaatgcctcctgtgcagtgttaagtttgcatgtgcagaaaattactgttgttgtattgtggtgtagtactctacctggtagctggcaagtgtgtttggcatacattgtaagccacttcctaattttagaagtgttatgctgtgaaaaaagtgcaattagaattggagatatttgacaaaagtcagggtgaataaatagtataataatagttatataaagtgcaataggggtgcagaagaaggagccataattttaaccaggaagactaaagaaggccacagtggaagttgatatttgagccagaaatctgtaggaaaagaaagaaagaaaacccgttttgggctttgggctaatgcacagtggcatcatagtgcatggtatgtttagagaattgcatttaggcttgaagctggagcccagatgggtgggaggtgctatagcagatggtgctgggaagataagacccaggtcagggtgagtctgcttgaggaggttggactttattctgcaggcagtgggaggccagtgaagatttggagatggggtgaggtagggctgacttatctactaggcacagtgtctagaaaccacaataattttagggtccacaaaaatgtttacattttaattgcctttaaaaatcagaataaaataaataagtataacaataatgaattcatctttattcaaatgcagtcattaaaatatatgtttttttttctgttaatagaggaataggtccatgaaggtaaaaatgcctacggcctacaaaagtcatactgcagccccagggaaaagagggcaaaatgtgaatcctggagataatttacagctgtgtgaaggatgaatcccaccggtggttcctaactgtgatctggctgcatcagatgtacctgagtaaacacagattccctactatgcagccgtaaaaaggaatgagatcatgacctttgcagggacatggatggagctggaagctgttatcctcagcaaactaatgcaggaacagaaaaccaaacactgcatgttctcacttataagcgggagctgaagatgagaacacatggacacatggcagggaacaacacacactggagcttgtcagggcatgggtggggcgggggaaggagagcatcaggaagaatagctaatggatgctgggctgaatacctaggtgatgggttggtctgtgcagcaaaccatcatggcacacgtttatctatgtaacaaacatgctgcacatgtacaccagaacttaaaataaaagttgaaggaaaaaaaggaaaagaaaacacagattcctgggccccaagcatgtttgatttaggaggaaggggaggggtgtgttggaagacagagcatgccagtggaggaccaggagaacaatcaaattgcagtttagctgatgacctgagaaacaacgaaggccctagccagggcagtgtcagtgagactgggaaaaagtcagcctggggaagcattgcacaggtgaatgacagactgacaaccaaccaatggtggggtctgagatacaggagatacctggatggcagcaggagagaaggtagtatttctagtctcagccagaagtggaaaatgtgatcaactgtttttctctgctgcaagttcaccatgaacatacttgtggaagggctgagaatactgttagcttggcacaagctttcaccaggctttcagctttttggtaggctgcccattaggctgtgcagatgcccaggggagtgctgtggaggggtgtgtggtagaagcaggccctgtgtttgcctggaggaagagtgagataatgggtagaaatgctagaactgaagctctgtggctctgggctgagtccaggcctaaggcccgaggccagtacggtgtctgtatcgggtggccccttctcactgggagagccctagactctggttccttgcttgttgatggaggcacagcaagaataatcaaacacctgagaaacttggaagatgattattgaaaccagaattttttttcagaattctctggaaaaaataaaaaaaacaaaaaacaaaaaacaaaaaaaccaaaacaaccctgaccccagaaattctcagggactttcttgtaccagcatttggccacttgagcattgcggcaaaaatcttagcagataatagtcttcatttttccctgatccttattcttattttagtttcttcctcttctgcagtctttccctctcttctcttcttttgtccttctctttctctttcccacccatcttcaacttccttatccctctctcttctcctttgcctcttgtactcatctgctcccctcttctcttttctcctccccttctctctagtcagtgagtcagcatgcctgggagatgtggagccccatgccatatgcagatgactgtagttttgggatatgtgtacgcatgtgacttagttctcagtctgctgcatgtggctcaaaaggtgtgaagactggtgtcactttccaatttaggcaattgcatctggcttacctaaaatttcacttgctgcttcaatcagcaaagtgtttcttccatactgtgacttggtgatgagaggtttcatgagctgcaataccagaggcagttgcatttcattcagatgaaggaatgaattttactaatccacagcccgagagtataagataatagctcaccatttcttcccctccatctctcttactttacctctgtaggaaagcagatctttctcttcttcttccctgttgctgaagcctagatatattgctctattttcaacccttccatgtctaaattagttgaggctgttgagcagtgggagtactagggaattatgagtcaggaactccaaatctaagctctgactttgtcatttacaagctgtgaccttgggcaagtcattcaaatgagaaaaatcatactgaccctgcctttttcataggcacagtggaatgtgagaatgtaaatgaatgcatttgcagttgatactcttcattcattcattgcataaatgtctcctggctgcctactatgtgctgccactcttctagccatgggggatacagtagacgataagatagataagaccttggcacttatgagtttgattatagtgcatgagcagtgaacaaagatatatggttctatggtatgctaaattctatggagggctagagcaagcagagaatagctcaggatggtagtaggatggggagacctatcttccaggggctggtcaggaaaggcccttctgaggagataatgtttgagctgacacctgaagaaacagaaacaagcaggaaaaagaaagagcagagtgtagggcatttcaagttctaggtacagcaaatgcaaagacctggagaagggggatagctttgtagaaagaagtgtgtacctgatataactggtgcttagtgaactaggagggcatggccacaaatgaggtttgagttgtgtttttaagagactgtttggctgcttgcatagagagagtttgaggtggcttcctaggtattccacattgtaggcaggatttctacatcatagacaaggtcagcaattatactgttcaacactaagtatcagtcttttaaaaatttatttatttatttgagacagggtcttgctctgttgcccaagctggctggaatgcagtggtgcaatcatagctcactgctgcctcgaattcctgggctcaagcaaggctcctgcctcagctttccaagtagctaggactacaggcatgcaccccaccatgcagggctaatttttaaattttttgtagaccagagtcttgctatgttgcccaggacggtcttgagacctcaaggaatcctcctgcctttggcctcccaatatacagggattacagatgtgaaccaccacacccagcctaaatttaattttttaaagacgatttttttttaagagaagttttatgttcacagcaaaattgagaggaaggtacaaagatttcccatatatcccctgcccctacacaggcatcgcctctcccattatcaacatcccccaccagcaacatactttgttatgctctatcatatgcagaacttacaatgatccagtgaagtaggtggtattaacaaaatgtttttgagagaaggttcaattaggttcaatgagcttatacacagtgaaactagcagcagaactcaggtcttctgccatattgggacatgagagagattttcagaagaggaattgacatcttgggcaccctgtagccaagatatatcagctactttaggaagagacaagctggagggataggacaggaaaagttgggttttaattgccagggaaattggtttagattgccttgaaagtatagcaggattttactgtaattattggtcttaaaattcagccattaaaatctcctaacaggagataggagcctggctttgtctctgaatgtgccaggagagaactgtctccattatgcctctcattggcacacagaggctgggaaactttcacacactgtctcgttttgtgagcatttgcagttgtaacggaagacagctctattttatatcttgctttgttttcaagccattgcatgaaagccaggcctcttggctcttaaaaattaacccccccaaacctattttagtttatagcagtgatacaggttaatgaaaagaatatttaaaacaattcagagagtagtataaaaatgaaaataaaaatccatttttttctatcttctcacacagacatggattcttgcatattcacatatacatacatccaatcatatatataatgtacacttgaattcctggaatccatctatacatgctattatataatgtgatgttttatttaacattgtcatagataactttctatattagtacctaaagatgtaccttattttctctaacgattgttttaaattccactgtccaaattcctctattgatagggggtaaatatctttgagcatatatttttatatattgtatatgcagtatacctgtgggaaaaattcctagaagtggaattactaagagaaagaacatatgcagttcacattatgatagatcctgcattgttgctaagaaccttgcactaaattaagtttctaacagtatatgagactacctgttttcccacattcttgtcaaagctgagtattgacaaacttcttaatctttggtagactcatacatgagaaatgatgataatggtttacttgaaactggcattaaaggttgatatttctgtgaattatttttgttttcagaaattaatttgaatagcttttcattaggtaggcaatacatattcaaggcaaaacaatttggaaaatccagaaaacacaaagaaaaaataaaaataactgataaacttgtttttcatgaataaccattgttaacatttaggatatacctttttgtctaatgcatgaagtgtgaatgagaaaattttattacagcagtggggaaagcattggagttggagccagtggttgttctagattcaagtttttaacattgctgactagctttgtgaccttgggcaagtcatttaaatcctctgagcctcagtttcctcctttgtaaaacagataatgccttttaatatgatttggctttgtgtcctcactcaaatctcatctcgaattgtaatccccatttgtcggaggaggggcctggtgggagatgattgaatcatgggggcagctttctcccttgctgttctcatgatagtgagtgagaactgatggttttaaaatgtggacttcctttctcactttctctttctcctgccaccatgtaagacgtgtcttgcttcccctttgccttctgccatgattgtaagtttcccgaggcctcctagtcatgcttcctgttaagcctgtagaactgtgagtcagttaaacttcttttcttcataaattacccaggctcaggtagttccttatagcgatgtgaaactagattaatacaccttccttcctttgttttcttttcttttttctgaagcaggttcttaccctgtcacccaggctggagtgcagtgacatgatcaaagccccctgcaaccttcacctcctggggtcaagcagtcttcccacctcagcctccaagtagctgggattacaagactgcgacaccatgcccagctaatttttaaattttagagatgaggttctactatgttgcccaggttggtctcaacctcctgggctcaaatgagcctcctgccttggcctcccaaagtgctgggattacagacattattgttcaggcacagtgagccaccatgcccagccaataatgcctttcttatcagattgttaggaagaacaaatggaataaggaatagaaaactgctcactgtattccttgccctatagtggataacttgataagtgttggctgtgctgaagttcaagtgaagtaaggcagtgttgagaatatttttcttatcctgaggtttcttcaaggtggagaattttctctcttcagtttacaaggcactgagccttgtctttgttatatccattttgggattgttcataagttttttctctttctttattttgtttttatttttttgagacagggtctcactctgtcacccaggcaggagtgcaaatagcacgatctcaactcactgcagcctctacttcccaagctcaagcgatcctcctgccttaccctccctcatagctgggactgcaggtgcacgccactgtgcctagctaagttttttttgtttgttttgttttgttttttttttaagatggagtcttgccctgttgcccaggctggagtgcagtggtgtgatctccgctcactgcaacctccacctcccgggttcaagcaattctctgcctcagcctcctgagtagctgggattataggcacccaccaccatggttggctaatttttgtatttttagtagagacggggtttcaccatcttggccaggcatgtctcaaactcctgaggtcaagcaatgctcccacctcagcctcctaaagtgctgggattacaggcgtgagccactgcacccagcctctttttcttgttttcccagtgtttgtttaaaagctagttcatgtaaggcagtggttgtcaatgaagggctatttcatgccctcctcctgggacatttggtaatgtctggagacatttttagttgacacaatagtggggggaactgttactggtctctagtgtgtagaggccagggtgttgccaaacatgctacagtgtacaaaacagctcctcacaacaaagaactttcctgcccaaaatgtcaatagtgccgaggtagggaaaccctgatatagggaatatattgaatgtgaattgaagttaatgaacctggtgaagtatgcatctatggactcatcaagctaatggtacttagtggtcggccctataaattgaactataccctacaggaatttctaccaggctgcaggaggttctttgcttttcaggaagatggcgtggaaagcatctaagttataaaagggctgtttggctagggctatcacctggaggcagccgaggtcctagaagtttgggtctcagttttcatggaatacaaggtagacttcctttgttccttcaagcatctattcattcagcaaacactgttaagtgaccagaaggccaagtactgtgctgtgtcagataaaaaaggaaaagaaacaaaagctaagatatttcctcttaaaggagcttagaagacagtatattattgtggttaagaactcagatgtggatctctgctgcgtgggctcaaagcctggctttgccacttctagtttatgtgatttagcctcttgctttaggatggagttgagaatatctaggtcatatgattgtgtgatgattaaaatgttgatgaacacagtgtttaggagagtgtctagctcaatgaaatttgcattcttgtttttgttatttgtactgtactactcctactgctaaggaatcttggagccttatggattttctagtttagtagtttcaagtttgattagtactggattccttttctcaatatagccttagccagactctgagtatataaaatacagatatgcatagcttaatatagccatacgttctgagaaacgcatctttgggcaattttgttgtgcaaacatcatagagtgtgcttacacaaacctgcatggtatagcctgctatgcacttaggctgtaggctatagcctattgctcccaggctacaagcctgtatagcatgttactgtactgaatactgtaggcaattataacacaatggtaagtatatatcaaaacatatctaaatatagaaaaggtaatgcactgcactaagatgttatgatggctgcaacatcactaggtgataggagtttttcagctgttattatcctatgggatgactgtcatatattcaatgtcattcacctaaacatcattatgtgcacatgactgtatatgagaacagcagctcttgttaaagtaagggtgggagtctggacactgctttctgggaccactcccctctctccccacaacagtgttgtctgggagagaacctgggactgtgtagaaccctgtttgccacccagcaatctcatccagtccactcactttgagtgaggaaactgaggcctagagagaggaagtgatttaaaaggaggctaaagcaagacaggagtagctctaatgtacatgtgccaaacacagacagggtgctctatgagggagttcagagaaggtagagatgggccccttcttggttaggttgaggtcttgaaggatgggtaggatttgaacattccagataaagttggaaagagtattttcacaggaagaaatagaatgataaagggatggaggaaaaagcattgtagtctttacccgtttcttagtcagtctatttaaaacatattacttaaaaaccaaaggaaggtagttgtcataaagtcacagagtaattcctggggcccaggggcagtggagccagcccatatgcacctggtaccccagaagtgagcacctcctggaagccccctctccagtgccccatagttcttgtttcccttcctgtgcatttgctctgcccttcactctctctgaagaccagctttattgtcttctctgtgtacatggcttcctcagaggtcctgaatttctatgccactgcttaaagcaaccagttctcaacgatcatctgtctctgaatcccaaattctaaattccaggaggaaagaatccaattacacatataggtattatttgtgtgcgtctcatccaaaattttagacagactagggcatgtgaggaacctgtcttatgttgagatggatggcaaagccctactcaaagatgaaaaaggaggaaaactggccctcaagttgctcttttaccagcagtagaaagaagggtctatataactataacaaagtatgagatagacagtacaggtaaaaagtaagagggttgatgaaggcttcttgaatggggacattagtgctggctttgcagtgtaggcaagatttcttggtggagagggagatgggggaggacattccaaactagaagcttggaagaactttgcatgtttgagtaacagtgagcagttgagtacctgcatatgccagtacttcattcattcgtttagacaggaaatatttactgaggacctagtaaggaggaggatataattatggataaagaaacaaacttaaaatagttacacggcttccccaaggtcatagagaatatgaatatgaaccatatctatcatgtttcaaactcttgttttctccatttatactttttctacttgattctacaaggtcaaaagtgacttagagcaaggttggtggctcatgctttttttctgttttaaatagagaacttttgaaattgtgcattgtccttacatcctaaagtgagaataggccataatttccataactataaaatgatttatgtgtgggtgtatgtttgttttaggggaattgtttggtcaggtgatttctaccatccattctaactcaacatttcatgtctgggtaatattggcaaccagtttgatttaatttattacataattatttataatagaaaaacacttgaaactgcctaaaatgtcccaaaatagaggattggtttagaaaattatgatatgcccatatagtattaccaaatagaatattaagatatgcctatgtagtattaccaaatagaaaactaagatatgcctatatagtattaccaactcaaaaaagttgcttttttttaatggtagagatggtgtctcaccatgttgcccagtctggttgtgaactcctgggcacaagcaattctcccacctcagcctctcaaagtgttgggattagaggcgtgagccaccatgcccagctcaataaatttttaatatgatgggaagatattcaaaatataaaattagtagtataaacaagaaacagtctttatacattgaattaaactacataaacacatacacacatatatttgtatttacataggaaaattattgtaaagatgtgtattagtctaaaaatgaaggaactatcaaaatattacaaaacaatatttgggtagtagatatcagtaattaacaaattttaaatgtgttttgctaaaatctcaatgatgaatttatatttcataactacagttttatgtaactatgttctttatctgcatctacttttgtaactgaaatttttattgaaataattatagattcacatgcagttgtgagaaacagtacagagagatagctgtaaactttgcccatttctcccagtggtatattttgcaaaactctagtgtaatatcacagccaggatgttgacattgattcgttccacctcagattcccctagtttcttgtactcatttgcatgtgtactcatgtgtgtatgttaagttccacactattttctcaactatgtgggttcctgaatcacagtcaaggtaccaaacagttccaacaccataaggaacccccatgttgccatccacacctgccactattcttttaaaaaagtacttgaccccaatgggtcgggcatttattttattttgcttttgcatctgaggccataatggtggaaccttagagttgggaaggacttagcagtcttcttggttcctcaatatagaagttttagaggaggagtgggaggcattttataattctccaccctcctccaaacacatcatcagcttgagctgtcttcccaacctttgccccgtaacacctttgccttggtaatgcaggtctcaagttagatatcatgtccactggaaactcttgtctgaccttctaagtctgggtcaggtgcttctttgtgccctgattatgttctgtattttcctctttgtggcacttttctcattttataattgctcatagataataaataaatagtgaatgggtagatggaggtctggatgagagtcctttcccagtgtctgatgatcctgcaatggccgcttctccttcctttcccaccttgtgagtggcttttgatcctgcctgcacttcggccacagcacttatgtggcaagcccttgtttatgttgattgtgcccaattccagccttctacctgctgatggttccaccaggatgactaacttcatcttctgagcttgtcacatttttcttttccttcatttataaagtcagtaagatgattactttaagtagctatgagcctatattgtgctatgtgcttgatatatattataatagcttcagctctgttcaaaagaggaaatggctacagctgacccagagagcatctggggataaaatggggatagtaaaacataacttgaagtatattttattaaaatatgtataggaatatttttaatattttattcaatataataaatataaatattgtatttatacagtattcccactcatgatcctgaacaacttattattcctgaataagttgttcaggatcgtgtagccagattagtggcagaaatagattcaaatccaaaactgtctgttacaaagttcaccttttttgctctgtctgcaagaaggaactgcatctctagggatctgttttaatttcctgattcttccaagacttagaacatcctctagggacctgtatccaagtctagttcttgactgaaccctctagttaggtagctctggactttggaaggcagccattctattgctggacaagaaacattgctgggatgtttattgatgttcagtggaaatctgcccttcactctctcagttctgtatctaggtggcttgtagttctttcccttggtgcaacatacattcttttgaatttataggtccctcatgctgtacctaaaagggatttttctgggtttacctctttattttacagatgaagaaacttgagtccaaagagagaagccctgtttaacttactgcccttgagttacttgaaacctaatcttgcctttctggcttacctttctctttctagctctttcagtctttcctcatgagatgggttttctttactttttattaccctagtcattctccttatggacactctccagctggcctgtgtgcctcctatttttgaagctgacctcaatattccaaattcgggttgattgcatggagttcaacagaggatgtttaattctgcaaacaatgatgagatgccactatgtaccaggaacatgttgcaatcctctaccatattctgcctttctttttctttgtgcacattgtctacaatatttatgaggctagaggtttggttgcatatgtcacaaaggccatcataacagtggcttaagcagatgaaagtctatttcttttttttttgttttgttttgttttttgagacggagtctttctctgttgcccaggctggagtacagtggcccaatttcggctcaccgcaagctccgcctcctgggttcaagccattctcctgcctcagcctcccaagtagctgggactacaggcgccgccaccatgcccagctaattttgtgtatttttagtagagatagggtttcaccgtgttagccaggatggtctcaatctcctgacctcgtgatccgccagtctcggcctcccaaagtgttgggattacaggcgtgtgccaccgcgcccagccttgaaggcttatttcttgctcatataaaagtcggatctggaatggatgttgtataaagtagctagggtgccaagctgcttctatcatgctgcttttttaatctttagggtattactctcttcttcgtcatctaagatggccaactaaacattagttttccagccaatgtgaaggcgagggaagggcttactttttctctctgagaaacagcgtgtaagttgcagtcttaattccactctcatcccattggccagaacttaatcacatggtcgtacctggctgaaggaaagcctgggaaatgtagtcttttattctggtagtccatgcgacgagctaaaaatattcctaagaagaacaaggaggggagaatggattttggttggcaaatagcagtctctaccatacccctccttcttcagctccagggaaacaagtcctggttggttctttgtagccattggcttcccaggtttatgaagttccatttctaggaaaagtggcaaagcaggatctcccagaaattctcaggattctgtgaaagactgaaaatcagaatctttggtgtggaggtcacaatgataaaaatacctgccatttatttggggcttactatttgtttgctaggcatatgttaacatgcattctcttatttaattttcagatgaatcctagggggcaggtatgataactaattctaaatttacaaaccaagttttccaaagaggtgaaacaacttcccaaggttgtacagcgattacagggtgaagctgccacctgtttatcttagtgcactggagcctgaggtcattgcccactcagtttgatgccagacagaccagagttgctcattaacacttcataaagccctctcatgttcctcataataaccagacatttctaattataacttgagcagcaaatgttgtttaagataggttatgagccccaagttgaagggatggcttttataccatgtttgctgagtatgagctcaggtcagacaaaatattgggtgaccaaattggcaaagaccattgtccctgtattccattttgctgtcagcagtgctcttggtttattttcttttccatgaggaaactgaggcacagagctatcacaggacttattccatgtggtaatgttgggatttgctccacattgttatgataccaagctggaaatcttcattctcctgctgccacatgttccttactctgggggggcctggacttctatttcctcatgtcctggagtctctcagcatgtcctgggacctgggacctggttccaggcctgagtttgccagctttgctgtgtctggttagagatcacaggcttttctggactcttttttgcttatagctttgctttttaaattttttttctcctataaatatggcagatggattacgaatacaaatgttaacgtggggcactcaatgaagaaaggatgtctctatggttaactctcttttccagctccaaatcaggatatgtagactacaggaaggggcaatggaaaccttgatatttaagaataacaaacgtttggtgaattgggtggtggggcacctttctggaggatgaaaaggaatcaattatgcaaagagccaggtagaggtttcttagcaggatgatagcaaaagcaaatgccttaagtgcagaaatgaaaaagaggcaagaaataaactaatatcatgtttgagtcttacatattttggaatttatttattacggaaggagagacagaagctcattatcagcaatgactcccctcccctgaatcaacggcaatttttggacaggcctcaataatgctaggagtaagtgctgtcacgcttgtcaaatatactttgcttaggtatgtttggaaaaatgatcagtgtccttggtgaagtgttattctcttttgcttcattaaactcaccttaggaagtggttaaattgacagtgttttttttgttttgttttgtttccagaattctcttgacatctcccagaggctttgaacataagataccagtgctgtttttgatattagcagtggtttataaaaatatttaagtgactctttcctcttaacgtacattcaaatacttagagggttagaaattagaagattatatcagaatttcaaacctgggatttatagaaaattggagggtgctcaaagatgttctgttggcagaggagttgagttgctctgagaacaatggtggattcttttatttacagtggttacagactcacagatgtgcttccactggccacaatccatccatcactagcagatttgtacattgttccagtttgggcatttgggttctcaatctaatgttaattcacctgctcatattaagaattttaacataccaagaaatgtttttttaaaagcaaacaaaaacaacactatcccccaaattaatagtgggaattgaatagtacattttggccttattactcatctgggctcagcagagatctttggatatgcttccaataacaataaaaataacagcttggtgaaataaatggactcgtaggtggagaaccgaagtactgagaggagttttatcttctgattgcattgctctttggcattgaccatggataaaaaccatcactgctttatttttagtttataaagtacttctatggataacattttacttcagctttacaactgccttgtaaactgggtataattgtcttcatttcacagctgaggagactgaggcttaaaggggttaagtgagttgcccaaggtcacagcatagcaagcaggtgacagcatcgggattccaacccgtatgttattatataaattgtcttaaatcctgaaaacatgatagctttaaaaccttaaaaagcatcagtgccatctttagaacaatgacttaggatttttttttcctccatggatattgctttaaatgtttgaggaaataactgcaaattttgtttcatcctaaccctaataatgctctctacaatgtccctcagctcagaattccttgtgactatttgaagcttcagtctttaatattgccttgtgtttgattatatcatgtcaaaggcagagcctggaaaatcattattaaggatttgtaggttgtttgcatgaccttttaaagtaaaaaggatagatatgaatagaaataaataaaattattttgcaaagtaaccataaggcttcagccatgtctgtatctaatttattcactataaaaagttctactgaagatacattttgacttagatcacataattgagaaaaagatggcaaatttatcgttaggttaatgtaactatcccttctttggagaggatgataacaaaactgtcaaaagaaaaagatgcccagatgagattatacttgcaaaattttgtaggcagatacacaaactgcaagtataacatgtaaccatgtttgacaggagaagtaggagaacatgggttacaaaatccttaagcttgacagcctctggcaaggtggtgaataatgtgaggtcttttaaaatggctttcttgagataaagcacagaatgtaatgcatgcaactttcagaattgttgctggagacagcaaaaatactcttgagacagtgcaggctactgaggaaaatacatgcggtgatccagaagaaagtgagagcacgggctgttgggagaactgcaaagagtttccctgggactggggcaaagatgggtgaaggaggaatgcaggaggtgagaatgggaaggaaagcagttcccaggttattcaaggctttgtaaaccatgtaaccctgtgcctctaaaaatttctatgaacgggagtgataagataaaatttgtattttaacaacatgcctcatccctctggagaggattggaggggtccaaagctgttaggaggctagagatggaaatggcctgaactgagtaagatactaagtaaggagtagtgggtgtgtagaaaggtgggttggatttgggttttgcctataggaacagtgggaggaaacaaggtgactctcagatttctttgtatctacccattcttactccataacctcccatgctgtaaaatgatggtggtggtaacaatgactataaaatttgaaggcctgttatattataggtgtgaaacttctcatcacctacaagataaaattcaagtcttaaaggggcatgcaagcattccataatgtgcttgttgcctatcctaccaccctttggtaaacaccctgtgcagtattgctgaccaatttatagttcagaatctaaggtcagaattaacaatatgtattgagccagatactctggtacaaataacagtgatcaaatcaactatgtctgtctttttttttttttttctttaaacagagtctcactctgtcgccaggctggagtgcagtggcacgatcttggctcactgcaacctccacctcgcgggttcaagatattctcctgcctcagccttccgagtagctgggactacaggcgcacaccacccacgcccagctaatttttttttttttgtatttttagtaagacggggtttcaccacgttagccatgatggtcttgatctcctgactttgtgatccgcctgccttgacctcccaaagtgctgcgattacaggcatgagccaccaggcccagcctatgtctgtccttttatggagcttcttttgtagtagatagagacagaaaaaataaaaaccctcaagataaaaagagccgtgaagaaaaaagagtagactaaggagagttcatatagggtgatcaggaaagcatctctgaaaaagaaacatttaaggagaaacctataggaagtgaggagggaagccgcgtggctcactgggggaatagtggaattgtaagtgcaaaggccctgagggaagtacatgttgaatagacgagtagtgtggctgcagcaaagacgcagggagaaaggtaggagataaggcaagaggggtacagaggcctgttcctatagagccttgtaggccattgcgcgagctttgatttttattctaagtgagatgggaaatgattggaaaattttcagcagaagagtaacatttgccttatttcttaaaagaacacctttgtttctctttatgaaccacaccttagggaggcaagggtggaggcagagacagcagtgaagaagatattgcaataattcagatgagaagtgattggcttagaccaggttggtggcactataggcagtgagaaaaggttgattatacctctttgtatgtggtaatataaaaatattatatacatttgtattagtctgttctcatgctactaataaagacatatccaaggctgggtaatttattaaaggaaagaggtttaattgactcacagttcagcatggctagggaggctgcaggaaacttacaatcatggcagaaggggaagcaaacatatccttcttcatgcagcagcagcaaggagaagtgccaagcaaaaggaggaaaagtcccctatgaaactattatatcttgtgagaactcaccactatcacgagaacaggagcatgggggtaactgcccccatgattcagttacctcccactgggtccctcccacaacacatggggattatcggaaccacagttcaagatgagatttgggtggggacacagccaaaccatgtcaacattgtacatgatatatgtagtacctaaatatatatagttttctaaattcaaatatacaaaaaagtaaaaaggggaaacacaggtagaaaccagaaacccatgtccccattactcagcttcgacaattatccactaatgagcaatttcattttttctaaagctgttcttgcccctctggattattgtgaagtagatcccagccataatgtcattaaatatttgaatatgcctctaacatgtaagggcctagctgggcatgatagcatgaacttgtagtcctagttacaggggagactgaggcttggagtgagaacctgctcaatcagtcaatcagtcaataaagggctccttttaaaaaacactgtcacaacattctcatctcatccagaatcttaatagtccttactatcctcaaatatccagcctgttcagattttcctgattcttttaagtgggaatcttatttttgcctttttatagtttgtttgaaccaggatccaaataatgtttatgcattgaagttgcttggttttaaagtttcttctctatgtctcttttgttcctgtgtaatttttgttgttgttgttgttgttgggaaaaaaaaccaggccatttgtactgtagattttccccaagtctagattttgctgactgcatccctgtggtgtcacttaacctgttcctttgtcctctgtgttcccggtagattaaaggcttgatcagacttacattcagattagctttttgcaagactatctcgtaggtcgtgttttgtatttccatcggggatatacaatgtgtggttgtttctgttttttgtcatcactgtctagtgccattgttttattaggggctgcaaatgtaattcttactttttttttttgtttgctggactatttctatgaggaaaaactcttcctcatcagatatttggttatcctggagtaaagttcatatagcaaacaaaggaaaaaggcttgattcttaccctttatttaccagttttcaaaaataaaaagtaggtcccctatccttctctgagggtgacttatgaagcttctctctttctctttttctcttcattttattattatgaactcatatttttaaacacacattcatgtttcagtccactgcagttattacagttggccctctggggattccacatctgtggattcaaccaaccctgaatcaaaaatatttggaaaaacaccaagacaacaacaacaaaaaagtacagaataaaacaatgatttgtctagcatttacattgcaatgtaataggtattatacataatctagagatgatttaaagtatatgggaggatgtgtgtaggttatatgcaaatactacacgattttatataaggacttgagcatccttggattttggtatccttgaagggccctggatccaatctctcgagtatatagagggacatcagtattcttactaatgactaaatggaccatctttggtcatgggagcctctgaagctagctcctgaatgcttctaacacactcaagtagtctttgatgctttccttgctttctggtatcaccagatgttccaggctcatcttgtatgttttctgccccaatcttagaatcagccactttttcaaagggctctagttccttttagagggaaatggtgcataaagacctctggtgtgaggggtgctcactgctcctgagctggtttttgtgtctaggccttctcagtggacagagctaggagcaaattttttaaaaggtaaaatacattatggattcacaattatatttctttctcccatgccaaaattctggttctcagttgcaccagtgtaattacttatttgctttgtgccacaatacacagccacagaatcacaataccaacactatcaccaaaacaggttaaggtagttttgttttttgtttttcttttggtggtggtgggggtactggttgtatatattttgctttaagacagttactttgtatcttaaagttacttgaggtagtttctctctgtgtggttatatcatcaatttcatactaagctgggttggtttggctcattttgctatcacttttgaggggttgctttaaaatttatgtttgtaattatatagaatatttacatagtttcaaattcaaatctttaaagcaggttgtattcaaagaaacagcttctgtccctgccccctctaccctgttccctccctcacaggtaactctctttcaagttttgggtttatcttttcactttgtaaatatgtgtgtgtatctatccactctctcttggataagtgggagctctatacatatcttaaatttcggataaaatttggaggtagtacagacactattttctgaaagattggatgtgaggtatgagaatagagttgaagctaatgcccaggtatgacatgattgactgatagaattgaaccacctggccccgagtgcccttctttccatgtggcctggttagcctcattcatctttgcaaactccagctttctttgctctcaggtgctctcctctgtgctccattgatgccctctgcgtcacattatccttcccatatggtcttatatactgttttcatttgtgtttggctgtcagtagactgtgagcagcttgatgtcagacattatgctttcttattctgttttcccaccacctatcacagaacctttcacacagtagaagctcaatagatacctgagtaaataaataggccaggtgtaatgttgggttcttaagaaaaaaaaaatgaggtggatgttgttgtcctatttcacagatgaaggaacaggcactgaaaggtttaagctgcttatctaaagaaacagctaataaattgctggagtacgaacccgaatcttgtctgatgccaaggccacacagctccaactctgtgttctcattcagcagtggcatgtgagactgtccacaattagcctattaattgtgtgacctctgcaagaaagtgagcctctatgtctatttctacatctacgaatgcaagatagtaatggcgtgtacattatagggctgtaaagcatttagaataatgcctcatacatagtagggactcaaatcttagctgattttaggtacaattgttatttttagtagcggaatattagaatactactactaccactacatacaaagccctgtgcttggcactgtgtatggagtcttctttgactcaccccatcttgccttctaggagtttgcaggcaatgtgcatatgcttaaagatttcaagaagggcaactggggagtggtcagtcaacaggcagtcacttgagattagtgccaaatgcagggaaagaggaaagaaggcacttgcaggtggccaacttgttagataatagtccctcacccctgggcttctggggcaaaaataaaaaacagaagccatggtggagatttgaatgtttctgttccaccaatgtcaccattagtggcagccaaatacttcgactccttgtccagtttggtgatactcctaacagtccttgccttgtagcattaataagttgcacaaatcacaatttaatactcacattatatagactctatgagtcatggggtcacccagagttcatgggaccttggagagcagcaaattccacctccacattttatagaaagagactttgtccagagaaggaaagccatatgtttaagggcacactggtatttggaacttgaactctgttggttaaccttatgggtcagatcatgcagattcccaaatgcctggacccttgcctgggagggagtggactctcaatatgcaagagtgctgagagacgagggatgatggctccactgttgtgctggccacattgtatttggtgagtccaggctcctgctcttatcagaacagcaatggtagctgctggaggaagagctggcctccctcaggatgtagccatttctgctgcctgattcatattgggcaaggtcttctttgggcccttccatagctatagccatctatgtgctattggcgattgcactgagacctctactctgtcaaaaagaggtaaggaagaatgtgatagtgaaagggcatgagatttagagccacacagatctggtttgtgttctgaccccagtgtttcttagaggtgtgacttttatccagtcatttaacttcactggaaacctcaatttcctcctcaataaaatgggcatgataatatccaccacagcaggttgttgtaatgattaagtgtgataatctatatgaagcatttggcagaaaaaaagtgtccaaagaatggtagcttctctgcctctctccccgactctgcctgaccttcatttagggctgtctgtcctctgtcacacagtgtggcatagggctgtggctgtgttattacactttctatttatcagaagctactgaggggtgttgaaagatgtagactttaggctccactctcagagattctgatttgaaagaaatctgaaaatttgcattttttaaaacaggcaccccaggctattctgatgcgtagcctggtacctaggctgacatttaaccttgggaacctcttgcaccactgtttgccagaccccttagcttgggcgggttatgcaacctctctgagcctcatttctgcacctactaactgggactgatagcctgtttagcaaggtccttttcagggtgaaatgaaacagtgtgtgtgaagcatcttgcatgaacctagcacacagcgggagcctggtgaagatgtgaagaccgataccagacaccaaagggctgcattgccttcttccaatctataagctagccgtggccctagttccttctttggaaaccaaacccttgcaatgtatctgtccacctattcttaccattctgtggattttgcagaggacacattgttcatgatggaaagccacctgcttgcctgtcacctgcattttttggagaccctttttatggttattagtgcctgtctttgaaatttcagcacctgtgagctctgattgtgttacctgggatctaaaaaggcagcagaggagaacagatgctgctaatgacttatcagctcttttgtccatagtcttctcaaagaaaaaaggctgtgaccctgggtttgtcagcactgatatgctttcacaccacaaagggacttgacaatgggcaggtttccaagtctgtagagtggttctttgggggaagatggaaagcatatttacagtttggttcttcgggctcatgctctttctccaccttctgtgctctgctgccactacccctggaatgctggtgcatgtggcttttgaacatgagagtcaaagacagcagctattgaccctaaaggctgtgtgtgcctgtggggtgggtgggactgggcagcaagaagaggctgaattaggaaagagcatcttgagccactgtcatcatccctttgtgggaccaagtccgtatgagggaccgcgatcatagctggattgtagttttccactcctgcctgttcaagccttagaaactagttttcattaatttcattgctatgcaatgaatgcatagcagttttccactcctgggtatctgttcttgcaaatatccttagattaatgcagagcagacatcaggccaaggtctgccttttttgttctccagcagtgcttttgggtttgactgtttccttttatgttttaagcttttaacaaatataataggaggcagcaaaatgttgtcagtggaacacaggctttggagtgagacagacctagggaagagcctggctgtatgacctaaatttttgtgttgggtcctgctgtgggctgaatatttgtgtcccctcctttcccagattcgtatgctgaaacctaatccttaatgtggtaatatttggaggtagggcctttgggaggtgattaggttgtgatggcagagccatcgtgaacgagattagtgcctttataaaagagggccccagagaacttgcttgtctctttcaccatgggaggatacagggagaagatggccttctacgaataaagaagtgggccctcactaggtaccaaatctgcaggcaccttgatcttggactttctcgtctccagaactgtgaggaatacatttctgttcttaataagccactcaatttatagtaccttgttacagcagcccaaatggtctaagacaagttctcactttgctcctctgtaaaaaggggataatcaaacttacctggcaacataattgtgaagattaagtaagataatggacataaagcttgtagtctagttcccagggatcaaagggtgcttaataagtgatggctattgctgttatcatcttgctgcacttcaatgcaattgaaattggtttaaaagtgaatagaaacggttggtttcttgatggattcaattcagttcaattaagtgtccttttttagatggcttaccctggtaagtgtcatgctgaatacttgatacagatagaaattaagcactctcttctcgctaagctcttcttgtgcattctcaattttgcgttgcagctttcaacaaaagcatcccctcacccttcccagtgattctaaatttctttatctactcatttgaaggttagtttgactttcaagccttttgagatctgagcatcattcacctttgcggtctcacctctcacccctctctaatataccacccagttctgtgaggaaacaccataatatcttggctctagtatgtaccattgccactgcctgatacacattcctctccatttcagagtcttcctccttcctcctgtgtagtggagacgcaatactcatctgtcagtgttggatgaggatttatgcatataatttttttgtccgaagagcagatggaaccacacagaccagactgcaggaaagagaagagataaacagtagactaccttacctgtggtttcactttccaaggtttcagttatctgctgccaactgcagtctgaaagtgttatgaaaattccagaaataatccattacgttttaaattgtgtgccattctgagtagtgtgatgaaatcttgcaccgtcttgcttggtcctgcctgggatatgcatcatccctttgtccagtgttatgttactgcatattagtcacttagtagttgtgtaagtgatgagattgactatcttggttattgcagtgcttgtgttcaagtgacccttattttacttcataatggccccaaatcacaagagtagtgatgccagcaacttggatatgccagagaaaagctgcagggtgctccctttaagtgaaaaggcaaaagttcctgacttaataaaaaaaaaggaaaaaaaaatattccgaggttgtatagatctatggtaagagtgaatcttttatctgtgaaattgtgaagaaggaaaaagggaattcacgctagttgtgccattacatctcagacggcaaatgttatggccacagtgtgtaagtgctgtattaagatggaaaaggcttcagtttgtgagtggaagacatgaacagaaacgtgttccaattgatggcagttgggtttggtattatctgtggtttcagacatcgactgcaggtcttggactgtatcctctatggaaaagaggggactactgtactagcacctgcattggccagatgctaagtagaaacagaagctgccttgaacttagggaggccctgggtgtacagtgatttttctatgccatttgtggtgccatttctgcagcccaccagggtgcagcctgcagaaggaaagtcacacagctctttcctccctccaggggtccttacaataatgaatgatggcaaagagtcaaagataggatgatgataatgcctactttttattgagcacttcttgtagatacatgcacatgtgtgtatttcattcttaacaagtattattgcaaaactgaggttcagagaggttgcatcacacccttgagcatgaagaagacagggagggtggctgtaataatagggacagtcctccaaagcatgacatccgactcttttgatggttgggcagctagtgtgccagggaaataattatctgtctccttagcaacccccaatatttggcttagttgtcattgatgcatttcagttatcttcatgtcgttaaagaaataggtctcaggaaatttaatccagctagcagtgctatgcctagaattcaattaactccatgatttgcaattaatgagccctcatgccaagattgaggtcatagcattaatcttacttttattttaggatttccactgtcatgatttacagcgaaatccagccaatcttgtcaggattattggagcataattaagccagaaaggcaggcagaacagctagttaacatgggatccagggagggaccacatacctttgcttggtaagcctacctcaagcaggatggggctacatatgaggatttccatctaaggactgtttcccagatgcctgatctgtatacatttcaaatccccatccaatctccaaagaaaatatttccgagtcccagttggtgagcccttgtgagttatgttgttgttaattcaatgctaccacatccacctccacctcaagttgccatttactaagttgtaaatgtaacagacagtgagtgggcttttacagatgatggatttaatatctgtgatgattctatgaggaaggtatcataggccttctctctgtataaggttatacagcaagtaagtggcctttccactgaactgatggaaggttgtggcagttcctagctgcagaccatttttgtgcttctctccctttcgtgtgtgtgtgtgtgtgtgtgtgtgtgtgtgtgtgtgtattttgcccattaggatctcctccactttcccatatagaaataagaaggtaggcatgcataggcaaatattgtttatgattgccttctaggtgacaaatactcatccatcattatctcatttaatcatcgtatacatgggaggaggatattatctacctccattttacagttgagaaaactgaggcttagagagatttactagtttgcctgctgttacacagatagcaaggaaggagagtcagtgttgtgaatccaggtatgcttgtttgcaaatcctaggttcttttaatcacaacacgctagtactaaataaatgctttttctcttttcctggttctccaggagtggttattattgagtcgagaatttttgggaaaagtaacacgtggagagtcaatttttgagtggaaggagtctgaagagagggtaggaaccaacctcctactacccaccaggtaagggtgtacttttggcctttgggatttagcccatgtcttctgtatgtagagtgcagatccaggttggctaccatgtctggccaaccaagcacagaagccaacccctcccattgactttacttttgctcagtgtttggtttttccacaagggagggtagtggccagatgtttatgagaaggtctccataagccaagtccacaccagaagctgaccccacagctagcggtagctttctttgccctagagaccagtgaaacagaggagtagcaggttctctttgtacttaggtagcagattttcctccaaatgcttgctgtgggttttttgggttttctcctaggattcaccttcagactgtatctgcctccctgtgtagttagcatttagaagtgtcctcactgggtttgcttagcctcattgaacatttttatgcctggcatggcttactagagactacctattggaagtgcctactaatacaattttctgataatttagatgctgaaggacttccttgaaattttcttcggctggcttgggatggaatacttgcttttgaaatatgccctaaagagtgtgctatccctggggaaatccacttgtctcaggcaatattaatctgctctgcgaacagcttgttggaaatttgctgataatccattttttttttgtcattccatatctcagtgtgagagagtaagagaatttggtaaaagttcttactttttagcttgaccttctgaggtctgaggagcactcaccttcccagtctcatcttccatccctctctaacacaccctcaagttccctgaggaaacaacattatatcctggttccagtatgtattatagttggtgccttaggaaaattactttctttttcagagacccctgccccacccttcctcatctgcttaggggagactgtaatactcatctttcagtgctgggtaagcctagcatgttccctagtatgcttataatcagagctcagttatgatcctttcacttttatgtctgtccttgacatgatgttctcttaacctttgcttgctctccaacattattttgtactaaataatggactaaaatgcccttcagcccatttccatccaaactgcaattcaggcatcacctctgccataagccatcctctttccaacaaccttcaacaccacccccgctccaccacccctgcctgccacacacacacagacatacacaggctggaaataagctcctcagaatgcttatctactttatatgcaactttataatacttcttggtgtgtctaaacagtagaaaatcaactaataattataatgcagcactgtgagagatatgagagaaaaaatactaatgactcagaagactacatttcattgctaagtggaaatatggcaggtccaaatctatacacagtatcatctttatttctatgtatgtggacacacaacacaaaatgtgtatatgtacgtatacacaaaaacagaactaagaatgtaaggatatatagtctccaaaatgttaacagtggtacccttgtttattttcttctctatcttaatttcatcttctttggtttcagtagacctcaggggtagagaagtgagttaatcatactgctttgcagtctttatacggcacaaggccccgtctggttttattgtagattttcttttttttttttacttcatcagcctcaattccatcctcctcacccagccatttggtttctttctgatgctctttatgtatgtccttaagtgtgcccaaattttccacattctttatgtcttctatattatagatatatatgatattattgtgtaatgcaacgtattttaatgtataaaatataacaaaatataggtaatgtttatatttatatctgaatgaaaccttttttcataaattagaaactggaattcatgtctctgctttttacctcttttccccgttgtctcccctcccctcaacactgcaatcacacacacatgcatgtgcacacacacacacgtgcacacatacacacacacacaaaaatgaagattttcttgaccagtcgtacttccagttccaaaatctcaggattccttgttgcatatattggttgactccctcccttgagctctctgatatatggttttgtaagaagtttttaacatgatttttctcaagtaattgagctcctagtttttagcatagtacagcagagtttgaacagagaatgaccaatggcaatgcagacagccttattggactaaggatggcattttctggtgattcgtatgtttggcttatcttccccagtctaggctctattcaagcatatggcaaaagggacacaccatttgcagttagagcaatatttgtttccttgccctgccagctactagcaagctaagtgacttgagccttaatttcatcattatgccttaaagcacttcaatgaatcttaattgacacccagaaatacgcattttttaaccttttgaaatttgtcgataattattttatgccccagcatatgtaaacacttgataagagggtatattcttcagttgttggttgcagtattctataaatgtcaattagggcaatgtagtattgttgttcaaatgttttcttcccataccaatgttttgtctacttgttcttaaaaagtctgcatttgtgattgtgggtttgtccctttatgtctacttttctgttcatttttgcttcatatacttagaagctgtgcatacatttagaatgatatggaataattgaccctttattattatgaaacattattccttaactctgtaatattgtcttgaaattaatttgtatcatgttaatataggcctacctgctttcttttgcttactgtatgattaatattttctcatcctttgctattaacctatctgtaactttgtaattaaagtacatctcttgtagacagcatataatttgtgttttttttatgcagtctgataatctctgtcttttagtgatagtatctggcctatttagatttattataattattaatataattgggattaagtctactctcgttatttgtttctaactattgcttctgtttttagtttctctattcttttcagctttgttaggattaagcatatattttaatatgaaattttaattcttctggctttttggctatatatatgtggtacgtatatttgtgtgtgtgcatgtgtgtatatatataaatatatataaatatatatgtaaatatataaatatatatgtaaatatatataagtatatgtgaatacatataaatatatgtaaatgcatatataaaaatatatatgtaaatacatatataaaaatatatatgtaaatatatatataaataaatatgtaaatatatatatataaatatatatgtaaatatatatatttggtatgtggtttctccagagattgcaatatttattcttcacttatcactgtatacataaaataaaataagagaatgttatagcagtaaaatttcacttaccttccacccatcttttgtgctattttgtcatatatttttcatctgtgtaataacaccacaatacaatgttgttatttttgcttgcaacagtgatctttcagatgcattaagagaagaaaaccataatcttttatattcacccagacatttaccatttctggtacacttcatcctttcctacagatctgagttttcatctggtaacattgcccttaaggctgaagaactccttttagcatttcttataatgcaggtcaattagcaacacattttcttgtgtttttaatataaaattttgttttgaaaggattttttgctgtctataaagttcttggttgatcatttttttctatcagcactctaaaaaaattcatttcattattttttgacctccattgtttctgatgaatgttagccattattgacatttttgttccgctatatgtaatgtatctttttctctatcagctactaagattttctttttctttttctcattggcagtcttattctgatgtgtctaaggtgattctttgtatatttatcctgttttgggtttgctgagttacttggatctgcagcaatagtttttaaccagggacaatgttggttctctaggaaacgtttggcaatgtttggaggtatttttggttgtctttgcttagagttcagataggagaggatattacttgaaattagttaatagaggctagggatgctgccaaaagttctacaatgtccacgacaggcccccacaacaaagaattatccaatttacaattcaatagtgctaagtgccgaggttgagacatttgcattttgagttgaatttttttccaccaaatattggaaataaaatagtttttctgctccattttcttcctgcgtcccttcttagactctgcttacatgatggtaaactgcttgcatgatgttgtctcacaggtcactgagactctgtttttaatttctgtcgacctgccttcaagttcataacattttcttttgcagtttcgaatctcctgttaagatcatttagcaaaattttcatttcagatattatactttttaattctgctattttcttcttctttttaaaaatattctttgctggtagctcattagactacctctttgtttaagcctttgaacatattaataagcttaaagttcttgtctactaattctaatatctgaagcatttcaggttctatttctatttactgctcttttattgttcaatttttactgctcctttatatctgtagttttattgtatgataaacattgtgatgatactttgttggaagtctggattaccattttctttgaaaacatgttaaattttattctggaagacagttaaattaccgacatatccttctggtcattaggcttgattttattctttgttaaaatgggtctattgtggttttcaacttagtcctaggaatgcagcctttattccaaggtgtagtccttattcctagtgtgatgtggcctttctgatacagaaacactgaatatccagctaaatgcctgagatgctcagcaagagctttccattttggctatgctagagctccaacatatgccagcatttataacctctggtatatagtgctggtttagttctcaaccctgcatcaggcagtctctgctgggccttgtgaagtcttactctctatatttacagcccagacctcagctaaggactcagggtgaatttccatgcagtcttttccctcctatccctccagcacccctaatccctatgtccacactgtgcctctccctattttcttttatattgtcccacatattcctgcttcttagtagtttttgtattttgatccctgccttcacagctcaggggaccactattctacttgggctctagatcattttatggtaataggaaagtgcttccaggcaaaagctggagcaattgtgaggctcatcttgtgtggtttctttctttcaaagatctcagtccttcttagactgttgtttaatgcctaaaaaacagatgttttatataacttatctagtttatcacaggagctcaagtccaataccattatcatggttggaagtggaaatcaggaatatgcattttaagtaaagaccccagataattctgaaactgatggttgtgggttcatattttagaactgctgatgtaaattatttaaagtagatataaagtattcaaagtagccccagctttctgaggaattgtcagaggatctctactctccaggaggtctaggtattttatattttgcaaaggataaaggacttttatctgaaatgtttcttggtgtgagatccctttgagtgtggtgtatgtgtatgcgtatatttgctacagtgctgagttgtactctgtgttttcaccatcttgtgtatagacaatgcacaatagaataccacaccatagcagaatcattgatcaaatatactgcaagaatgaatcatccatacatgtgtgtgtacacacacagttatatatattttttttttcttaagatggagtttcgctcttgttgcccaggctggagtgcagtggcgcgatctcggctcaatgcaacctctgccttcaggttcaagcaattctcctgcttcagcctcccaagtagctgggattacaggcgtccaccaccatgcccggctaattttttgtgtttttagtagagacggggtttcaccatgttggccaggctggtcttgaactcctgacttcaggtgatccacccgcctcagcttcccaaagtgctaggattacaggtgtgggccactgcacccggccttataaacattttcaatatgtagttttatatgtaaatttcatgtgtcaataaagctatttttttcaaaaagttaagtcatggcaatgatttggggaagtcattttattttcctggtgcatccatttgaggcatagggatacattgctaatattctattgagtattaaagtgttatgagtctgggttctttcctctcattgtccaaggggggcttccagctctctgactgttatgttcctgactgtgcctgatgaaatgaaaaaaacatgggtcttgtcttcacaccgacatttggatatatcctaactaagtaatctggtgaatgaactgacctctgactctcttttgatttaggctagaagtccaatgcactatccattgtgccacagagcctgcctgcttgcacgaattgacctctttgagacacagttcccttatctgaaaaataagagcaaaaatatatttcagttttaatgtgtgggatactgtatattcctagcatggtgcctaacatatagtaaggccactttggtatatgtgtagcacatgtgtgtgttgtatgtagcacatagcatatatacccttaccttgatcttgtaaacgacaaacaatattcatccacaaccactgctacttttctggagaacagtaatttgatctttctctcagaagttggcttgcaatggcagctccagaatttctgccttggagctaagagaagacaatcttggtagaaggggaggagcttgagaaaacgcttcttagagctgcatatgcataacaagcacactggttttctaaaattctacctgtatatggggggttgtttgggaagactgatagagttctctcagttgccctttggtgcctatattgtctcccctgtctctcttaaatggaactgaaatgtcgaacagaaaatttttgccttatttttttctctttgcagttttctttaagtagaccatcagtcctctgctatctctattctctatcatagacaaggtcagataacagcaaggacattttctctgttccagggtggtaattaagagggaaatgtcatagtccattttatgcaatttaagccctgatcttttgattagagaagggaggaaaaaaacaattgatggcccctcactttctggagttgaggttccatgtggtgcccagaaccctttctgtttcttcaggtttctattgaggattctgatctcattgaatagatttgattattattatttcataatgcagagcctttttatttggtccacatgttgaagagtaaagattccttatttagaccccttttccctggcacatcataagtacttactttgtctgttgaatcaaattaagcaatatccatgtaaagttttatatgagagtttattgagtagaatttggattggcacctgtagcctgatttctttgatccttgaaggaacaaaatatgttacatccatttgactggaattcccctagcaccaacagcctggttgtgaacactgtgccctatctttattatacgcagagttcattttggtttcaatgtagtcattactttgtatttctcattttttccactcttatcaatcttttttcatgttgtcgatccttttgggaaagaggagctagtattggtttcttaattagttcttctatctctttgaagataaacatttcccatcaaatattagccttctttacaataaagcgcatgttgtatttcaagaaatctccatcttttaggcaggctttctcagtgggtgcagtgttgcaatcagaaattctgaaaagcttgaggagacagtgaaacagtgaaagcatctagtcatatttgctacctacagttaagcaaagaccagatcactgccaaagttgatctgtttggtcttccttgccatctctgccatcttctctttgattattgcattccatagcagctcagtttcacatacttttattgagtgcttactgtgtgccatatattgcacttaggggactgtgaagaggcatgaaacatgcttcttgctgttgaagactcaatagcaagtaattgagttgaggggaggtagactcattcacaagtaattataatgcaagctgactgctctgagtcctaggatggaggaacagaatgaggtgggagaatggaggcatgagagacaaaaagtacctcttgaaagaggcaggatggggaagtgaataagagcagaggctttgggtccagccaaacctagcttcatttcattctgttgtgactgttactaaacttcaccaaaacctcagtttcctcagtgggactcccacctgccactgtgcttagtgcaagcatcccatttagttgtttatggaaactgcttagctgagtgtctagcctagagtacatgtttagtagatggcctttgtatgaggatgatgatagtgttaaagaattttaaaagtggaggggacttaggaaatcacttaattcattctcctatgtttatattcttggagactctgagtttgtgattctcccatagcttgggaaatagctgagccatcatagtctagtattcttcccattaacaacctgaaaagtgagtgtggacgtactcatgtgtgcacgtacagatttcatggtgtctgtaagtgatgacaaaagctttaataactggcacactagcataatatagaaatcaatatatatcaatgtaaaatataacccccttttattctgtaaataaatacacacaagcacatgtatattatcactgtttatagcacaaattatcactctaatttccaattttttaattgatttttggacattctgaagagtattcttgttactagctaaatgatctccatttccgggccatggtttgacatagggaatgccagccaaaccttccagcaacttccccattaaattgattattctggttgggcgtagtggctgacacatgtaatcccagcactttgggaggtcaaggcaggcagatcacttgagctcaggagtttgagaacatggcgaaaccccgttgctgcagaaaatacaaaaattagccaggcatgggtgcaaccctgtagtcccagctactcaggaggtggagttgggaggatcgcttgagcctgggaggcggaggttgcagtgagccaagattgggccactgcactgcacagcctgggcaagagagccacaccctgtctcaaaaaaaaaaaaaaaaaaaaaagaaaaagattatcctaagggccctggcactttattgcagtacaaagagagttgggtgtgctattgccttgtaagagctgtgatggtcttggatgcctatgcttcctatgtggcctgaaacgagaaagcctgactcattggcattacctgctctgtggcctctgcctgccagtgcttagctcccctggagccttccatggatgctacacatgcccctgcttctgctctcttggtctgttgagcagctgtgtccagggccacagctgtagcttataccacgtgccacctagtacataagtattgtaatatatcaaaaaccagtactactgaatctgagtgaacctgaatattagtcctgcaaatagctcacaataagtcctcctaccaggcaccaggtcacgtcaagatgagaagcagaaacttcagagtgataaagaggttcacttctgttaaacatttgttcttctgaactatcaaaagtgaagagtttccatgggccatagcttggatacaccaataggagattcttaccctagggaggcttgctagacacatctccagtctggctttgttaaccctgaaatggaacagcatggctttttttttttttttttttttttctggccaaggctgcgtgagtttgctagaggcagcatttttttgtggctttatcttctatgtgccattctattaatatttctattctacagataaggaaatcaagacttctctagactatatatccagctaatagcagaggtaggatccagatcagttctggctgaactgaagctgacataaagcctgtattttaatacaggttgccttctgtaatgcctaacctcttgtttggcataggggttattgatttgttattttgctaaatgttatctttttttctctgaaattttaatttctagttggattcccagccatttgtgggaggcattccttggaatcatgtactatgagtgctgaatttctaagaattaaaataaaaattctgacaggcatggtggctcataactgtaattccagcactttgggaggctaaggccggccaatcacctgaggttaggagttcgagaccagcctgggaaacatggtgaaaccctgtctctacaaaaaattaactgggtgtggtggtgcatgcctgtaatcccagctactcgggaggctgaggtgggagactcacttgagcccaggaggtggaggttgcagtgagccgagactgcaccactgcactgcagcctagataacagaatgatactctgtctcaaaaataaataaataaataaataaaataaaataaaataaaataaatttaaaaaaataaaaatttctggtcattttagaagatctcattacataaaaatcacaatgtcatgcgtgttattatttgatcctgttgatgacatgaggcatgtagaaaagtttttgttcttaattagttccagtttatagggtggggagttggtggggggaaggaggcctagaggagtaaaatgacatactcaaggtcacacagcttttaagcagaaaaaccaagtttcaagtctgagacctctcttctcaaagtctgttacatttcctcaaagcttccctggagtgagatgaatggggaatgagacgtaagcagcctttggagccaaagcagtggctttttccatggtatatctacttgttatgcccatacgatccatttctctaactgctgggagccaagatctgaaaaatctgttacaaagaaggatgatgaagccctttgtgataatgacacgagttccttccttgccctttgccaagcactgtgaaggaatggcttttccctagagtggggcatctctacagagtcactttagtttcagggatttctatcccacagttgtcaattttatagaagccaggacaagacatttttaacattgtgactcttaaccactgagaaaaatgcccactggtgaatgggaacatgaatatgacatgattctaatgccaagttcactttatcagtcgtctctccaaaaggctgatcctgaacactatgggatactaactcactttactagacctggatgatgaaaacattctggaaagaggaaaagtgatgttctgtggaagtgtttttgtggagtcccagaggatccactgaagaaggctgatgtcccaagaactgcagttggtgccaagtgttggttgaattcttgagagcaagaactgcagttggtgccaagttgctgcccatctcctccctgtccccagcatattagatcatcttgagtattgatgctggagctgagacagttaccactgtgatgaagctgggtctgaagtcttagaataagtcaaatgtagaaggatgttccttcctggcaagcccctagcctgcttggagtgaggggggcacacaggctcttggagggctgttggcagcatttgcctgcctctcccaggccagctgagaaacttgtgtggctgtgaactgtgatgaatcacgcaagaggaaggaggtctctacagctgttgaggaaggacatatcaaacttgaatagcatagcacttggctctttattttatgtaacatatttttaattgtaaaactaatgaatgtggccgggcacggtggctcatgcctgtaatcccagcacattgggaggccgaggctggcggatcactttaggtcaggacttcaagaccagcctcaccaacatggcgaaaccccatctctactaaaaatacaaaaattagctgggcatggtggcgggcacctgtaatcccagcttatcgggaggccgacgcaggtgaatcacttgaacctgggaggcagaggttgcagtgagctgagatcgcaccactatactctggcctgggcgatagagcgagactcagtctcaaaaaaaaaaaaaaaaaaaaaacaaaacctaatgaatgtaacttgcagaaaatttagaaaatataatcataaaaacaaacaaaaatcactcatcattttcccagatataattaaatataattactataactgttttgaaaatgtagtggataaaagcctggactctagaatagcctgcatgggtacaaatcctggcttactaactgtaggacctggggtgaatcactgatatgtctttgcttcagtttccttgtgtataagatgaagatagcaatggtattgccttcatagggtatttgtgaagattaaatgtgttactacatataaagaatttagatcagtggcctagtatgtggtaggcattcagtaggtttcagttgttattattttatgtttattatatcctctgaattgtttctctaaactgagatagttttcttttacaaaagtaagattacacagtggattatgtgttgtagcctgcttattttacatttagcctttgccatgcccttctgtacttttctgcaaaatgattttagtagctaaccatatggcgttattagagatatttaacaattcccttactattgaaaaaaatacatcatttatagcctcttgccatggtaaacactatcttgatgaacgtctctttttggtaagtttttgcataccatccttcttttgatgacagtattttatgggggagcatttcttcttagaggaccagatggaattatccacagcccagggtgccataggcatgtactgaataagcatatgaggggatgatcactatgcattatggacactccttctcctttgataccacttctcacagtgttttgtccacggctaagaaatcaataaaatgtttatgaaaagcagccacacttttttatattttcagttacattaaggcagttaagactagccctagcatttgtgtttatcttctttatataatttctaaatgactattgaatcatctcaaatctcttttggaatgaagctcgatacaaataaatgatcaaacagccaactagcaatctagtgggagacagaaattctctcccaggaaacacaaattttatgtcactcttgacagcaaggactggtcaggttcctacaacttggaaggaataggatactgcgtctagtttcccaaacattaggaatcccaaggaaaacttatttcttacacccttaaagtgactcagaggtaaaagtgcaattctctgatgtttgtccttggtgggcttagattttcacaccacagacatcattgaaacaagaatctacttggagccttagaggcagtcctggacctttctctttggatggcactcacatgctctgtcaactctgatgtcctcaccttcactctcttacaccctcaaatccctgaggacccttagtaagcagagtgttctttccactgggtgccattttagccaaagtatttagaaaggtgttggaggtagcaagctctgcattcctaagaacacaagtggtgttaaccatctgatgcaagggttggaaaactttttctgtaaagggccagagagtaaatgctttagactttgtgggccgtaagatctgtggcactactattttaactctgcattgtagcatgaaagcaaccataggcaagatgtaaacacataagggtactttacttctggacattgaaatttgaccctcataccagtttcatgttatgaaatatcattcttctttctacttttttcaatcatttaaaaatgtaaaagccattgttatttcacagactgtacaaaaacaggccgtggactggatctggcccatgggatccagtttgttaccccttgatctaccgtggtcattgtttgtcttctgcatttctttctcattgcaccattttcttctttgttgtgccatattttgaaacctctctgccctttctcttaactagctgaggctaaaatatttgcagaatctgcacttttggcacttatgtggctcatcagggaaagccagaatatctacctaaaagaaccagtagagcaacatcaaataatgcccctcttcttttttgtgtggccttgccagttcaacgtataatttgaatatatgaaggttacagatggactctggcaagttgttctgatttctgcagcattccaaagctctaatgagcagagcatgcagcctgagggatggtgagagtctgatttttagataatcaaggatatttatatcttttaataggctggtgccttgtagttctattccagcataaaactgagagttgaagagacatctaatcaatttgatgtcctctctttaacagttatatatcaaaggggtgttcaggctgaacacatgaaaatgttacagggatggaaatgggagaattataaacattttatgctgctctatcctcactatatttaaaacaaaaacatgatacagatttttacatggtggggtgtgtttacagggaaataatgtgctctatttcatatgaaacaggacacaagagagcattctcagatttgtaacactagccgtagtctgtggaggtgcccattagacctgttcctggccttttattcagggctgtgaagcagtaggggcgacagaggctcggctgcctgcgtaatgagattgacttggtttgcctggcatgcagtgatttatgagggtgcttattgtagggatatctgccgctgagagcagccagatgaaaggtgtgtgggtgagaggtggaggagagcagggaataggagagaggcagttgtgtataggcaggtaaggctcatcttgattatagttgttggaatcctgagctgagtgaagatgtagaatagtgtgaaatggtagattagcaaggctttggaattgcacagatatgggtttgaattgctgacccttccactcgttaactggactctttggtgagttactttccttctttgagcttccattgcttcatctgtaaactggggataataaccacttccactctcccgctatatgaaactgtactatcataaaggtctgagcacagttcctgttgcattggagagctcagttagtggtagagatgattaatgtttgtccatatgtccattcattgtttgtttaccagtattcaatgtgctttgcaatttctaacagagcctcattttctaatagatgtctaatggtgacttagacatctgttaggtatcaatagctcttaagatcaggatggaagaacatgacagtcaacatgtatttatagatatatgtatgaacatctaagtggcatgtaggagtgtactggtacctgaaatatgattgaaagaacagccacctggccagtaagcacagtaaaagatacttcacctcactagtaatcagggaaattaccaaaataggaccaaagtgagatacttatttatacttgacaaagtggtaaaaatgtaaaagtctgacaatactaagtgttaaggagaatatagagtgaaggaacacatatgtactagttgtaggaatttaaactgctgtgactgctttggagaatggtttgtcaatatctagatatatgaagtgtacataccttatttactggcaaattctgcttgtaggtataatctagagagagtcttatgtatgttatcaaagtcatgtgttcctcactgtgttgcttattataacaaatagcctacgtgtccatcagtggggtaattgatacacacattaattgagctaaagctgcatttggtaccagcataggtgaattttaaacaaaagtaagtgaaaaaaataaagttgcaaaattatgcaaatagaaaaccatttatgtacagcttgaaatcttggaaaataatattaatacattttttgtggatacaaacatatggaatacaagtttgaagaaattaattggaatgacaaatataaaattcaggctgatattaggagaagaaagtgggatgtgattggaagggttgcctgggttcactagcttgtatgcccttagacaagtttcttaacgtctgtgcctcagttttctgatctataacataggaataataatattatctatttcattgggatgctatgaggattaaatgactgaatatagataaaatgcttagaaaaatacctaccagatagtaagtgttatatataagttagcaattatagtgcctattacgtgaatatttttattattctttattttgaaaatcttatatattgcaagttttgaaaaagaatagatgccattcttgtcttttgtcatcatatagttggaaagtgaacaaagattaaaaataccatcaatacaggaatttcaggatgtggcataatagagtttagctacgttctcttgacccctagatttattaggtaccatgccaacagctttatatgcatttatttaatctttccctatggagtaggcacaatttttatccctattttacagatgggaagaaagagatttagaaagactgacttccagggtcacacagctaggggtagcaaagctgggcaggaacccaggtgagaatgactcacgctcttgactgctaggccttaaagccctacctggccactgttcacattaaccacctcctctacacagattcctgcttccttcctgtatcagcctgcataggttaggttgtgctttggttatgaacattcccaaaagatcagcggcttctattaacaaacaggtgtttcttactgtattagtctgttttcacgctgctttaaagaactacctgagactcagcaatttataaagaaaagaagtttaattgattcacagttccacatggctgtagaggcctcaggaaacttacaaccatgacagagggtgaaggggaagcaagtcacatcttacatgatggcaggacagagaaagagagcaaggacggaagtgccacattttaaaaccttcagatctctcactgtcatgagaacagcatggggaaaatccacctccatgatccaatcacttcccaccaggttcctcccctgacccgtggagattacaacttgagacgagatttgagtggggacatagaaccaaaccatattacttactcatgccaaatattcatcaaaggtcacctgggtcatcaaaggtcatatgccacatagctcctttctctgggacccagaagtcatggacagagcagccacagtctccaaccttgctgattgctatggcaaagggagagagaaatacagacagagagagagagagacagagaaagagagaaagagagagagaaaaactatggagaatatcacattgacagttaaatgtaccctggaagtgatgcacaacatacactgtgatacacagcacttcccctcacacacataggctggagcagtggttttcaaccaggggtgattttgcctccactaggggatatttgccaatctctggagacattttttattgtcacaactcagaggtggagtgggggttggggcaggtgctactggcatctagtgaatagaggccaggaatgctactcaacaccttgcagtgcacagggacaaccccctcaaaacacgcacaataaagaagtatttagcctaaaatgtcaatagtgctgagattgagaagccctggactggagctaagcacaaggggccaaaaagcgcaattttaagaagctataaagggaagagaacctgaaatatttgacagatagcactaatagctgccatgcatcctaaggcctaaaagctgtactaaagccccttcagaaggtgtttttcatgatagaagtgaaccagtgctttaagggatagccatggaatggggcttctagtatagtcagcttcatcagagggccgaggagtgccctggactcactgaagttgactactgctcttcctcagcagtctctctggagcagcactgtccaaatgtagtacaataaaggccacatacgtagcttaaaaattttcagtatccacaccaaacaggtaaaaaggagcaggtgaaattgattttacagctataatttctttaattcaatatatttaaattattatttcaacatgtaatcagtataaaaatattgagatactttacattcttttttttttgcaccaagcctttggaatgtgttgtgtgttttatatttactgcacatttcagttgagactagccatatttcaggcgctcaattgttacacatggctagtagcggcaatactggaggtttctgttcctgggactcagtgagggactgacctgggtctcccctgaggaccagtagcaatgctataactcagagtctataagttctgagagtgggacacaatttccaggaatatctgtcccagactcttaaagacagtctgtgtatgttttaagaatgaagagggattggttttccgtggattctctgccatcaccatttttgtttgtttgtttttttttttttttggcaggtgcctcatctccagacatggagcccagctatgggggaggtctctttgacatggtaaaaggaggtgcagggaggctctttagtaacctaaaggacaacttgaaagacaccctcaaagacacatcttctagagtgatacaatctgtgaccaggtacgcacattcttcccagttaatttagtggatccccatgctctcaaaggatctggttacctgctgactgcttgtctggctcaaagagtgtcaattttgggatataattttatgggatctgatgaactgagaaatgtcattgaagacataaagttaagtcctttagaagctataagcacgggctgggaggactcagttcattgccacattagagtataatggttgccctccctgtctttagaatcaaacatcttgggttctaatgcaatatctgcccttgttaactaagagccctcaggcaagttaattaacctctcagagctttttttttataccctgacaggatttgtgtctttgggttgtttagggattaaatgagattaaaatatacatgcaatctgaataagcattacctacggattgtaatcaaatcagaactttgtttttgtttcctactagccctttaacatttattcagtgagagaagtttcctactcttccactgtatgaaaattcttataagcaggtcataggagttattttttattgtttagtattagaaaattctagggtcactttgagttacaatatgcagttcttaatcagaaattcaaacgtcaagtacattatattaatcaaaattttaatctttgttcaaagataaaactattcttacctctgattctcaaccagggcctggtaggcagaaaaatggtgtcatttattttttctcaaccacttcttcccctaccccttagccacttacaattatggaagatatttccaggtaggcaaagaagctagaacaattggtgttgataaataagcagagttttctattctgagattgattcagatcatgaagtggcatctacaagggcattagaatgcaccagttggagtggcatatttatacccctgaggtcacgggctttcttttctcagtgatccttccttgttggagagaagggctggaggggagtcgaaacatgccccctggacagcggtgtcccagttcatatgcgcaagtgattgagagagagaaatcttggcatatttggatcattttaatgagtgcccatttttgtcttgcttttagctacacaaagggagatttagacttcacttatgttacctccagaattattggtaagtttctcatgtttattaacagtcctttggctcagtttcccgttgctgcccatcgttatagcagacgtaaacatttaacctgttttctttctgtgtgatctctctcctagtgatgtcctttcctctggacaatgttgacataggattcaggaatcaggttgatgacattcgaagctttttggattccagacatcttgaccactacacagtatacaatctgtcacctaagtcttatcgaactgccaagtttcacagccgggtaaggatttttagccctgagatcatactgttgaagacgtgatggtgcttttcctcctcagagatacccttaaagcacgtgcccttaggcatctgaagctgaaaaactatacactctggacacttctgttcacaaaatatttattaggctgctatgagatatcctaaagattttccttgggtgaggatacttacaggaaagtgtatctgtcaatgaaataccatcgaagttggggtctcaagtctgttggtgcctggttgttccatggcacagtgttcatgaggcttaagttggagattgaactgctgctagggcagttggctgccttcatgctgttacactaattatgccgttgacccttctttattgctacttggtatcaagataaggcagtgtggatagaccggtactgacaagtattaatgggaacgtgtttccattaatatattttaagaagttttttgaactagagagagaaatattcctagtttcaccttggcttaggtttgaatctgatatcgagcctgatatttctggccactgaattctgacttactcactaaaaaaaggcatttttttcccctctcaagaacatctctaaatatttttgacttagccttcagatatgattggttctgcaacttcatttgggtctattaataaatagaatggactttctatgcatggatcctttaaaagtgaaacttgatgtcaaatgtgtaaaatgatagctggttgacaatgctgtgtatctaggatcttagctttgatgctggaacacacttcgttccaaattccagttaccattgataatctctgggcctcagtttccagatctgtaacacacacaagaaaattggtgtacatgctttatatggctccttcctgccctaatattcaataagctatgggagagttttaaggacctctttttcagcgtattctgagaacagtctcaaattttggtgtgcatcagaatcacttggagggcttgttaaacacagacttctgattcagaaggacaagggaggcataagaatctgcatttctaacagcttcctgggggctgctcctgatgttgctgcggggaccactctttgataaagcactgataacgccattctgaagtggtttgatctaaattgccattctataatgaagattttaaatgcatctctttaaaatcttctgtaataaaataaccttccaactcttattccatctattagctaattcagaacaagtgaattaacatcaaacaaaaatgtggatagatattttgttcttaatgtaaggcaaatcttttgaattatttttcttgactggaggctaagtcagtgccattattttcataatttaaggactgtggaacatcctacacaatatttcatagaaattttatttgaccttgaaagatctgtgataatctggagcattttccctctgaaagtaaataaagatatgatatcattatagaagcatttatacatataaagatgtctctttgtataatgtttataaaaggcaatctctataaagatgtttttaatgaaaggcatctatcagtgtaactaaagattttgtgactggacttaagggtttaccaaaggaatcagagattacatattaaacacctaccctgggctgctcttacttgccctagaagaggagggagcatttttttttttttttttttggatacctagaacaacagttcctgacatagataatcaatgtttttaaaaagcatgaatgtgctgcacccattaactcgtcatttagcattaggtatatctcctaatgctatccctccccaaaaataaaaaataaaaataaaaaagcatgaatgtggaaagaattgttaaacactatagatataaaataaatatttggtttttgttctcaagacacctaagcctagttggcgagagaacccaggacgttctaaagataagtacaaataatatttataatacctgccaagggagattagtaaagggagacaccagtgacagctggaccttagagcaggagaaaggcttatataggtcagaggagtggagtcatttcttgcctatacaaatcataaaatatcttgtgaggctcttgatgatctagcctctatctgctcctctaacttcatcttttaccattcttcattgcccaaaaatcatatgctccaatagggataggcatgtgctcatgtgcacacagacacacacaatcttcttgcatgagctactccttctcccttaaaagctacccatgtcacacacccttcgtctccttccttccttccttcttcccttctctttcctttctccttccgttttccttcccttctccttcccttctccttccttccttccttctttcctcttcttcctcctcttcttcttcttcttcttctcctccttctccttcttctccttctcctcctcctcattcttcttctcccttcctccttccttcctctctcccttcctcccttcctcctcctcttcctcctccttcttcttcctcttcttcttcttcttcttccccctcccctcccctcccttctcttccctcccctccccttcccttcccttcccttccaaaagagcctcactcagttgcccaggctggagtacagtggcatgatcttggctcactgcaaccttcgcctcctgggttctgattcttgtacctcagtcacccaagtagctgggattacagatgtgtgccactatgcccagctaatttttgtatatttagtagagacgattttgccatcttggccaggctggtcttgaactcctggccttaagtgatccacctgcctcagcctcccaaagtgctgggattataggtgtgagccaccacccccagcccatcttcttctttatttgcctaattttgctaaggagaagatttccacatgccacgaggcttttccaattctctctcctaaaacacaggattgcactacatctttagctcttccagatagtcctagaatttggcagaatgcaagtggatcctctgacctgtctcctttacccttagttgcatcttagggaggcagtcccaaagccgtagtatttccatcttacctttgtttttgatttgcctacatctcttttcaaactcctagacctttctttccccagcactaacactgtgaatggatttgcatctcattgttgcatgacttagaaaagttttctttgtttttacctttcagttcatgaggactagaaccatttcttactccttccggttctgtggagtgctacgtctgaaattaaaccttattttaataaatgttgatggtagagtctaccataaatactaaacatggaactggttttatttgtagattcataagggtgtataaggtcttaggaattttttatttataaactcgtgggagtctggatctgcccacatcatatacctctgtgccttgaaacctgaattcagtcattttacatgatgattatgtgattgtttgtatatgttcaaacctgcatttgaggatgtaggtagtgatgttggcaaagacaggctgtttccaggaagattttactttgctgagggttgtcattctgtatttcgattcacttttatgcttagaagccacattggttgacaggaattgtatgaaatgatcaatactgttttcctgatttttctattatgtatttgcatatgtcacagaatgttaaaataggactttgtttagtctcagtttagcagaggctacaactcaaaacaatgcatagcacatagcccagcattcaaaagcgaagtactggaatacctattcaggactgcaaaggatgtatgaaacctcaggtgtttttatttttttttaatgttttttgactctttatagccaatatccaccttgaggaaataagagtactgatgctgacaatgaagtcctggagaccaacaagatgcatcagttaaaccagatgttcataatgactcctctgtgtatgtagatctattgctaggcttcagagagcttaaccatctgtttctgctcctttaaaaaaattattgtggtaaaatatacataacataaacttattgtaaccatttgtagcataaaatttcagtggcattaattatattcccaatgttgcataaccaacaccgctatctatacttaaacctttctcatcatccccaacataaacactgttcccatccactccatgcatatgtgtgtgtatgcgtgtatacactggtttggtttctgcatagaaggtttatagctgtgccccagaatatcaggaacctttacacatttcttggcattactgttggcaataaatggaaagctggatgaatgtacactaagtctaacctgattccagagttcttaagttctgattaatgctattctagggccactttgtctctccttcttccactgtttacccaggaaggacagtatggtgacagagtccttctagcagcaaagaaatctgcagcccagctggttgttttaggctctaccctcttaactatttctaaatgacataatcttctaggatttctttccctttgggaacaatttgatttttggaaaatgtattatcaacttgggtgtcttaaaggactcatgattgaaggtcaatgtttttacccctttttcttcctgagcacaccaaagaggtcgctacagctcccagttgtttctgcattggtgggaggttggtgggagattggctggagtgggagaagtttatagctcatatttcatctctcactctgctaccatgcctcagtgtcaggacaagaaataactggagtgaaaaaaacaatccctggcctgggggccagaggaccagagactcccacattctagttatgaagccttccatgaattgaatgtcttaaccctggtaaaatacagccatcacttgaagctgtaaccactctacaaatgcaaggtggagttattgttatcagtcatcagacaatgtagtataatggagagtgcacaaattttatttttttaaactgagatgaagccatatagtgtatacaaactttagactttaaaaattaccctaggttcacatctcagctgttcttcttcctgggcaagtcacttttacctctccttggactcgtttttctcctgtgtaaaatggatatgccaataagagagtgcctatctcacaagcactcttagaattttttttataggtttgttgtaaggaataaatttgatagcagtctcttgcttagagtcatcatgcagtaagtagtagctatgattaacattggtaataataaaatgctacaataagtgattgactgaattatccccatcctccaaaaatggtgtgtgattcataaaacactagatgtagcaattaagtcatactctctgtagaagcattcattcctatgcttagtgaatggctgcttctgcccatcctgtcttgggcaagggatgatggagagatgaaaattgaatggcatccagctctagcgatgatttggcttctttttcccactgggtggtatcatggcagtgctgtaatctgtatggtgtcctctgatgctaagcaagcccaggagatgttcaaggtgttcaggaaaactggcgacagcattgcgaagtgtcagctactgcatgaagctgtgaaccccagagagctacaaaaatagcttgcagtgattgaattccttttttattttgttggttttgtttatgccttagtgttttccccttttagacagagcacatgcttttaaaaaattctaattgtatgtttacttaatggtgtataattatatatcaagtaaatatataattatggagtactttaaattaatattatttacttgattgagttaatgattctggagctattagcctattgtgctaagaataatttagccaacttttagctgagactcattacagatattgacatttggggtgtgtgtgtgtgtgtgtgtgtgtgtgtgtgtgtgtgtgtgtcatagccagtttttaaaaccttcaaaaatattgctggggaaataaattttctatactttcattctgttacagtctaaaaaaaacccaataaaatgggttcacctgttccctcctcaagatatggtacatgtggacaaatcttattataaaaatagattgccaaatggggttcattcctttattctttcactcattcattcactcagcaaatacctgctgagcacctaccatatgagcaacacatgcacagtggacactggggttacaaaaatgagtaagttatggtctctcttctcatggagcttggtgtctacaaggggagacaggtataagcagtttattcagtacagcttgaccgcaagctagcatttactgtgtttatgttgtgctacttaattctgacaacaatcttgtaatgctcatttatactttacacactagataattgaggcctggagaggttagtaaattgcctaaggttaatcaagtagtaaatggtaaatccagagtgaaaatccagcctgtggatttaaccatgttgttctactgaaaaaagctgtaatagatgaaaataaactggggcatgagtataaagatgactaagcgtttctgtctgtgagtattagagaaacagtcagagccaagagaacacttgaacatttttttcttttttaaaaatttgagttaaaatatgcatatataatgtaccatttttaccattttaagtgtacagtttaattacatttatattattttttcctccttcaaaccctctcccactcctcttcctggcctctggtaactactaatctactctttatcttcatgagatccacatttttagtttctgcatatgagtaaaaaacatgcaatatttatctttctatgcttgggttatttcagttataatggcctccagttccatccatgttgctgcaaatgacaggatttcattcttttttatgtgaataatatttcattgtatatgtataccacattttatttattcattcatccattggtaggcacttaggttgattccatattttggctattgtgaatagtgctgcaataaacatgggagtgcagctttatattcgatatattgatttcctttcttttggatatatacccagtagtggaattgctgggtcatatggaaccttcatactgtcctctatggtgattgtactaatttaccttcccacctacattgtataagagttcccttttctcacattttcaccagcatctggtattacctgcctttttgatacaaactattttaactgaagtgagatgacactatattgtgattttgatttgcatttctctgattagtgatgttggacattttttcatataactgtatgccatttctatgtcttctttggaagatctgttaattctcttcaactcttttgcccagtttttaatttgttttttttttttattgttgagttgtttgagctccttatatattctggttattaatttcttgtcaaatgaatagttcacaagtatttcctgccattcagtgggttgtctcttcacttcgttgattgtttgctttgctttgcagaagctgtttagcttcatatagtcccaattgtgtatttttgctttggttgtgtgtgcttttgaggtcttccacaagaaatttttgtccagatcaatgtcctggaacatttctctaatgttttcttctagtcattttatatttttgggttttggattcaagtttttaatcaattttatttgatttttatatatagttagagatataggtctattttcatttttctgcatatagttacccacttttcccagcaccatctatggaaaagactgtcctctcccactgtaagttcttagaatctttgtcaaagatgaattggtggtaaatgcgtggacttatatctgggttctctattttgttccattagtccatgtgcctgtttttatgccagtaccatgctgttttggttacggtagctttgtaaaaaactttgaagtcagatgatgtgatgcctctaactttgttctttttgctcagggtggctttggctatttggagtcttttgtggttccacatacattttaggggtttttttttatttctgtgaagaatgtcattggcattttgatagagattgcattgaatctgtacattgctttgggtagtattgccattttaacaatattatttcttctaatccatgagcatggaatacctttcctttttttgtgtcctcttctatttctttcatcagagttttacagttcttcttgtgtagatctttcacttctttggttagattgattcccaggtattttatattttttgtagctattggaaatggcattggttccttgatttctttttcagattgttggctgttagtaaatatgaatgctgttgatttatgcatgttggttttgtattctgcaactttactgaattcgtttgtcagttctaacagtttttttggtggagtgtttaggtttttctagccataagatcatgttgagttcgaacaagggtaatttgacttcttcctttccaatttagatgtcctttatttctttttttgcctaattgctctggccaggacttccagtattatgttgaataatagtggcgaaagtgggtatcgttgttgtgttccattctttagaggaaaggccttcaattttcctccattcagtacgatgttagccatggatttgtcatagatggccattattattttgaggtatgttccttctgtatctattttctgaggatttttttttttttgagacggagttttgctgtcacccaggctggagtgcagtgatcttgactcactgcaacctccgcctcctggattcaagcagttctcctgcctcagcctcccaagtagctgggattacaggcacctaccactatgcccggttaatttttgtatttttggtagagacggggtttcaccatgttggccatggctggtctcaaactcatgacctcaagtcatctgcctgtctcagcctcccaaagtgctgggattataggcgtgagctgccgagcctggcctcatgaggatttttatcataaagggatgttgaattttatcacatactttttcagcatctattgaaataatcacgtattttttgttcttgattctattcatgtggtatataacatttattgatttgcatatattgagccatccttgtaccaatgaagtaaaacttttttttttttttttggagacggagtctcgctctgtcacccaggctggagtgcagttgtgcgatctcggctcactgcaagctccgcctcatgggttcacgccattcttctgcgtcagcctcccgagtaactcggactacaggcacctgccaccacgcccggctaatttttttgtatttttagtagagacgggatttcactgtgttagccaggatggtctcgatttcctgacctcgtgatccgcctgcctcagcctcctgaagtgctgggattacaggcgtgagccaccatgcctggccatgaagtgaatctttgttgataatggtgaatgatctatttaatgtgttgttgcatttgttttgcaagtatttggttgaggatttttgtatctgtgttcttcagtgacactggcttgtagttttccttctttgttgtatccttctctagttttagtatcaggtaatgctggctttgtagaatgagttcgaaagtatttcctcttcttccatttttaaaaaatagtttgagtaggattaatattcattcttttttaaatatttggtagaatacagcagtgaatccgtcaggacctgggcctttctttgataggagaatttttatacagcctcaatctcattacttgttactggtttgttgaggttttctatttcttcatggttcaatcttggtaggttgtatgtgtccaggcatttatccatttcttctaagttttctgatttgtttggtatataattgttcatagtagccgtctcttatgagtctttgtatttctgaggtctcagttgttaggtctcctttttcattcctggctttatttatttgggtcttctctctctttttcttagcttacctagaggtttattgattttgtatattgtttcaaaaaaaacaaccttttattttgtcgaaatttttttctttttagtttcaattttcttaatttttgctctggtctttattatttctttccttctagtaattttggctttagtttgttcttgcttttccagttccttgaggtgtattgttaggttgttaatttgaagtctttctactttttcgatataggtgtttattgctataaactttcctcttagtacttcttttgctgtatcccatatgtttttgtatatttccattttaatttgtttcaagaaatttttaaatttccttcctaatttcttcattgactcattggttgtttaatttccatgtgtttatgtattttccaagtttccttttgttatttagttgtaaagttttattccattgtggtcagagaagatgcttggtatgatttctattttatttatttatttattttatttatttatttttttgagacgaagtcttgcactgttgcctgggctagagtgcaatggtgtgatctcagttcactgcaacctccacctcccaggttcaagtgattctcctgcctcagcctcctgagtagctgggattactggtgcctggcaccatgcccagctaattttttgtgtttttagtagagtttcactgtgttggccaggctggtcttgaactcctgacctcgtgatctgcctgcctaggcctcccaaagtgttgggattacaggcgtgagccaccacacctggccaatttctgtgtttttgaatttgtacagactcgttttgtggactatggtctattctagaaaatgttccatgtgctaatgaaaagaatataaattctgcagcagttgggtaaaatattcagtaaatgtcaataaggcctattagatcttgaacctgggttttaaaagatgaattggagtttaccaagagaagaaaatacattgcagacagaaaggagcttgtacaaatgtacattttatgattcctctgacagcaaaatgtatcttcccagttattctgtatttttagtcagtaagtcatttccgttccttgaaaacaaacacgtcaatggggaatatatatgtgggtaaagactagaccagaaacagtcctgaatcatgttgggtaaaaggggcaaggcatcataaagtttaaattgacagaggccaatgctagatcaccctggactgtttgggagctatgccaaacatttcaaatactttgtttaataaaccatacttgtctctcctaaaggtatatgaaagtgggtaacctggaaggtctcctgacatttgccccacagtcatcttgtagaaaaaagttacaaattaacaaaaaagaatgggctttcttggcagccccagacagagaaactcaatgtgtttgcttttagacgtcagctctaccaagagcacagataatttcctagtcgtattttgattatttattatctgattaccagaaaagggctaatcaaacaaattcctcctgcctccctttcccatggtcaaatagaaggaattcgagacatttgggattgcagagcacattctgacatcatctgtatgaagcctcttctttctgcagaattccgtatctcaggaaatagcacttcttgtatccttctatccagccattcaagctggaaacttggagttcaggcttgactctttcctctccctcccctgacacactcttcagtacacccctccacatgcacacactgccaccatgtatcacctgtcttatgtccaggtgtcccaccacctatctcctgagtccctcaagtgtgtttgtaccccactgctactcagctagccttagccactatcatcccttattgacactcctcaccaacctcctgactggtcttcctacctttaggctcttgttatccatttctgttctccatactggagcctgaaagatctttggaaatgtagatctgagagtcattctcctccttaacaagactgtataatctggcccttcagtctacactctcaccatgaaggacttcatttttttcaaacatggccagtcctgactgcagggctttgcactggcagttacccgataaaatgataataattgccaacatttattatcactctgggtgtgtcagatactgagctaagctcttgaagtacatgttcatgtagtatcctgtgagttatgtaagaggtactgttcaccacattttatgaagaaaggcttaaagaggttatgaagtttgtccaactctaagcttctccttgttgtttcttagctagattagtaagtatgtaatcaactggggatcatgccttaacagtattttgaggcaagtgataatgtcagccagtgtgctgttgtaacatgatttatattcagaagatctgggctgcagtgctgacgctgagcagcagtgtgactctggataacctctgagagtcagttttctcatctgcaaaatggggtttatattaatacctgtcttagatgattgttgcatggatcagagccaagcaatattcctataacttagttgatgatccataatgtgtgaaaaaaatatgcatgttaaatgaatgaaaatgccaagggtttcccctgtaagttgtgtcctttgattaaaagagaaaaaaaatagatccatgcacaagcctgcctttggctcactctatagcacttttcatgttatcacgagagctgggataaattagagatggtgcaggacttataaccctataattaaacatttggggggaggtcaaaacattttatgcttaatagaaatgaaattctatgtaacctcacagaatagaaaaaaatccaaggatgtatttgaaatggtctagtttaatttaaaatgtgcttcaaaatgtgttttcatacctttactgaatgagaattctttaatttaaaaaattgctgtgttaaacaccctcttcttcatgcatttggaccctgttcccactattcctatctatattaagagaggatgtggtatcacttccagaagatgttggttggtgtgataacctgcttatgaagaggaagttgctggaggaattaatttccttttgctgtgctcccttaggtctcagaatgcagttggcccattaggcaggctcccagtctgcacaacctttttgctgtgtgtcggaatatgtataactggctactgcagaatcccaaaaatgtctgtgttgtccactgcttggtgagtaaccttttgttgttggtggtgatggtttggtttggtcaaatatggatgagcctgtacacaatggtagacaggtaacatttgagttcaataggatttactgagcccatatttaggaattgggtaatgtgagagttgtaaaaataagaaagggatttattattcttgacttaaagcttgactactagtgggaaaggcagatgtatacacaactcacatagtgtggggactctagaatgtgctaagtattataaaggaggtagaaacaggagtagtgtgtgcacagctaaaaatgccattgacttttgtgtgaataaagttaacattaacatattggcgtatttattttttcttcctgtttgtgtttgaataaaaataaaagaaaaaagatacctatgtccttgtaagaagtcacatagattgactgtattttagagcattcccagtgagactaatggtttttctgaccattgacttcctagagttcctttccctaactcttctcagaactcttgcctgtcctttacaactcaactttcagtaaaatccttctgactcttgagtattttcacaatacagacattcccattatatctaaatgtcttctgtggcttttaatactctgtgtcatagtaagctcttctcctgcatattttcccactagactattataatcttgcaggaaagaaccatgcctttttttaaacttttgtactgcaggcataaaaggcttcaataagtgattgaatacacaaatggaatctgagcattaatgctggaaatttcaaagcttctataaattttaaagcttctataaactttagtgtatatgtttttgctatagtattacttgatgattcccaaccccctgtcctttcttgagagccagttggctaaaacaggaaagaaagttaaagaacattttttctttctttttacttcacatctccaaactcttggcaataaagggataacacttggtgtttgtaagaatttaatgttaaagaccaaaggattttcctttccaaggcacagcagatggtgtaacagaacagattacttttagggactaagcaaccttaaggaccttggtgattttctctttactcaagaatttgctgtaagttcagagagcctacatctgacaacttgatggaggaaagatggctcaatggagaccagaaactcccagttccagtgattcttcataaagaataaaaacccaatgaagaagaaaaaagaagaggcaaacaaaagattatggttctacagggtgctcaataagctcactcaaaaaggacatgcatatgttggaaatgaataccatgtctttgggaaatggaattgaagctgggggagggagtttttttttttttgttttttgttttgttttgttttttttttttttttgggaccgagtcttgctctgttgccaggctggagtgcagtggcacaatctcggctcactgcaacctctgcctcccaggttcgagtgattctcctgcctcagcctcccgagtagctgggactacaggcacgcaccaccacacccagataatttttgtatttttagtagagacgggttttcaccatgttggccaggatggtctcgatctcttgacctcatgatctgcccgccttggcctcccaaagtgctgggattacaggcgtgaccccaccaggcctcttatttttatcttaatatactactggttattatattaaaaataataagcatagtggggcgtggtggctcatgcctataattccagcactttgggagactgaggcaggtggatcacttgaggtcaggagtttgagaccagcctggccaacatggtgaaaccccatctctaccaaaaatgtaaaaagttagccaggtgtggtgctgtgcacctgtaattccagctactggggaggctgaggcaggagaattgcttgaacctgggaggcggaggttgcagtgggctgagatcgtgccagtgcactccagtctgggcaacagagtaggattccctctcaaaaaaaaaaaaaatgataataacaataggctatactagtcttttaataaaaaaccaaagtttttaaaagacctgcatcacaggtaaaaagagaggctacatatccaagagccatggatctgtgaaaagagtgtcaggaaggctaaattctgaaaataaatcagattaagaaaaatatcctttttttaaaactgtgtttggaataagaacaacaacaatttcttgaagcatgtggtataatcttaactcctttattctgttttctttatcagagggaacaaatgtcaaactaggaagaacgtaacaatgatgtttaagacaaagctggtaggtagcaagatagtacgagagcctcacaatcctccaaattaattcactctcaaggcttaaattatgtgacacaataccgaaagcacttggagaagcaattatggatttcatttgtaatatgaagaaacaggaaggagaggtgccaggcaaatgaagagaggagattttttcccaaagtatggaaggaggttgatcctggaaagttgtaggcttgtgaacctggtggtaattcaaggcacaattctgagaaagttttgcacagaagattttaaactcttagcaaaaaaggaatctccattggtttgttatgagcacatatcaaaccaacagaacatttcacatgactaatagactagttgagatagtttattggagtcctgcaagatatttcttagttttttctagtcaagattgagaaatttggctaggttgttatatatttagttgagttgaggctgaatatctgcttccaaaggtaggtgattaatggatcacctttctcctgggagaaggctttatttagttattcattttaatcaacaactttgatgaagatgtggaaattcagcttatcaattttcttagaattataagggtcacatagtgaatttggattttaaaagttcttgtaggttggtcacttaacaaaaattaataatatgaaattaaatacaagataaatgtaaagtcctgaattctggttttaaaaaattaaacatatttgcacattaccttaacatgtcatctggaaaaaatctaggggttttagtggatagagagaataataaaagcttatgttgttacttagcctacatttatactagcttgggctggggttatgttaataaaagcatagtgtccagaataaagaagatgatatttcttctctagtttggtcagaatatatctcatatctttcatttcacatctgggcagcatttaaggttgtcattttaaaacttgaatttgtttagaagaaatgtgctaaatgatgatgtctcttaaaatggaaaatcaagtgaggaagaatagaagggattgagtttgttttaaaagggaaatagaagcattgatagaaagggagggtatttcagatatgtgaaggactgccataggaagaaaggagtaggtttattttttgttctcacaaaaggatgagggtcatttagtggaagctatggaggaatgaaagtcaactcaacatattcagtataaggaagagctctgtaaactggaatgggctacttcaagtatgagtaatctccctgtcacttaaagtgttctagaagaagctaggtcacatctgtcagggatgttactgaattttgtcttaattagcttgagctgctgtaacaaatataccatagaccgggtggcttaaacaacaggaatgtagttctggaggctggaaagtccaagatcaaggtgactgcagttcttttctttctttttttcttttcgaagagttggggtttcaccatgttgcccaggctggtctcgacctcctgagcttaggcaatctgctcgccttggcctctcaaagtgctgggattacagacatgagccactgtgcccaaccaaggtgcctgcacttgtaatgtctggtgagggcctgcttctggggtggcagatggctgtcttcttgtttttcacattggccaagggcagagggagttgacagcaagctcttttgtctgttcttataagggcacaattcccattcatgagatctccactctccctacctcattacctccccaaagctccacctcctaataccatcacattggggttaggatttcagcatatgaattctggggcatacaaacattcagtccacaacagatttatttctacattgaatgaagttgaatctggtgaaggttctttattttatacgaatctaggaacatactttgcatgagatacatatatgccatatcccaacaagcagcatttacctaacctgtgagctcgttacttccagtcctaaaccaagagacttcaactattaattcaacaagtccaaaattactttgaagattatattatttttcaccaaatatatacaaatcaaattgggcttctcagattagaatcaattttattctaaggataagtctttccttgctgcctttgatttaaaaagctgaaacaaattttggttttcaagtgaataatttttaaatgaaaagcacccacagttaagaggatttctcctctctctgtctcttaattgcaaattctgccattttcaatggagaatggctgatttgatcatgttcataatgattttatgcattttctttgacaggatggacgggcggcatcatcaattctggttggtgctatgttcattttctgtaatctctactctactcctggcccagccattcgattgctatatgcaaagcgaccaggaattggactttcaccatcccataggaggtaaagtaagctagatgcaggctaggcacagatgtagtctaattggtatcatgtactgttttaaatctgccttacaaatcctttcataagtttcttttactttatctctgtattagtccattttaatattgctatgaagaactacttgagactgggtaatttataaagaaaaagagtttcaatggattcacagttccacatggctggggaagcctcacaatcatggtggaaggggaaggaggagcaaaggcacatcttacatggtggcggggaagagagcgtgtgcagggaaactgccctttatgaaaccatcagatctcatgagacttattcactatcatgagaacagcatgggaaaacccgcccccatgattcaattacctcccaccggatccctcccacaacacgttggggattatgggagctacaattcaagatgagatttggatggggacatagccaaaccacatcaatctgacattatcctgaactatgcaaaaactgaattggattaggatattagattgtcattcagtttgtaagcccccatacgaaaatttatgatgttaaaactagaaggaaactttaaagaatacttatatccaacttccctcattttacaggtgaggaaactgggactcaagacaggttgtgatttgcctcaggtctaatgcccagtggacagagccagaacagcattcttgatcccaagctctaagaccagtccctttttgttttattatacaggtctttattgaaaaacagcagtagctggttatacttatcactggtgatcctcctgtgggaaacctgatttaacaaagggaaatgcaaaaatacatagagaataaagcgttttaaaattcactttttcatgtaactctgatatagaaataaaagattacaaaagataatctgaaaaatggaataaaaaagaaaactgtttttagataacattgatttttcttttatcacaatttcttcatttttttaaaaactacatctccttaattttttggattaaaagtgcttctgatgataaaattctaaaatttatccaaagccaaattttagctgataaattggatctgctagataaaataggaatagatgttcaaatattgaagtactataaaattcccataagctttttgatttaataaataccccagtatcagttcattggggaagtacagcaatctcagtagataaaatgtttcctaaattattgatcgcattatcttttgctagttaatatttaagaaattgatagaataagtttttattataacagtaatttgcaagaagaatcttcatagcaaatattgattgcttgcttctcctgatgtgatgggccccaagagagtgccaaccttctgtttcagatacctgggctatatgtgtgacctactggcagacaagccctaccgccctcacttcaagcctctcacaattaagtcgatcactgtcagtccaataccctttttcaacaaacagaggaatggatgtcgcccttactgtgatgtactcattggagaaaccaaaatatattcgacttgcacagattttgaacgaatgaagtaagtcatgatactttacttcttcctatgtacttctcaattctcatgtaaatgagcaggaatgagttgaatcatattcttcctgcaagactatatcattgtgaaatagctgatatataaaaaatgttcaacatcagtggtaatcatagaaaagtacaagtaaatcaggggatgttatggccctttttcaaatgaaaccatgatataggctaagggactagcataagctgtatacaggattaagaccaaggggaacatgggacacctggtcattgaagaaggagatggccttgatgggattaggtgagggtaatggaagaatcactgatgaatgaggtttctaagtgagcaactaggtagacggtgatgtaattaaagaagttacagaatccataataaagagcaggtgccagtgggtggtcataggggatgtggagagaagggagtgggtggtaacataacatgaaattagttaggaatagattgaatttgaggactggcatccaagactttcacagagcaagacatttctgtttgtatcctgatctccagtggattttttgttccctttatctctgcttttagtattaatttaaagttaagaaaaggcaaatacatgggggctagatgcatttgaggaaaatgagatctgcaaagcaggcatgggcaattgcagtccagatgggatgcagagagggggcctggcattagaccagcaccatcctactgcacaaccagttggcactggctgcactcctgtttttgctcaagataggaaatagtttctgggtccgggcctgggcgaacagtcctctgggccagagccatagagaactatacctgtgtctgtgtgattgtaccagattggactctctttcaatgtatattttggtctgtgtttacagagaatatcgtgtccaagatggaaaaatcttcattcccttgaacatcactgtgcaaggagacgtggttgtttccatgtatcacttgaggtcaaccattgggagccggctacaggctaaggtatggtttttggaagaatcatggcataagttcatctgagtcttcaataggagtatttctgaatcttttctccccatcactttgggcttgagtcacttgtagttttagaatgaaaaagagcgtttaaagattgcttagctcacctccttcatcttacaggggaggaactgagactcaaagaggttgtgacttgcccaaagtccttggcatgatgtccgtgccagaggatgacagccctggaactcttagcaaaccatactctttagaagcctgtgcttttcttatagtgccccatttggatcagtgtaagggaagagatttctactgaggatgtggaattaagggattgtattttttcaattttaaaaaattgagataaaaccacataacataaaagtcacccttttaaagtgtacaatgcagttgtttttagtctattcaaaaggttgtgcaaacatcaccactaattccagaacattttcatcactcacaaaagataccctgtacctatagcagtcacttcctattccctctcctccatctcctggtaaccactgatctacattctgcctctatggatttgtctatttgggacattttatttaatggaatcatacaatatgtggccttttgaggcttccttctctcacttagaatgtttttgaagcttattgtgttatagcatgtgtcagtacttcattatcttatatggccaaatattattccattgtaatgtcacaatgtattaatcttagttgataatctcagttaataatcatcagttggtgaacatttgggatattgccattttttgctattaggaataatgtggcaagtaattgtgttttgattcatcacatattggctaagtgagtgctttgtgccagccattgctgaggtttttaggattgacaagagtaagactatgtctctgcctttaagggactcaatttcacaagggaaatccatgcaagtacaaatatgcatgataccatattagagggaggatgaggtgttataatgggagcagtttgttttagccagcagtggcctagaaaggctacagagagaatatgaacttttaagacatgccctaaaggatgagttcattgggttggaacagggcatcctgggtagaaggaatgcaatgagtcgaagtatgcctgtgtgcaagaacatagtatttagcggatgagaaaatggtttgccaaggcagagttcaagtagaggagaggctggaaatgaagctgagcctattctaactggggaggtcatttaatatccatagtaaacacaaattcagatattgaaacagttgaaggtgcatgtctccccaaaatctaatcttttgatcagattcccttttcgctgattgattgtaatgtgcttctctcatgtatttttaggtgaccaacacacagatattccagcttcagtttcacactggattcataccactggacacaacagttttaaagttcaccaagtaagtactggttgggccaaaagtctatttgaatcaaattagctgtgaagtgctgaggctcaatggcaccaggctgtagcataccctggaatcctgtgctgctgaactactgagtgtcactcagtagcacagagaggctgtgggcattctaaagctttcagttgaatatgatttatcttcagaagtacaaagggaccaaagacttcaaacagaaagttctaaaattctatgtgagggaataagggtaaacaaagcgggacaaagtatcactgcttttgatcctttgcatctgtgtatccccttgtgttttccagtggggatggcagtttaatcagtggtatggtatcagcaatgatgcatcagaatagaagccccgctatagcactgaagcaggcttctggaggacctttctgcaccgacattaacctatctcatagtgtggtctaggtgaacgcagttgtgggggtggctagagccgggatggagttgctggggccaggataggagtagatgttcaagggctcaggacagtggctgtgggcctattgcactattttaataatggattttgccgtgccagtcacatcagccctgctttccagaatgcttttacatgcagtagcattcaaatttgttgagcaggcattattctcctcttttctctagattaggaaactgaagctcagaaaagtaaagtaacttatctggttatgactgagtcttttttagaaatgagacttagatttaacctaagagtcaacctaagatgacttctgtgccaaacatcataccagttccattgtttttcactgaatttatcttttttaaatccctatttaggcctgagttagatgcatgtgatgtaccagaaaaatatcctcagctatttcaggtgacactggatgtagaactacagccccatgacaaagtaatagacttaactccaccatgggaacattactgcacaaaagatgtcaatcccagcatcctcttctcttctcaccaggaacatcaagatacgctggccttaggaggtatgagtcacctgatggttttgtttttcaggatgaagcctctctgttatttatttcctgtgtctcattgatgctacatggtctttttgtcttgcaggacaggctccaatagatatccctccagacaaccccaggcattacggacaaagtggtttctttgcctctctctgttggcaaggtatttacaagtgtttctttaagtcacatggtttgatgattatgtatttcttctgtaaagatgttggccctagaagcagactacattaaagcagcacttagaggtcattcaatccaggcacacggactcccacctgtaagcccagcactttggaaggccaggataggaaggccaggagttcaagaccagctcaggcaatatagtgagaccctatctcaacaaaaaattttaaaaaattaggtgggagtggtggcaaatgcctgtagtcctagctatgtcagaggctaaggcaggaagactgcttgagcccaggagttcaaggttgcagtgagctatgattgcgccactgcactgcattctgggtgacagagcaaaactccatctctaaaaaattttttaaaagacatcattcaagtttacatccttccaattcattcccttttcaaatcaggcaacttccctactttcaactcagtagatgctcttagactgatgcaaaaggccattttaaactgaattctcccttctctctgctgtgtttttggtcacgtcattcctggactgacaaataagtgtgatttgtttatgatctccctttagactgctgcctctgtaatgagattaacacaggattctatcttccgctgtcaactaaatattataaaaatatcaaatcagcattccccccagggagccttaaccactagcagggcagaactgagcttaccctgctgcagagaaagcaaacacttggcctgtatatctctgctcttgctttaacagccataccagaaataagggctcgattactaggttcttttctctcaaacctggagatattttcagaatcctcctcaatataacacttccagctgctgccagcagtagcctgacgttggcatcctaatcaatacccattggctatccttgctttagagctggctgaggctaactgtgagattcagtgtagacgtgggtagtcagtgtttgggtatgaaaggcatgggaaactggctatggtatggtttatctgaaattatcctgattgaccttcctctgttgtgtgaatgtaagataatattcccatcgcctgcaggcttcagtttgatgaaaaagttgttcataaaattccgttgaattgaaagactcactttcagaattttctttcgagaaatggaactagcaaatcctcaaatttggaaaacccagtggtatctggacagtaggtagatttcttatcccctgttggcctttcttacctcttattttcctcacagcgagggcttttaatacaacttcactctttcctctccactgtcattttagcaaataatttagagataattcctgtagactctgaaataggttttagtatagatgcacagtctcttgtctgaacctctcagagccaggtatgtttaggaatgcagaactttttggattttagaaggatgatatgctacataaagtgatgtaacttgacatcccaagtgatatctcagataataacctataatcaaacatattaatatttctgcagtagaacatataaacaatagccctaagtgagataaatgaagactataagtatcttcatattcacgtctgtcagttttccaccaactgaattcatgccaaacttaggaaaatcttttccttttcatagcttattacattttataatttggaataaaggatgtggatccatacttgacttggaatgtgggtctatctggcattaaatatcaaatttttgtgggaagatctatctcagggagggcttagaaggtcactccttccccagaggaggcctctttcctgctgctcattttgtgctgaaagtacccctttcaagctggtataaggacctttcacagcagagctcttcttttcactttttaaatgtgtggttcacttctgctccagactgttagagaagggatttgcttttggctacaggacacatggagaagtaaagacagtgagaagtgtcagcaaatgactagcagataatggtttgtactaccctccccggccaaagcacctagcatagtgcctgaaaaaaaaaatcaacacttaggtactacttactattgattggagtgatttataatatcatctcatgtatttctcacagtagcctgtgagttaggtactatttatttatttagacacagtttcactctgtagcccaggctggagtacaatggcatgatcttggctcattgcaacctctacctcccgggttcaagcaattctcatgcctcagcctcccgagtagctgggattacaggcacacgccaccatgtgcagctaatttttgtattattagtagagatggggttttcaccatgttggccaagctggtttcaaactccttacctcaagtgatcctatctcagcctcctaaagtgctgggattacaggtgtgaaccaccacgcccggccgttaggtacaatttgttatccccactttgctgaggaggaaaccaaggcacagagaagtaaagtaacttgcccagtgtcatagagccagtgagtagtgaagctgagattcagtcctaggctggctccagagttcctgctccttacccctatgctctactgcctctcagatgctcaacaagtggtagttgaatgtaacgtgaaatacatcaagtgttccactgattagggtctaaaaacactgtttgctcagggctgaatccttctgtctttctggaattatatacatatattataacaaaaaccaacaatgctgtggtcagcaactaatctcttatggtatactggccttcctcagatcagaaatcggagaagtcattctgtgaggaggaccacgctgccctagtgaatcaggaaagtgagcaatcagatgatgaacttctgacactttccagtccgcatggcaatgccaatggtgacaagcctcatggagtcaagaagcccagcaaaaagcagcaggagccagcagcccctccaccccctgaggatgtggaccttttgggcctggaagggtctgcaatgagtaacagcttctctccgccagcggctcctcccaccaattctgaactactgagtgacctgtttgggggtggaggtgcagctggtcccacccaggctggacagtcaggagtggaagatgtgtttcatcctagtggacctgcgtctacccagtcaacaccacgccgctctgccacctccacctctgcgtctccaaccctaagagtgggagaaggtaattttttctatgttgcactgtgcctctcagatttgaattctaacctttgggccaaataggtggaattgaactttcctaataagctagacttttctgatttcactgtaagtcctttagaggaggtctgtatctttatttaaattgagagcgtaagagaaaatagaaatattgtccatttgggtagcacactaaggtagtgtaagagtggacgtttgagcttcacactcttacttctaattttctttgtttagcacttcaacccctgagctgcattagtctgcttaaacatactgattgatgaattattattgataaaaatagctaatatttatgaggtatttactatttgccagacatggaatttaatactaaacattatttaattcttacagaaactcaataaataagggctatttttatccccattttatagttgaggaaatggaagcatagaattaaatcagtagcataggtttatatgactagtaattgataaggccagtgtccaaacctaggttatttgactctagggctttccctctgttttcctataacggcttcctgaagttatagttttctgaatatatgtgggctatccagagaagtgtttggttatttgaaaatatgtttaagtgactcatgccggaagcacagcttcctagaacagagcagttggtactaggtaaggagtttgagccccttgaggctctgttagtttcactgtctcattgccagagactcaaaccttctactatgagtcatctaggattttttgacatttataagacagtgtagttgggtaagcagagatccagcacagctcctgaagaacccactcaaattagctgccccttggtcctgtcaccattaaccaagatgacttcacattaggaagggtaaagagaaatgtctcaactcttcaggcctatagtatcctataggaacattttttttccccaagcgtatccttcccagaaggctctgggctggtcttgacttgtgatagttcagctggaggcatccttcatgagtgtgggtctcagaattacagagtattggtgttgaggctcaagctccaatgttagctattggtggacccaggatgtgaactcaggtgccctgaatcctatgccaatgctatttcatctgtacttcacttccttccatacagttttaacttgccaaagtgaaaaaaagctctgtcaggaaaacagtttccaagatccaagatatcagtactcgataattgcattttaagactgtgcacctggtgtgactctcatgatttcattcatcatagtttcaggcagctagtggaattccagtgccagaaggggccttagacatcagttaattctctgcctcatgttatagacaatgaaactgaggcttagatgtattgattgacctgtctgaggatacccactggattagtggcatacccaggtctagaatgcaagtattctatccccccaagaggaagtagaaagaacaccaagtctagagttaaagacctggatttgaatcccaggacttaactgtctgtgtaacattattgaaaaatcttctcagttgtaaaatggggataatagttacatattagcattgttgcaaagactaaattttgagctcttgtcttgtggtgttgggcagttttagttattggagaatgcccctagtttaacataaattgatattttaaatgtactgagtatggtaagaagggataaggctagataacaaataaatcctgctcttaaaaccgaggtgggatatatggcttaatacgttttcagctaagacttcattggcataatgctctcctaacaactgctgggcagattagccttgtgtagcagcaatggtatcgactgtagttcatccaacaggtaagtccagactactcctttgtccacaaagataggaaattcttggagtccactgttagccctacaggaagtgacaattctgtgacatttagtgaatgaactcatgggacaaataaatatattttcccattgttttctaggtgccacctttgacccatttggagcaccttctaaaccatcaggtcaggatttgctgggttcttttctgaacacatccagtgcttccagtgacccctttctccagccaacaagaagtccttcgcccacagtacatggtaaggaaatattttatattgtgttcagtggaacatagttttctgcaagatatcagtaagtgctcatatataaaagcaccctgtgggtgcttttttgataaaagcttcctcacacatctctgtttttgaaattaacaactcaccttaacatatcaaaatctctgggctgtcttacaggacagaaacctgcttaactttgttttgctctgctttcctatttgactatggtatccttttttgcattagagctacatggacagaatcataaatgacccttgattgtaggacatatgattattttatgtaccaataagaaagaaaaaaacactgccactatgaaatgattggaagatacttcttggttagagaaatctttgaaatgtgggaaaatatgtcttaaataaataaaatatgttagtagtccacaaaattggtattccaaagaacaaagtttgggatatgatagccactagttacgtgtggctgttgatgactctacatgtggctagtctgatttgagatacactccaagtataaaatacataccagatttcaaaacttagtacaaaaagggcatgtgaaacatctcatcaatatttttatattgatcatttattaacataatatattgaacatactgggttaaataaactatattattaaaaataatttcaatagtgtctttttactttttaaaatgtgactgctaggaaatataaaattacatatgtggcccaaattatatttctatgttagagacttaggttgtatagaaagagtaataataatcacatccatttataaaagtgtgtcacttaggtaacattgattaaaaccggaggtctgcagtgagggataaataactttgagccagagagttgtagctcattcctgatgtcgaagtctattgaacattattggccacaacctagaaggtgacgtattgttgaaggcatcctgagcttgcttggagaatgcagtccagtcatcagttgactttgggaaaccatgccaatgcaaaaggaagatgacttttgcaacactggtgaaactgaaacttgactaaaaaagattccaggaacaacttttgtggttcatttccaactagtctttaatctcaaactatttgaagtgcatcctcaggacaatatacaagaaattcccctcttacctctgagtcatgctcacttgagagagtctcctgattggatgttgactacctgtaggagaaaagatgcaggaatgtagagtagagttggttttctcactcatttaaaatgttaagtcatgtcattgctctgctcaaaatgcctccccattttactcagcatgaaaaccaaagtccttgaaatggcctgtgtagcctctgtatgctctagcatctcagtgcccgtgacctcatttcccattctttcccactttactctctgcattccagctgtactggcctctttgctgttgcactggctgtttcctctgcctcatactcttccccaggcatctgcatggctaagtccttcacctccttcaagtgtttgctcaaatgtcaccttctcagtggagtctactctgattcctccgtttcaaattgcaactcgtctccctgccctactctacattcccctttctgttgtgcttagtaacttccagtatatgcagtaattaacttatgtgttacatttttttgtcatctctctctctctattagaacatgaattccacaaaggcagggaattttgttttgttcattaatgcatccatagtgcctaaaagaattaccggcacatggtagctgctatctatctttccaatattaaatataaaatgaattaactcatttttcccatcaaagtttctttgatgcacagtgatagtgtcataaggctatatgttttcctgattttaatactttgaaattattgttttaataagagtactaccctttgtgtcccatggacgtgggtgttcatacttggcagcttggcagttttggatccagttttctgtttctgatgagctgattagaacatggtgtttataacccagtttaggccagttagtactcctttgttttgtggttacatttctcattttggtctgtattgtactagcgagtggaaagaattttctcctctccttgttgggaaagcaatgatcatttcactgttactgaatcaactccccgtcttcacataggacagaatataggtgacactcagatgtctgctttgggaggtcagacatcctcagggtacttcccccgggtttctgcaaggcgtcgccaatctctcatgaaaataaaaaaaatactgcctttgggctcaacaaatatttattgaacatctattctgaagagaataatcacttgggacatgatgttggaagaacaaataaataatcataataaaaggcaaaatagagactaaaatattaggtaattacctttttgaaaaaatatattcctgtttctctaacagaccttaagtttcttgaggatagataatgcatctttcagtctctgtcccctgatgtggtgccttgcatgtggtaggtagtcataagggtttgtgggtttgattagcaacagggttgaagttctgatacctacttctgcgtcttaattggatgtaagactaggatcagagcttaaaggaaatcagatagaacgtactagcaaaaccgtctaacttccacctcagtggaatgggttactgtgtaaaaatagaagggataaatagaaaagaaagaattattattgctgataatggcatatcctttttaacttaatgatgggaaggtactagatgacttggttggtactaagtaaacaaaacaaggaaataaaaggtttggaatgctaatcttgatgccttctggtggtgatggggtgtgtgtgtgcgtgtgtgtgtgttttaaatcccagttgcaatgtcagtttagtatttgcattttaataattgatttgtgtgggcaaaacctagaggtgcctcagaaagaaattcttcatcatggcatcctgtttcctatatagattttatagatgtgtaaaaaacttactacgcacatgtattcctctagtacacctgattccttttagccaaatatttcttttaaattatatgtttggaactttgagggggggtcagaatgatttattttgaagctgtaatgagtttattttgagtaccatagacacatccctgacaaccagcatagtgatgatgtatagccagtgcccagtacatgttctgcatgactcattattctcaactcatgtcacagcagaggagaaaacaaaatgtcagttttgagtggattatgcttctatacttaatgcttagcaaaggtaaactgagcttaaggtgttttcccccttttcttattgcacactgactctgtgttaaatttagaggtgggacacacacacataagatagttctttcctgacttcgagggactgacaattgaatggagacagacacatgctcaatgataactcaaagcgtgtggatatggaggtaaaaccaaagtgagacaaagaaggagcagagacaaataatatgtcgtttctgtcaagcctcatgtgaacaaccagaggtgaaggcagaacatattgaatgttgcagagtgtggcaagaactcagaaggaggagtggatatcttgggatcttgctggggccatgcaggcttcagggatggaatggcattatcctgtgtgaactcagaaaagtgggttctgagctctcttgttctcattctttttcttttccccatttgcagcttctagtacgcctgctgtgaacattcagccagatgtttctggaggttgggactggcatgctaaaccaggtaaaagcaggttattttctgtacacatttatataattgcaaaagcataatccttacccaagatgaagtgagtactcacagagtattgtggcctacctgtgtaatttgtgtcactttttcctaaagattcatattctagaagagcttttcccaatgcacttgatgacatgatagtgctacttatcatacaccatttaacttttctaaatttcatttgctgaatgtcttatcttgacaatagaatcagacggatataaatatatatcaaactctatcacttagaaactcttgggtttttttggcaagtctgagcctcagttttcttatctgaacaatggggataataattttggtcccacatagttgtgtaagtttaaataaaaaaaacttatataagaatttctggcacagtgtagatgctgacaaatgtgaatattcttccttctttacaaagtacttacttcagggtgggatttgtctgtcatcaacaaggtctcctcctcatgaccactatggcatttatggagctgtcttgtgtgactgctcctgacattgagcaagttaagtgcacgcgtgcacatacaaacacatacacaatgggcttatcacaacaactttctgaagcagttgctgtttcctttttttattgtagcaaccccttccccacaacgtaacatttaccctgccaataatttccaagtatacaatacagtattatcagctacatgcactttgttgtgcaacagatccccagaacgaacccacctccccactgaccttctcacataactgaaactctacactcactaaataactccctacctctgcctccaccagcccctggccaccacccttctacatgagtttgactactttatatacctcccataagtagaatcatacagcatttgacttttgtggctggcttatttcacttagtataatatcctcaaggttcatctgtgttgtaacatgtgacaggatttccttctgtttttaatttaaaaattttttttggctggggcgtggtggctcacgcttataatcccagcactttgggaggctgatgtgggaggatcccttgaggccaggagttcatgaccagtccgggcaacatggcaaaaccccatctctacaaaaatacaaaagttagccaggtatggtggtgtgtgcctgtagtcccagctacttgggaggctgagatgggagaattacttaggcccaggaggttgaggctgcagtgagccgagatcacaccactgcactccagcctcggtgacagagtgagaaacctgtctcaaaaaaagatttttctttaaattgacagataaaattgtatgtatttgtcgtgtacaatatgatgttttgaagtacacatacactgtgatatggttaaatgtagctaattaacaaatgcatttcctcacatggttatcatttttgtggtgagaacatttaacatccattctctttggatttttcaagaatgtagtagatcatcattaactagagtcactatgctgtacaatggatctcttgacttattcctcctttctagctgtaataatatatcctttaaccaatgcctcctcatccctgccctacctccaaccaccccagcacctggtaaccaccattctactctttatttctatgagaccaacttttttagcttccacatgtgaatgagaacatgcagtatttgtctttctgtgcctggcttatttcacgtaacataatgctctctaggtttatccatgtcatctcaaatgataggaattcttcctttttatggctcaatagtattctattgtgtatatacaccatattttatttatccattcatccattaatggacacttaggttgattccatatcttggctgttgtgaatagtgctgcaataagcatgggagtgcagatatctctttgacatactgacttgatttcctttggatatatacccagtagcaggattgataaatcatatggcagttctatttttaatattttaaggaatctccaaattgtttcccataatggctgtactaatttacattcccaccaactgtgtccttttttctctacatccttgccaacatgttttttgttttttttaatagcaattctgacaggagtgaggtgatatgtcattttggttttgatttgcatttctatgatgattagtgttgttaggatttttttatacatctgttggttttatacgtctgttggttttcttctggtattcatctgtatgttttcttctggtaattccatagttttgggtcttacatttaaatctttaatggattttgagctgatttttttatatggtgagagataagagtctttttaccctgttgccttcttattctgttgattgttaccttccctgaacagcagtttttagcttgacaattgtcccatttgtttttcttttgttgcctgtgatgttggtttcatattatttctcttttttaaaactaatggtaaaatgctgaagctcaaagatgttaagcaagattcccacggtcactcaggaattggcaaagccagaatccagatccagacctaacttcgaatcttataggaaagagtgaagtcaggtgacatgaggacctggaaataaaacaaacactggaaataatagttcacacttgtggcctggaaacagcatttgtcttttctgtggtctgtccttgttcaaggccaccattcacccaggtcagggaaacagggtctagcaacttcttagacattttcaaaccctgtcctaatttgcctaggagacaaataaacagtaactctggaattctgaatttcacaattcagcctcaaacaactaactcattttcaatgaccttatttccttttcaggaggctttggaatgggaagcaagtcagctgccaccagcccaaccggatcctcgcatggtactcccacccatcaaagcaaaccccagactctggatccttttgccgaccttgggacactaggtacaaactcagaagatcaagatacaaataacatttatttatagctataaagcctcaaatctcagtctttggtgttacagcaagctggtattgtcacctggaacctcaaatagtgtgtattcttaagctatcctctgaaacctgagattggctttttaaaaaaggaaagcgataatcagatgtggggttagaaatcatctttattgattcatttctccagtgcctaattctggatgtgtagcatgaataaagttagagctttcaggggctcatggcaacagagtttggctgcgcaaaagtaatgcgtagggaaacagtatgagacagggctggtcagatggatttgtgccacatgatgccaaccttgcagaacactaactgtgatgcggtgatgttacctgtgagatcttcacaccgttccccttctctccattaactgtggtgctctccggtcaatttgtaaaattctatacagaaaatagactcaagtatcgtatttccagaatattttcaccatatgttaatagatgttacaggataagtgttctgagagcaggtgagattgggaagcactggtttcagtggattttgattaccactaagagggacacagtatccagagttctcaaactgatttcaccaaggagcctgttttcaaggaggggttcactggactactatgttctgaaacattttcttcctcctttttccttcctcctctagggcagtgcagatttgttaaataagggtggggtagccctgacacaaaggtttatcttggctatattgatagtctgtgatctcagaaagccctactgaggcatttagagccagatggagggaatgtgagcctggctaccgttgttgtctgtaactagtgtcagcatctttatcttccattctgtactatttagatgtttttcccttttaagaactctcaaaattattttatgcagtcattttcttctccacctttctttgtatcttactgaaaatttcaaattttaaagtaatattatatcagatgaaattttacttcaataaaatctcatttattatttatttttaatgcatttaatgcattgattcatccaacaagtatttaaggcacttttgtgccttctaggtgctaggactgttttagtaaaaaaaataaccaaacaaaacaaaactcctgccttaataaaacttacattatagaaggggaatcaaataataaattaacaaatatataatgtcaaataatgaaaacaataaaaataacagttaatagttattggggccttactatgtgccaggcactacttaaagtgttttacatatatcatttcatttaatcttcctcataatcttttgaagtagtgactgttataatcctcgttttacagatgaggaaacagggacacaacaggttaagtaacatgcacaaatcacaagctttcaacaccaagaagtctagctctggagcttgcactcataaaaggtttagaggttgatgtagctgagtgtgggaaggggtatcagttcagttcatccagtcaatggttttctacccttgagcattaattccctcatttcacaggtatttttgagtacttattatgtggtaggcattcaggatgtaataaagaatcaaagctgatgatattcctgttctttgaaacttgcactacagtgggaggaagaaactttaatcaaatgtaaaatatccgctactgtaggggctacacaagatggagcattttttaaaaagctccccaggtaattctaatgcacaatcaaggttgagaactactgctttgcttttaatgaggactgcagtggtctctggatttagctaccactttgtatttctgtaagttctctgcttcaatagcattaacaattagacttgctgagcatggggagaaaatattctagaagggtagacatcagagagtcctgcaatgttgatgagccccatgagtgcggggtcagcgtctgctttttcaccactgtatctgcagcctggcatctagaggatgctcagtagtgtttcctaaattaatgaataactggcagtgtggtaggcatatggcaaggttttcttagttctttaggcttttctgtatttaccaaattttaaaataaaaaaaacacatatgttcagaacagagtaagcttccttaaatataaaatgaaaccccagtgtagaatgaataccaagttttaggtgtatgttcccgtgctattggcaggagggctctgggacataggaagaaggaattcatgctgctagttatggaatgagtggggcaatgccaagcttgaagacaagccctgtcattacattttcctatcaccaagtgtttattgagccctgaagatgtaccaggcatgtgcttattagcatatgagcttacattattttataatatataacgtctctttgtttgcttaattgtgtaatactttcctatagttgttgtgtctttacagtatacctgtgatatagacatagttttgattaaacagatgaagaaactcaggctcaaaggagtgagttttttttacccagctttagaagagcaaagattctctatatcctgttttcagctatattcttagtgcccagcatagtacatgacacttggtaatgctcatcaaatagtggtgaattagtgtatatatgtatgaatgaatgaagaacgaatgcaagaatgaatgacagagctgagactcaaactcagattgatggtaagtccagtgatcatgatgcatttccagcagggaaggaaagtggagccccaggatcagaatagggaaagtatctatagaaagaagagatagtaagggatgagttgtagtgaaaggcttagcaattaggagaggaattaaggattactgagtgcagtaaatgaacatgacatttggaggtaggatgcacatagtctaatcccagctccattaattggctgtgtgatcatgagtatatcaggaaacctctctgagccttaatttccttatttttaaagtggagccagtgatactacttacttcctaagagtgttgtgtagatctgagcagtaatgtacataaacacattttgttaactctaaagagctatataaatattagttattttattattgttactttagacttattacatgaaagggtctttggacatcagcacatttcagttttctcattttacctctttaaatgcaagccacagctggttttcatattttggacatagcccagcttgtatgcaatgagtgcttaaaagtttggagattatggaatcaagattctacttaaattcctggcacaaaataacatcattttcaaagcttgaataagatcctttgtcctgtttaaagttatcagaatgttgactgtttttgctctccttcagtgaaatgcaagtagtatgaagttaaaacctacttgtgaaatttcaaaacatctttatttactcttgggcactaaccatgctttataacaaaaaatgatgaatcctaataattgaagtttaagtagcaccttaatgagtggactgttttattccccattcttgtcatttggtggttttttttaaattttattctagtgaagaaacagaatctgctcagaagatggaagggtggggaaggatggcacagtgggaagagccagggttcttttgacctggaggcaaagatccagaatcaagtctcggctcagctacttgctgtgtgcctctgagaaaaatcacttaactgctctgacctgcagtttgttcatctgaaggaaaaatgaggccattaaaacatacctagaaatgttattgtggggatgaaggaaataatatgtatgcctgcaattgctttatctatattaggaagattacttatgctgtcagtcaagggaatgactattaaagccactgcaaacagtgtcttaagacacaagagttagaggccactcaaaatagttttaccttctttatctctttttttctttaggtagttcttcctttgccagcaaacccaccacaccaactggattgggtggaggattcccgcctctcagctcgccacagaaggcgtctccccagcctatgggtggcgggtggcagcagggaggtgcctacaactggcagcagccacagcctaagcctcagcccagcatgccccactcctctccccagaaccgacccaactacaacgtgagcttctcagccatgcctgggggccagaacgaacgtgggaaaggatcaagtaatttgggtaaggataatggtatgggacctagctatggggcagcctgtctatgttgtcatactgcctgaatgtgtctctctgaaggtgacagtattttctgggtagtttcaattcagtagtttctgagggaatcttatagttgtagagataaaacatgattcctacccccaacgctgtacctggaggctcctaggttgactatgctcctaacttttataccattttgtgaccgtgggctcacttggctgtttatctccagactggaaccagatggagggcagggactgtgtcttagttgccatggtatcattagcacctagcatagtgcttggcatagggtaggcactaaatgaatgttgaagggatatgagtggagaggtagatggatcttaaagctgttattcctttggaagaggaagtggaagaaaaagttggggaatctttcaagcacattggtcatatttgccctttggtcccagttggtggactgcatgtgtcttggaaaacttggtctttcttatgctctgcttggtggattcctgagatcagcggggtacctatgatggtgccaacacctgaggctggaggatactctggataggatcttgacaatgaatgaaaagtaatatttttgcataggaaggatggttagatttgagtttattaaaagcctattttggtacattttatatttcagctgattttgtcagaccctccaatgaagtacataggaacatggtgagggaagaggcctttctctctatggaacatggaaaggcaattcttatgctcttcctaatagctgtagctaacatttattgagtccttactgtatggcaggtgctatcctaagcatttttcatgtacaggcatccccctttatttgtggttttatttgcagtttcagttacctgaggtcaactgcagtctgaaaatattaaatggaaaattccaggaataagcaattcatacatttcaaattgtgcactattatgagtagcgtgatgaaacctcgcactgtcttactccatcctgcctaggatgtgaagcatccctctgtctagcacatctatgttgtattctctacccacccattacttacttagtagccatctcggttatcagatcaaaaaaaagagtactgtatatatagggtctggtactatctgcagttttaggtgtccactgggggtcttggaacataccgcctgtgaataagtggagggactcctgtattatttcttataatcttcaaaaccaaccgcatatcataggaagctgtgacacagatcgatgaagtaatttcctaagtttatacagcttataagcgacagagccaggattcgaaccctggcaatctggctccagaacccctgcccttcattgctaccctctactggctagaacacaggtgctcacaacaccagcatgttaggaattcagttgtcggggatatgtaacatcatgtttgttcttgactagcagggatatttcctggacaattccatagagtcatgccaattcccctccatttttgagtagatagatgtggggcgagtgacttcaatcagcaaatacttatggagcatcttcagtgtagaaaacattgaggatgcagcagggaacaagaaacaaaatccctagtttcagagcacttacatttcagtgtgtgcaaaaacaggtatgtgtatgtcttacagtatagagatagcaaatggttttcaactcaaaaactgattttggttgatttgaatcgactgtatggactgttatgttttggttctattttgttttaacaagcatttagatagccaggcactgttctaagcattttaaatgttaactaattcattttcaaaacaagtccataaggtgagtaatattcctaacaccatccccattttatggatgaggaagttgaggagtagagataataagtaacttgcctagattacatcactaataagtggcagagctggaatgcaaacccagggagttggggtccaaagtctttgttcctagccaccatgctcggctgcctctccaaacaaattgagaaagattaagaggctacaaccagacttggagagaaagagcaaagtgattgactaaaatatcaacagaatatgggcagagaagtggtagcatgcatgaatttcaagtaccaaaccgagatcccagtgccaacactgatatgagttagttataatctggagggataatgagtatcctcatctaaagagaaggtacagtggaaatggaattggatttggcttcatgatccagcctccagttttaaccttgccacatatatgattctggacaggttcattttcttcatctgtagaatggatgcaacagtctcttaccctactcacagggtaagcaagcatgagggttaaggactgaatgcatattaaaaacaccttgaagactccagatgctgtgagataatgatacagcattatgtttaagaatgaaaactgtaatgattttcaaaaattatattgcagaagggaaacaaaaagcagctgattttgaagacctactctctggtcaaggtttcaatgctcacaaagacaaaaaggggcctcggacaatagctgagatgagaaaggaggaaatggccaaggaaatggatcctgagaaattaaaggtgagtgaggcccctgacgcagcttgattatcctatatgacaaagtcatgtgataaagtcatgtgtatggagctatcgccatgagagtaacctattgtcttagcccattcaggctgctataacaaaataccataaactaggtggcttataaacaacaggattttttttttctcatagttaatgaaggctgggaagtccaagatcaaggtgccagccattttggtgtctggtgagggccatcttcctggttcatggatggtggtcttttccctgtgtcctcataggcagaagaaagaggtcttgctcaggcctctttcataaggacactaatcccatttataagaggtctgtctcatgaactaatcacctcccaataggaagccctaacctcctaataccatcacctctggagttagaatttcaacatagcaattttggggggacacatacattcagaccatatcacctataaaaggcatgatagtagatttctggtggccactctatttcatttggtctttgcagctgtgatttgagtacagctgtgccctttaatagcaaagtagctctgaggaggttgcacacactgtttactttctttaataaaataaatgttattccatgatatggcaatatagatttcttttgtttgcctgttcaaatgagcagtggcactttctaagaggtgattttgttattcagatggcattcacattctaaagatgagtcattagaatttgctggtaagaagaatgcattatttatgttttctctttctgctttgagagcttttttattaaaccagattgactgaagcccccaggatcttttctctaccgatagagaaatatttatgtacctgagacttaccaattcctgcaacattagacctggagctttggaaagtagaggagagaaaggctgagggaagtgtggctcctgtcttccccattgtctccctctacttttaaccaaagcagttccacttttctctctttctgattctggaggtttaggtaaaattagatttgaggtttttcctcaaatcaaatcaacatacttttttcctcaaatcaacatactgttttagcatgtttcagcattttgtttttttaagtttgcaattcagcgaatctaacccctttgtttcacagctgaaaaaaaaccacataacttcatagatgaagatgttgtatggacaggcggatgcggattagctgggaaacagagggtggttctgttgatgagtggtatgaggtctggaagagtttgtaaagatcaagagaattggaatgctcttcacagatggagaggttgagttcctatgtgacaaaatactaaatatgctgatactacaacaaactgaaagaggaggatgtaatctgtctctgtattaaagcatctgcaaaaccagtacttaaacagcaagtcaatcttaacacattctgaaaacatataccaccgttctgtataatttcctgacagatttgttgcagatgtatataatatacatctaatataacttagattctttgatacattttttagtacaatgtagggtctttcatttgcatgtttttcactccacccaatgtcacagaagcttaatatttcttccaaaaactttgtgcttcatctcaataaccgttgttcattaggcaaattcggacagtttcctataaaagaaagctgtttatttcatttaaaccatgtttgattatttaattggtacagggtatgtaattgtttgggagggtagctgtcattaatgtgactaaaccattcatccagcaacactcacttagctgaactcctgttaggtactcaatgctgatacagttttatgatccctctgacttaatcacctcatttgttcaaactgtgaatgttcatagttcaaataaatggctaaatgggtcaattcacgtaacaagcctttttgagctctgttctgcaccaggttacttatttggttccgagatacagtgatatataagaaataatacttttcctcaaacagctctgcctaatggcaggcaaagagaaacacacaattacaataaagtgtggtacatattatggtagaaatatgtttaaggtagagtggcccagagaagtttggcccttttttaaggtttacttatttagtgcagtatctaccctcatggagtttatattgagtataactctgggggtggggatgggagagaaaggaattcaaactcgcaaagtctaacagtgtgaaatttctcagcacccttttgaaagatgatagagttaaccagggagacaaggtaggagattgaggaggagaagcattccaggtagaggaaacagcctggatcatacaggttgccctaagtgttttgatgttgctggagcagaaggggtttctagagtcctagtggaaaccttctgaactagtaagtaagcatttgaatttcttaatcccctttgtgtttacagattctggaatggattgaaggcaaagaaagaaatatcagagcccttctttccacgatgcataccgtactatgggctggggagaccaagtggaaaccagttggcatggcagacctggtaacaccagagcaggtgaagaaggtgtacaggaaggctgtcctggtggtgcacccagataaagtgggtataacctgccctgttgtgtaacttgtcaggtccttgcttcattatcttatgagtatgtgttttactttaaatgtgctggttcatatggcctatttttaataaaattaagtcaatgagctaaaatcagatatttaaacaaatagttatactttatgaaatgagaaagacgatatcaaactatatattacaggggcttatttagagagagtaagatttacccagtgattaatttttagggctcagaagtaaattgtgtctgagtacggtggctcatgcctgtaatcccagcactttggggggggcagggtaggcgaatcgctcgagccctcaagtttgagaccagcctgggcaacatgacaaaaccccgtccctacaaaaaaaataaaaaaattagctggtgtggtggcataagcctgtagtcttagccactcgggaggttgaggtaggaggatcacttgagcctgggtgatcaaggctgcagtgagctgagatcgctccactgtactccagcctgggcaacagagtgagaccctgtctccaaaaaaagaaaagaaaaagtaaattgtgtcctggcttacaatagtaaggacaggctaagagctggacagaagaaaactcctttcctttagagatacagcagtatagttagctaggatggtaatgaaaaagcttcagaatgtagttggtaaaatttgtgagaatcaataaaatattcagaatggaattaaatttgccctctcttgattattactacattgattatgtcagtttatgttttcattgaagtatatatacatctaagggctctaccttgtcagaaacttcaagtaactcatggacaaatgaaatcatcatataatacatagaaacattcagcaagaagtgagtcatcttgctgtcacatagactataccagtcatatgacatgaagctatgatcgaagtgccacttgggaacacaggcttgaatttgatgcatatgattttcatctctccacatttttttgtactagtctgaaaagaagaattaatgagaagcaatggtagtgcttgaattttgatgaatcaaaagagaaggagaaacaagagcccagaaaaatccacaaactgtattccccattatgactctcaaagaactttttagaaatgggaaaatgggagttaaaaacagtcaatagagatgggctgtcatgaacctttgtcatttggcagatacgtctggagaacagagatacgtcttgtgctgcctgataagctctctgttgtctacttcttgatggattactactacccttgtgcatttctagggggaggtcattatggggaggttatagtaatttgggtcagatatagtagattaggctgaaaaggagaaatggccaaatagaaaaacatttccattgcttagagcccatatattggcagtgaaaaatttaatattaatgaaattttggtctgtggtatctaatgtgtgtttttgttttctctacaggctactgggcaaccctatgaacaatacgcaaagatgattttcatggagctcaatgatgcctggtctgaatttgaaaaccaaggccaaaagcccttatattaatttatgagcttttccatctctgctgcagacctgtgctaatgcttagtgtgtgtcacaattctgaggttttcgcagatgaaccaaaaactccagtaacatgttttcagtactaaaccgttaagttactcatgaattaatttctcattgataaggaatgtggatgtttggtttctccaaagttcccaccataaaagatccaaagcatgagaggaacttctagtcagatgaccttgcagaaccaccgcattccaccctgccctttggggagcctactcagcattctacctggggaaatggaaaacagaggccaccacccatgaaggcataacacccatcacattgtctgagaataggattaatgagcaaaagttatgataatagagttatatgatggtttaatggtttctagatttttcttggaaagatataatttgagcagtggctttatgcagactccaagaacaaaaccaccaggtatttttttttaagtaaaaatttactaaggcctttagcataatactgtaaatgtcttttggtcaagagaactaacaaatataaaggaacttgaaatgtggggagtgataatagtccagtgattaaactacagtccagtgattaccaccaactttctgactaagctaaaaatgaatgaaaatggtggctaaagaaaatagggactctgaagatgtcgaaatctttattcctggttaggaaggtgggccgctacccttctttccctttagaaaactgtgattaattaaataaaaagtcttactactataacaactctaaacctggtttaaatgaaacatctaattttgctgtaaggcttaatgctcttcttttgtttagccaagaaaacattcttagttggaaacaggtggtaaagtagtttggcctgttcacaacttatcaggaccaatatctagtgtggactcagtgttctctaggtttgtgagcagttgtggtaagagaatggaaggcaacactgaataggagttaagggaatggcacgatcacagtgagagagctgcactcacctgcagacccagtcagatggcttgtcagtatctgctctgaggaaccaggtcccacctccccacaaggcaaatctagacccattaaattattacagtgggcttttttgttttaaaagtggttggggatccacaggaacgacattcatacagggacatttgtgaaagcaaagcaagaatgaatgctttcccgatctcagactggctggattcagatcagtgtgttggctggttctcattttaaggggtaagcagtttgctattctgtgactttagtagatctcttttgtgtgcacatatacaatgtgcattatacatatatattaaatatatccacaaagcagatgggcaaaaagattttcatgctaatcttcaaaggttcatgctcaatattgtgaaaagcttttaaaagttgttttgaaaagacaatcattttttgtttttgttttaactttcttgtggcaagctataccggaaaagcggcatgtcaaaaatactttaggttctacatagatctctttctctcttttgttttgtttgtttgtttgttaaagttcattatttattttaccttttactgacaatgtgaaactcgaagaaaatgttctctttttaaatatacagtcataaactgttcaaggtaaccataacaaactaggtgttatttattaacgtattataaaataatgtttgatccagtatgtgcttgtcttatttaaaattggaatgtgagacatgttgctgtgacctgtttttctttctcattcacatttgtagatattgtgtgaactacagtatataatgataacaattaaaaggatattctgtggatgtcacgtattttgaaatgatagaactacattagctttgtatcatgtttggataattcatcaatgttcacagtttaaaacatcattaaacattatgtaattacaatgagaaagaatcttacttaaatttggagattttcccccacatctcttttccggatacattataattctggacccctatttatctcaaaactcttaatatatgcagaccaacaggtctttgcattccttttaaataactggttgtgacaaagcttgttgttgatcagattcactgtttcatcatatttattgtaatatattttttgttttgtaaatatgttacaacaaaatgtgattggtctaaaatatttgtaatgtatattaaaaggttcaaaaatatttgtataaatctaagttatttgggtacttgtaggaatacaatgaggagcttgaatgccaccttctgacatgatttacttttaaggaaagttatgaggagagaatacaaaaagcatgcaccaaaatgtaatctgacaggatttctggatttatacgtaatcactcctgccccaacacacacacacacacacacacacacacacacacacatgcacgcacacatgattttgattatgctacatgatatatgtttcaaaaagaattagcatagaaatcctggtctcctagccaaaaaaatcaaaggattttcaaaaaaacgaatctgtatgttgaggcaaaaggattgaacctggaagtctgggactttatcatagaaacaaagtctcagatattttagttctttggaaacaaatgctgtaattcaaaagcatttgacctgtcactgtactatctacatgtggaagaatgttcaagttgaatcctaatgccgtgaatgaaacacagtctgtgtagggaatgagcaaaaaagttgaattccaattgctttttggccttttggctaaaataaatgtagcatctaattttatcagttt

SEQ ID NO: 86 - DNA, 151176 bp, Homo sapiens; identical to SEQ ID NO: 85

SEQ ID NO: 87 - DNA, 106335 bp, Homo sapiens
ggcgccccgagccgagctcagcccagggcggcggcttcgcctcgcccggcgaagcttctctccggtggccgctccttcttttccctcctctttgcgtcatgtcgggcacttaatttttttttttttttaattccttcttcagccctttccaccttccatctcccttttcgcttcccaggttgattattttctcttttctccgggcttgcccatgagcctcctcgggagctaccggaaaaagaccagcaacgatggttatgaatctttgcagctggtggacagtaacggggacttaagtgcgggaagcggcggggttggcggcaagcagagagtgaacgccggggcagcggcgcggagtcccgcccgacagcctccggaccgcgccagcaccatggacagctcaggtagcgctgcccgaggggagtgcagcgctgagccccgcgcggcctccggagcctcccagtcgcccggcccgaggcccccccgtggtcccccagccccggtttgcgagagagccgggctggaggcgaaggcttctaataccacctgggtgtcgagtctctaatttctctcatccagggagctacgaaacgttagatcagtcctgaggcccagagactgtagcgagctcctcctaatctctctagactgctgaatacggcagctgggggcggggagggggagggaaggaggaggggaggggtggagaagagaggggagcgggtggggcgaagaacggcttgggaggagggctgggagaggcagctgctttcactgcccagctggatgagggggagaggtgaaggagcatgtgcgttgattgtttttgcagcatgcagacggtatttattccaattgttattcttgcaatgctgatgctatttgcaattctgtaaagctctgccacatcttaactcagccgtctgctagggttaatgttacctttctcctgcagtttttaacctgggatctagagctcttttacacagcttttactgtttgcacaatgaaatttatttcatgtgttggctttgatcttgtttgtccttttgcttgagtgtacagatttcataaacctttacatgtagggacaaggaaattcctctaaactttgtatcggggcttgcaactgtcttttataaaaggtttggcaagttagagtcctctcttggaactgctgttggcatttgcgatttcaatagcaaaacagtcatttaatatatccatgttggactaggagtattattatagctatttgcttacttctgcagggaaccaggttcggagaattgtttacagagatatttataattgaagtcctcagtggttggttctacactggtaactttaatactggacaactgaggattccagaggaaagattcatatggggtcgtttgaacagtaatgaaatcaaactgaatttaaatgccctgctttgcaaacaaatgcttgtttattttaattgtgtaatggctgtccttgggctattattttctattttccttgtcccaaagtgggatgaaatattgtccacagatgctcaaatgtcctgggctgaaaacaaattctactcattgaagctcttattgaagttaaccaagatattgatgggacattctcttagaccattttaaataaaactaaaatgatccccaagggattgatggtttcaggactgtttttttttttttttttttttttttttgaggcggagtctcactctgttgcccgggctggagtgcagggatgcgaactcggcggactgcaaactccgtttcccgggttcaagcgattctcctgcctcagcctcctgagtagctgggattacaggcacctgtcaccatgcccggctaatttttgtacttttagtagagacggggttttgccatgttggccgggctggtcttgaactcctgacctcaggtgatctgcctgcctcggcctcccaaagtgctgggattacaggcatgagccaccgcgcccaggcaggacttttttattgatgttgtatgtggttattcaatgtatgttttttcaaatctgtgatatatcaaagtgtaatccatcttttgactggatgtaatctcctttaaatcttaaaaagattcatgttctctgaatgatgccaccataataatgtttacatgtagtgagcatgtaaacaattgaaatgaaaacaaacatattccaaatgagtgtgaaggagcctcacttcaggaaaatgaaagaaatatgaaatacatatgttttcctttttcatagggattattattttaagagttgaaattggtttttgaaatatgttacattgtagaataagttcaacatacattttctgagcccagctatgtgccaagcactgtgagggaacacagtagtgaatgagatccttctggcctctaggggactctcagtgggggcagtaactataacacagagcagcctatggtaagtcctggatttttgaggattgtctttttcactaaatcagacttttttaataggtggagagaagaataatggattgctttaataatctgttgtgatgggaaagtgtttcattaagaatattgttatctctaaagtgctattgccaggagttgattcttaaacttgatcaaagtggtgttgtgtgaagaggctgcagggattccttttctcctccccttatccatcattcactcctatattttattaggggaatattgtggctttgttgtagaagtacagggtatcttacaatgattttgatgcatattttcaactgagaatgatttgtttggtttgaatgaaggattggactctgagagtaggattcttttactagtacaactatatgtcttgcctaattatagttctttcttctaagatcctcaaagtgtggcctgtgcagtgtaaatatatccatttgtttagtatatctaattaagttcatggatcatttctaaagtggcagtaatctgcccatttattcaactgattgtactgtgacatgctggataggatcagtggtttatgggacttttgctctgatagaaatattaatgagtggaaaaaatatgttgacatctcgctacatgatttaaagcttagtcttaataataccttaaacttgtaagactgtttataatagaacacttggacaattctcttatttcatttccccagaattttattaaataggttggggaagcagcatgtgtctgtgcttggagacttgggatcaaacctctgcattattgttactcgctgaaaaacctagtaacctttttcttttcttttctagacagatagctctgtcacccaggctggagtgcagtggtgcgatctcagctcattgcaacctccacctcccgggttcagacaattcttgtgtttcagcccctcaagtagctgggattacaggcgtgcaccaccacacccggctaatttttgtatttttagtagagacgggctcttgccatgttggccaggctggtctcggactcctggtctcaagtgatctgcccgccttgacatcccaaagtgctgtgattacagggtcttgctccattgcccaggctggagtgcagtggtgtgatcatggctcactgcagtctggacctcctgggctcaaatgaccctcctgcctcagcctcttgagtagctgggactacaggtatgaaccaccatgcctggctaattttttttttttttttctttgtagagatggggttttttgccatgttgcccaggctggtctcaaactcctgggctcaagcgatctgaccacctcggcctccctcccaaagtgctcggattacagacatgaaccaccatgcttggcctgttcccatttataaaagtggaatcataagagctgttcttaccacagagctttagttgaggctgaaaacaatataaaaatacatttgcagtttttctttactttgtatcttgccctttcaatttatcatatgaagaaacttattctcagaggtggtaggagacctatcaaaggtagaatagataatgacagccagacttaggtcttctgactcaaaggtttgagtttttccccattgaactaaacttttgggtagacacaatatcaactgattgttgaaatggaaacatttttatctactttgatttcccccctgtttttagataaaagaggggtacatgttcagaggaatgtaatggctttctaagtcaacagcctctcaagtggtagataccagagcagtctcctagccagatgtgacttccagagctctctgccttccctggctcactttctcttcattcaaattattctctagaaaaggttgtcatttaaaggtcatcctgtcatatctcaaaggcactgcactatcccaatgccgaaaaccccctatttctcttgtgtgcaccccacttttcagggaaagtagaaccacaaaagtagaactttcaatattgagctgctaaagtgttccaatattgggcttaatttaccaagttcataatgacaaactgaaaaagagtagtccaattaaaatctggaaacagatattaatactttttaaagaataagtataatgataggtaaggatttctcttttgattctcactttttaggctttgttctatatatttaaatatatagaaattcacatatataaataaacaaaatattgtatatattaaaaaaaaagaataaggataatgaacaatgctaaaataccatgtagtgtgagtctggttggaaacaaaaattacctttaacaaattctattttagttagtgtttaaacacagcatccacattttgaaccaggtttcaacattatgagatacgtgtttggataattgtatacttcatggaagtataataaacatatatgtactaataatcctttcttaagaatatctgcccattgaagggtcttgtaggttggaggcaaagtttatttatataacttattttttattttttttttattttttgagacggagtctcactctgttgcccaggctggagtgcagtggtgtgatcccggctcactgcaacctcttcctcctagttcaagcaattcccctgcctcagcctcctgagtaactgggattacaggcacccaccaccagccaggctaatttttgtacttttagaaaagacggagtttcgccatgttggccaggttggtcttggactcctgacctcaggtgatccgcctgcctcagcctcccaaagtgctgggattacaggcgtgagccactgtgcccagccaatttatataacttatttaatgtgtggttatagtttggatgtttctggataatcgtttaaagatgcaccagttactggattacagaataagatacgtcaatttaagtttcaaatttcaaatgcttggagactgccagatttcatagatttggaaggggaatccctggaaccaaatctcggaaagttggccaggtagccaatggtggacactttctgtgatggagctttagctactggggcagtgtctttgaactgttctcatcagtgcagagttctttttatttgggcaaaatcagcctttctgttctctagatacaaattatgtctaatccttctttcacatggtagcccttagacaacagatttttgagaacaggtactaattctctcttagtcttaattttcctcttttctaggccaatcaaacctaagttccacatgcttttttctctatataaaatgatttccatataattatcctaagctttgagaataatgttttttttttttattattttgcacaacaggggttttcaccaatttttattataaaaggttaaaaaagaattaaagattacagaaaggaataaaatgagaaaagttaagtattctctcccctccctgatcatttaggtccttgcctcagagataacttctactaaaagtttctggaaggactttcaacgtacaacatgagtgtgtgtaaatatatatgctttacacatatatgtatatgtatgtgtataccattagaattataataaaatacaaattcaaagtttaaccatgttcatatatgtacattgttcaataatgcttaatgacaaaaatagctacaatttaattattataattcagggattatgctaaacactgcatatggtgtcacatttaaccctcataagaatcctataaggtaaatgatagtaacggtcatcttatagttgaataaactaaggcacagagaggttaagttgcgtgaggttacacaggctctacttattctatattgagtaaaatgccatagagaaatgcccatacgattgcaaatgaagaatttagtggtgaatttttttatttgcttctttctctgaggcaaggaaaaataggagtgattgagagaaccaaaatgagttcagttgttttttaatcccatgaaagtacaaatatgttttctttacttaaatataaagaatttaaaaacactggaaatgaaaacagcaaaaacagcattgaataaagctgattaagacttgatacggcactgagagaacaatacaattgatgaagcattatatatttttggaaaaatatattgcaaatgaaaatggatccccactgctcttaggataaaatccaaggtattcttaacaggacatcagaagccctttgtggcacctgtgaaagctggcccaacaaaacttgttgtcgctccactggtagatcccctccccagcctgcacctccatctttatgtttttgcatacactgttctctcaactcaggccaacttatcccatagacccctggacacccacttttccaggttatctcctattcattcttcagggtttagctcagatattccttaatcgcaggctgcatgcaatggtcattctccatgctcctcagcagcctttacttccgtatcacagctctcatcacattgagttgtgacatgctgcctggcctgtctctccctctagtctgtaagtaaagttcagagcaaggctgggtcttatttgcctttgtagtcttgtcattgcttggcatttattaggagcctgataaatacttgttggatgcacaaaagcatgaatggattttgaatttttaaaagggcatttataatgaaatatgcccatccaaatctaaaaataagcatacagctaggttttaacagaaatgaggccaggtttgagagaaatgtaactgttggtcgaaagctagaccaattcagtaatgagcattttttcatatgtaaagacactggaagtgaaagaaagatggttaatatatagcctagatccttaacagttttctaatatagacatgtcaagaaagaattagcttaccaaaagattgtgctttttcgaccaacaaatacaatctactgtatgattcatcataaaggtcacttttttttttttagccaaaaaaggaaactcaaaatgtatacaatttttttaatgaactgacaatagatgactttcatctatagatctgtgtatttcttaatcggtgtcattaagttttaatcttagccattttcaggtttaatattaaaagttctttgtatcatctttggccgtctgcagttgtatataagctttgtgctaacttaactgcttttttaaatctgtgctcaccatcttgaactccttttggaaaaaagctatgtttgagatggatgaagaatgctggagtttagattgtgcatttccttgttgcgaaaggtgtaactctgaaaaaactaaattacagttattgtatattaaacagctattcctgaaatttacttggaagcttttgaaagagtagctcagtatctgaggagaagttcttcacggtccaagaaattaggaagttccataacatgtgccaagggatctggcaatttctactacctttagttgctttatcccacatgtcacaggccatagtctagatgcaaaaaatatctttttatttcaataacacatcagaacatagttttaaaagtgctagagatagaaactttaaattaaaattaaaatgcgtgtagtattaacagcgcaaatgtcaccaccaaggaagcaaccagatgagccaatgcctcctgtgcagtgttaagtttgcatgtgcagaaaattactgttgttgtattgtggtgtagtactctacctggtagctggcaagtgtgtttggcatacattgtaagccacttcctaattttagaagtgttatgctgtgaaaaaagtgcaattagaattggagatatttgacaaaagtcagggtgaataaatagtataataatagttatataaagtgcaataggggtgcagaagaaggagccataattttaaccaggaagactaaagaaggccacagtggaagttgatatttgagccagaaatctgtaggaaaagaaagaaagaaaacccgttttgggctttgggctaatgcacagtggcatcatagtgcatggtatgtttagagaattgcatttaggcttgaagctggagcccagatgggtgggaggtgctatagcagatggtgctgggaagataagacccaggtcagggtgagtctgcttgaggaggttggactttattctgcaggcagtgggaggccagtgaagatttggagatggggtgaggtagggctgacttatctactaggcacagtgtctagaaaccacaataattttagggtccacaaaaatgtttacattttaattgcctttaaaaatcagaataaaataaataagtataacaataatgaattcatctttattcaaatgcagtcattaaaatatatgtttttttttctgttaatagaggaataggtccatgaaggtaaaaatgcctacggcctacaaaagtcatactgcagccccagggaaaagagggcaaaatgtgaatcctggagataatttacagctgtgtgaaggatgaatcccaccggtggttcctaactgtgatctggctgcatcagatgtacctgagtaaacacagattccctactatgcagccgtaaaaaggaatgagatcatgacctttgcagggacatggatggagctggaagctgttatcctcagcaaactaatgcaggaacagaaaaccaaacactgcatgttctcacttataagcgggagctgaagatgagaacacatggacacatggcagggaacaacacacactggagcttgtcagggcatgggtggggcgggggaaggagagcatcaggaagaatagctaatggatgctgggctgaatacctaggtgatgggttggtctgtgcagcaaaccatcatggcacacgtttatctatgtaacaaacatgctgcacatgtacaccagaacttaaaataaaagttgaaggaaaaaaaggaaaagaaaacacagattcctgggccccaagcatgtttgatttaggaggaaggggaggggtgtgttggaagacagagcatgccagtggaggaccaggagaacaatcaaattgcagtttagctgatgacctgagaaacaacgaaggccctagccagggcagtgtcagtgagactgggaaaaagtcagcctggggaagcattgcacaggtgaatgacagactgacaaccaaccaatggtggggtctgagatacaggagatacctggatggcagcaggagagaaggtagtatttctagtctcagccagaagtggaaaatgtgatcaactgtttttctctgctgcaagttcaccatgaacatacttgtggaagggctgagaatactgttagcttggcacaagctttcaccaggctttcagctttttggtaggctgcccattaggctgtgcagatgcccaggggagtgctgtggaggggtgtgtggtagaagcaggccctgtgtttgcctggaggaagagtgagataatgggtagaaatgctagaactgaagctctgtggctctgggctgagtccaggcctaaggcccgaggccagtacggtgtctgtatcgggtggccccttctcactgggagagccctagactctggttccttgcttgttgatggaggcacagcaagaataatcaaacacctgagaaacttggaagatgattattgaaaccagaattttttttcagaattctctggaaaaaataaaaaaaacaaaaaacaaaaaacaaaaaaaccaaaacaaccctgaccccagaaattctcagggactttcttgtaccagcatttggccacttgagcattgcggcaaaaatcttagcagataatagtcttcatttttccctgatccttattcttattttagtttcttcctcttctgcagtctttccctctcttctcttcttttgtccttctctttctctttcccacccatcttcaacttccttatccctctctcttctcctttgcctcttgtactcatctgctcccctcttctcttttctcctccccttctctctagtcagtgagtcagcatgcctgggagatgtggagccccatgccatatgcagatgactgtagttttgggatatgtgtacgcatgtgacttagttctcagtctgctgcatgtggctcaaaaggtgtgaagactggtgtcactttccaatttaggcaattgcatctggcttacctaaaatttcacttgctgcttcaatcagcaaagtgtttcttccatactgtgacttggtgatgagaggtttcatgagctgcaataccagaggcagttgcatttcattcagatgaaggaatgaattttactaatccacagcccgagagtataagataatagctcaccatttcttcccctccatctctcttactttacctctgtaggaaagcagatctttctcttcttcttccctgttgctgaagcctagatatattgctctattttcaacccttccatgtctaaattagttgaggctgttgagcagtgggagtactagggaattatgagtcaggaactccaaatctaagctctgactttgtcatttacaagctgtgaccttgggcaagtcattcaaatgagaaaaatcatactgaccctgcctttttcataggcacagtggaatgtgagaatgtaaatgaatgcatttgcagttgatactcttcattcattcattgcataaatgtctcctggctgcctactatgtgctgccactcttctagccatgggggatacagtagacgataagatagataagaccttggcacttatgagtttgattatagtgcatgagcagtgaacaaagatatatggttctatggtatgctaaattctatggagggctagagcaagcagagaatagctcaggatggtagtaggatggggagacctatcttccaggggctggtcaggaaaggcccttctgaggagataatgtttgagctgacacctgaagaaacagaaacaagcaggaaaaagaaagagcagagtgtagggcatttcaagttctaggtacagcaaatgcaaagacctggagaagggggatagctttgtagaaagaagtgtgtacctgatataactggtgcttagtgaactaggagggcatggccacaaatgaggtttgagttgtgtttttaagagactgtttggctgcttgcatagagagagtttgaggtggcttcctaggtattccacattgtaggcaggatttctacatcatagacaaggtcagcaattatactgttcaacactaagtatcagtcttttaaaaatttatttatttatttgagacagggtcttgctctgttgcccaagctggctggaatgcagtggtgcaatcatagctcactgctgcctcgaattcctgggctcaagcaaggctcctgcctcagctttccaagtagctaggactacaggcatgcaccccaccatgcagggctaatttttaaattttttgtagaccagagtcttgctatgttgcccaggacggtcttgagacctcaaggaatcctcctgcctttggcctcccaatatacagggattacagatgtgaaccaccacacccagcctaaatttaattttttaaagacgatttttttttaagagaagttttatgttcacagcaaaattgagaggaaggtacaaagatttcccatatatcccctgcccctacacaggcatcgcctctcccattatcaacatcccccaccagcaacatactttgttatgctctatcatatgcagaacttacaatgatccagtgaagtaggtggtattaacaaaatgtttttgagagaaggttcaattaggttcaatgagcttatacacagtgaaactagcagcagaactcaggtcttctgccatattgggacatgagagagattttcagaagaggaattgacatcttgggcaccctgtagccaagatatatcagctactttaggaagagacaagctggagggataggacaggaaaagttgggttttaattgccagggaaattggtttagattgccttgaaagtatagcaggattttactgtaattattggtcttaaaattcagccattaaaatctcctaacaggagataggagcctggctttgtctctgaatgtgccaggagagaactgtctccattatgcctctcattggcacacagaggctgggaaactttcacacactgtctcgttttgtgagcatttgcagttgtaacggaagacagctctattttatatcttgctttgttttcaagccattgcatgaaagccaggcctcttggctcttaaaaattaacccccccaaacctattttagtttatagcagtgatacaggttaatgaaaagaatatttaaaacaattcagagagtagtataaaaatgaaaataaaaatccatttttttctatcttctcacacagacatggattcttgcatattcacatatacatacatccaatcatatatataatgtacacttgaattcctggaatccatctatacatgctattatataatgtgatgttttatttaacattgtcatagataactttctatattagtacctaaagatgtaccttattttctctaacgattgttttaaattccactgtccaaattcctctattgatagggggtaaatatctttgagcatatatttttatatattgtatatgcagtatacctgtgggaaaaattcctagaagtggaattactaagagaaagaacatatgcagttcacattatgatagatcctgcattgttgctaagaaccttgcactaaattaagtttctaacagtatatgagactacctgttttcccacattcttgtcaaagctgagtattgacaaacttcttaatctttggtagactcatacatgagaaatgatgataatggtttacttgaaactggcattaaaggttgatatttctgtgaattatttttgttttcagaaattaatttgaatagcttttcattaggtaggcaatacatattcaaggcaaaacaatttggaaaatccagaaaacacaaagaaaaaataaaaataactgataaacttgtttttcatgaataaccattgttaacatttaggatatacctttttgtctaatgcatgaagtgtgaatgagaaaattttattacagcagtggggaaagcattggagttggagccagtggttgttctagattcaagtttttaacattgctgactagctttgtgaccttgggcaagtcatttaaatcctctgagcctcagtttcctcctttgtaaaacagataatgccttttaatatgatttggctttgtgtcctcactcaaatctcatctcgaattgtaatccccatttgtcggaggaggggcctggtgggagatgattgaatcatgggggcagctttctcccttgctgttctcatgatagtgagtgagaactgatggttttaaaatgtggacttcctttctcactttctctttctcctgccaccatgtaagacgtgtcttgcttcccctttgccttctgccatgattgtaagtttcccgaggcctcctagtcatgcttcctgttaagcctgtagaactgtgagtcagttaaacttcttttcttcataaattacccaggctcaggtagttccttatagcgatgtgaaactagattaatacaccttccttcctttgttttcttttcttttttctgaagcaggttcttaccctgtcacccaggctggagtgcagtgacatgatcaaagccccctgcaaccttcacctcctggggtcaagcagtcttcccacctcagcctccaagtagctgggattacaagactgcgacaccatgcccagctaatttttaaattttagagatgaggttctactatgttgcccaggttggtctcaacctcctgggctcaaatgagcctcctgccttggcctcccaaagtgctgggattacagacattattgttcaggcacagtgagccaccatgcccagccaataatgcctttcttatcagattgttaggaagaacaaatggaataaggaatagaaaactgctcactgtattccttgccctatagtggataacttgataagtgttggctgtgctgaagttcaagtgaagtaaggcagtgttgagaatatttttcttatcctgaggtttcttcaaggtggagaattttctctcttcagtttacaaggcactgagccttgtctttgttatatccattttgggattgttcataagttttttctctttctttattttgtttttatttttttgagacagggtctcactctgtcacccaggcaggagtgcaaatagcacgatctcaactcactgcagcctctacttcccaagctcaagcgatcctcctgccttaccctccctcatagctgggactgcaggtgcacgccactgtgcctagctaagttttttttgtttgttttgttttgttttttttttaagatggagtcttgccctgttgcccaggctggagtgcagtggtgtgatctccgctcactgcaacctccacctcccgggttcaagcaattctctgcctcagcctcctgagtagctgggattataggcacccaccaccatggttggctaatttttgtatttttagtagagacggggtttcaccatcttggccaggcatgtctcaaactcctgaggtcaagcaatgctcccacctcagcctcctaaagtgctgggattacaggcgtgagccactgcacccagcctctttttcttgttttcccagtgtttgtttaaaagctagttcatgtaaggcagtggttgtcaatgaagggctatttcatgccctcctcctgggacatttggtaatgtctggagacatttttagttgacacaatagtggggggaactgttactggtctctagtgtgtagaggccagggtgttgccaaacatgctacagtgtacaaaacagctcctcacaacaaagaactttcctgcccaaaatgtcaatagtgccgaggtagggaaaccctgatatagggaatatattgaatgtgaattgaagttaatgaacctggtgaagtatgcatctatggactcatcaagctaatggtacttagtggtcggccctataaattgaactataccctacaggaatttctaccaggctgcaggaggttctttgcttttcaggaagatggcgtggaaagcatctaagttataaaagggctgtttggctagggctatcacctggaggcagccgaggtcctagaagtttgggtctcagttttcatggaatacaaggtagacttcctttgttccttcaagcatctattcattcagcaaacactgttaagtgaccagaaggccaagtactgtgctgtgtcagataaaaaaggaaaagaaacaaaagctaagatatttcctcttaaaggagcttagaagacagtatattattgtggttaagaactcagatgtggatctctgctgcgtgggctcaaagcctggctttgccacttctagtttatgtgatttagcctcttgctttaggatggagttgagaatatctaggtcatatgattgtgtgatgattaaaatgttgatgaacacagtgtttaggagagtgtctagctcaatgaaatttgcattcttgtttttgttatttgtactgtactactcctactgctaaggaatcttggagccttatggattttctagtttagtagtttcaagtttgattagtactggattccttttctcaatatagccttagccagactctgagtatataaaatacagatatgcatagcttaatatagccatacgttctgagaaacgcatctttgggcaattttgttgtgcaaacatcatagagtgtgcttacacaaacctgcatggtatagcctgctatgcacttaggctgtaggctatagcctattgctcccaggctacaagcctgtatagcatgttactgtactgaatactgtaggcaattataacacaatggtaagtatatatcaaaacatatctaaatatagaaaaggtaatgcactgcactaagatgttatgatggctgcaacatcactaggtgataggagtttttcagctgttattatcctatgggatgactgtcatatattcaatgtcattcacctaaacatcattatgtgcacatgactgtatatgagaacagcagctcttgttaaagtaagggtgggagtctggacactgctttctgggaccactcccctctctccccacaacagtgttgtctgggagagaacctgggactgtgtagaaccctgtttgccacccagcaatctcatccagtccactcactttgagtgaggaaactgaggcctagagagaggaagtgatttaaaaggaggctaaagcaagacaggagtagctctaatgtacatgtgccaaacacagacagggtgctctatgagggagttcagagaaggtagagatgggccccttcttggttaggttgaggtcttgaaggatgggtaggatttgaacattccagataaagttggaaagagtattttcacaggaagaaatagaatgataaagggatggaggaaaaagcattgtagtctttacccgtttcttagtcagtctatttaaaacatattacttaaaaaccaaaggaaggtagttgtcataaagtcacagagtaattcctggggcccaggggcagtggagccagcccatatgcacctggtaccccagaagtgagcacctcctggaagccccctctccagtgccccatagttcttgtttcccttcctgtgcatttgctctgcccttcactctctctgaagaccagctttattgtcttctctgtgtacatggcttcctcagaggtcctgaatttctatgccactgcttaaagcaaccagttctcaacgatcatctgtctctgaatcccaaattctaaattccaggaggaaagaatccaattacacatataggtattatttgtgtgcgtctcatccaaaattttagacagactagggcatgtgaggaacctgtcttatgttgagatggatggcaaagccctactcaaagatgaaaaaggaggaaaactggccctcaagttgctcttttaccagcagtagaaagaagggtctatataactataacaaagtatgagatagacagtacaggtaaaaagtaagagggttgatgaaggcttcttgaatggggacattagtgctggctttgcagtgtaggcaagatttcttggtggagagggagatgggggaggacattccaaactagaagcttggaagaactttgcatgtttgagtaacagtgagcagttgagtacctgcatatgccagtacttcattcattcgtttagacaggaaatatttactgaggacctagtaaggaggaggatataattatggataaagaaacaaacttaaaatagttacacggcttccccaaggtcatagagaatatgaatatgaaccatatctatcatgtttcaaactcttgttttctccatttatactttttctacttgattctacaaggtcaaaagtgacttagagcaaggttggtggctcatgctttttttctgttttaaatagagaacttttgaaattgtgcattgtccttacatcctaaagtgagaataggccataatttccataactataaaatgatttatgtgtgggtgtatgtttgttttaggggaattgtttggtcaggtgatttctaccatccattctaactcaacatttcatgtctgggtaatattggcaaccagtttgatttaatttattacataattatttataatagaaaaacacttgaaactgcctaaaatgtcccaaaatagaggattggtttagaaaattatgatatgcccatatagtattaccaaatagaatattaagatatgcctatgtagtattaccaaatagaaaactaagatatgcctatatagtattaccaactcaaaaaagttgcttttttttaatggtagagatggtgtctcaccatgttgcccagtctggttgtgaactcctgggcacaagcaattctcccacctcagcctctcaaagtgttgggattagaggcgtgagccaccatgcccagctcaataaatttttaatatgatgggaagatattcaaaatataaaattagtagtataaacaagaaacagtctttatacattgaattaaactacataaacacatacacacatatatttgtatttacataggaaaattattgtaaagatgtgtattagtctaaaaatgaaggaactatcaaaatattacaaaacaatatttgggtagtagatatcagtaattaacaaattttaaatgtgttttgctaaaatctcaatgatgaatttatatttcataactacagttttatgtaactatgttctttatctgcatctacttttgtaactgaaatttttattgaaataattatagattcacatgcagttgtgagaaacagtacagagagatagctgtaaactttgcccatttctcccagtggtatattttgcaaaactctagtgtaatatcacagccaggatgttgacattgattcgttccacctcagattcccctagtttcttgtactcatttgcatgtgtactcatgtgtgtatgttaagttccacactattttctcaactatgtgggttcctgaatcacagtcaaggtaccaaacagttccaacaccataaggaacccccatgttgccatccacacctgccactattcttttaaaaaagtacttgaccccaatgggtcgggcatttattttattttgcttttgcatctgaggccataatggtggaaccttagagttgggaaggacttagcagtcttcttggttcctcaatatagaagttttagaggaggagtgggaggcattttataattctccaccctcctccaaacacatcatcagcttgagctgtcttcccaacctttgccccgtaacacctttgccttggtaatgcaggtctcaagttagatatcatgtccactggaaactcttgtctgaccttctaagtctgggtcaggtgcttctttgtgccctgattatgttctgtattttcctctttgtggcacttttctcattttataattgctcatagataataaataaatagtgaatgggtagatggaggtctggatgagagtcctttcccagtgtctgatgatcctgcaatggccgcttctccttcctttcccaccttgtgagtggcttttgatcctgcctgcacttcggccacagcacttatgtggcaagcccttgtttatgttgattgtgcccaattccagccttctacctgctgatggttccaccaggatgactaacttcatcttctgagcttgtcacatttttcttttccttcatttataaagtcagtaagatgattactttaagtagctatgagcctatattgtgctatgtgcttgatatatattataatagcttcagctctgttcaaaagaggaaatggctacagctgacccagagagcatctggggataaaatggggatagtaaaacataacttgaagtatattttattaaaatatgtataggaatatttttaatattttattcaatataataaatataaatattgtatttatacagtattcccactcatgatcctgaacaacttattattcctgaataagttgttcaggatcgtgtagccagattagtggcagaaatagattcaaatccaaaactgtctgttacaaagttcaccttttttgctctgtctgcaagaaggaactgcatctctagggatctgttttaatttcctgattcttccaagacttagaacatcctctagggacctgtatccaagtctagttcttgactgaaccctctagttaggtagctctggactttggaaggcagccattctattgctggacaagaaacattgctgggatgtttattgatgttcagtggaaatctgcccttcactctctcagttctgtatctaggtggcttgtagttctttcccttggtgcaacatacattcttttgaatttataggtccctcatgctgtacctaaaagggatttttctgggtttacctctttattttacagatgaagaaacttgagtccaaagagagaagccctgtttaacttactgcccttgagttacttgaaacctaatcttgcctttctggcttacctttctctttctagctctttcagtctttcctcatgagatgggttttctttactttttattaccctagtcattctccttatggacactctccagctggcctgtgtgcctcctatttttgaagctgacctcaatattccaaattcgggttgattgcatggagttcaacagaggatgtttaattctgcaaacaatgatgagatgccactatgtaccaggaacatgttgcaatcctctaccatattctgcctttctttttctttgtgcacattgtctacaatatttatgaggctagaggtttggttgcatatgtcacaaaggccatcataacagtggcttaagcagatgaaagtctatttcttttttttttgttttgttttgttttttgagacggagtctttctctgttgcccaggctggagtacagtggcccaatttcggctcaccgcaagctccgcctcctgggttcaagccattctcctgcctcagcctcccaagtagctgggactacaggcgccgccaccatgcccagctaattttgtgtatttttagtagagatagggtttcaccgtgttagccaggatggtctcaatctcctgacctcgtgatccgccagtctcggcctcccaaagtgttgggattacaggcgtgtgccaccgcgcccagccttgaaggcttatttcttgctcatataaaagtcggatctggaatggatgttgtataaagtagctagggtgccaagctgcttctatcatgctgcttttttaatctttagggtattactctcttcttcgtcatctaagatggccaactaaacattagttttccagccaatgtgaaggcgagggaagggcttactttttctctctgagaaacagcgtgtaagttgcagtcttaattccactctcatcccattggccagaacttaatcacatggtcgtacctggctgaaggaaagcctgggaaatgtagtcttttattctggtagtccatgcgacgagctaaaaatattcctaagaagaacaaggaggggagaatggattttggttggcaaatagcagtctctaccatacccctccttcttcagctccagggaaacaagtcctggttggttctttgtagccattggcttcccaggtttatgaagttccatttctaggaaaagtggcaaagcaggatctcccagaaattctcaggattctgtgaaagactgaaaatcagaatctttggtgtggaggtcacaatgataaaaatacctgccatttatttggggcttactatttgtttgctaggcatatgttaacatgcattctcttatttaattttcagatgaatcctagggggcaggtatgataactaattctaaatttacaaaccaagttttccaaagaggtgaaacaacttcccaaggttgtacagcgattacagggtgaagctgccacctgtttatcttagtgcactggagcctgaggtcattgcccactcagtttgatgccagacagaccagagttgctcattaacacttcataaagccctctcatgttcctcataataaccagacatttctaattataacttgagcagcaaatgttgtttaagataggttatgagccccaagttgaagggatggcttttataccatgtttgctgagtatgagctcaggtcagacaaaatattgggtgaccaaattggcaaagaccattgtccctgtattccattttgctgtcagcagtgctcttggtttattttcttttccatgaggaaactgaggcacagagctatcacaggacttattccatgtggtaatgttgggatttgctccacattgttatgataccaagctggaaatcttcattctcctgctgccacatgttccttactctgggggggcctggacttctatttcctcatgtcctggagtctctcagcatgtcctgggacctgggacctggttccaggcctgagtttgccagctttgctgtgtctggttagagatcacaggcttttctggactcttttttgcttatagctttgctttttaaattttttttctcctataaatatggcagatggattacgaatacaaatgttaacgtggggcactcaatgaagaaaggatgtctctatggttaactctcttttccagctccaaatcaggatatgtagactacaggaaggggcaatggaaaccttgatatttaagaataacaaacgtttggtgaattgggtggtggggcacctttctggaggatgaaaaggaatcaattatgcaaagagccaggtagaggtttcttagcaggatgatagcaaaagcaaatgccttaagtgcagaaatgaaaaagaggcaagaaataaactaatatcatgtttgagtcttacatattttggaatttatttattacggaaggagagacagaagctcattatcagcaatgactcccctcccctgaatcaacggcaatttttggacaggcctcaataatgctaggagtaagtgctgtcacgcttgtcaaatatactttgcttaggtatgtttggaaaaatgatcagtgtccttggtgaagtgttattctcttttgcttcattaaactcaccttaggaagtggttaaattgacagtgttttttttgttttgttttgtttccagaattctcttgacatctcccagaggctttgaacataagataccagtgctgtttttgatattagcagtggtttataaaaatatttaagtgactctttcctcttaacgtacattcaaatacttagagggttagaaattagaagattatatcagaatttcaaacctgggatttatagaaaattggagggtgctcaaagatgttctgttggcagaggagttgagttgctctgagaacaatggtggattcttttatttacagtggttacagactcacagatgtgcttccactggccacaatccatccatcactagcagatttgtacattgttccagtttgggcatttgggttctcaatctaatgttaattcacctgctcatattaagaattttaacataccaagaaatgtttttttaaaagcaaacaaaaacaacactatcccccaaattaatagtgggaattgaatagtacattttggccttattactcatctgggctcagcagagatctttggatatgcttccaataacaataaaaataacagcttggtgaaataaatggactcgtaggtggagaaccgaagtactgagaggagttttatcttctgattgcattgctctttggcattgaccatggataaaaaccatcactgctttatttttagtttataaagtacttctatggataacattttacttcagctttacaactgccttgtaaactgggtataattgtcttcatttcacagctgaggagactgaggcttaaaggggttaagtgagttgcccaaggtcacagcatagcaagcaggtgacagcatcgggattccaacccgtatgttattatataaattgtcttaaatcctgaaaacatgatagctttaaaaccttaaaaagcatcagtgccatctttagaacaatgacttaggatttttttttcctccatggatattgctttaaatgtttgaggaaataactgcaaattttgtttcatcctaaccctaataatgctctctacaatgtccctcagctcagaattccttgtgactatttgaagcttcagtctttaatattgccttgtgtttgattatatcatgtcaaaggcagagcctggaaaatcattattaaggatttgtaggttgtttgcatgaccttttaaagtaaaaaggatagatatgaatagaaataaataaaattattttgcaaagtaaccataaggcttcagccatgtctgtatctaatttattcactataaaaagttctactgaagatacattttgacttagatcacataattgagaaaaagatggcaaatttatcgttaggttaatgtaactatcccttctttggagaggatgataacaaaactgtcaaaagaaaaagatgcccagatgagattatacttgcaaaattttgtaggcagatacacaaactgcaagtataacatgtaaccatgtttgacaggagaagtaggagaacatgggttacaaaatccttaagcttgacagcctctggcaaggtggtgaataatgtgaggtcttttaaaatggctttcttgagataaagcacagaatgtaatgcatgcaactttcagaattgttgctggagacagcaaaaatactcttgagacagtgcaggctactgaggaaaatacatgcggtgatccagaagaaagtgagagcacgggctgttgggagaactgcaaagagtttccctgggactggggcaaagatgggtgaaggaggaatgcaggaggtgagaatgggaaggaaagcagttcccaggttattcaaggctttgtaaaccatgtaaccctgtgcctctaaaaatttctatgaacgggagtgataagataaaatttgtattttaacaacatgcctcatccctctggagaggattggaggggtccaaagctgttaggaggctagagatggaaatggcctgaactgagtaagatactaagtaaggagtagtgggtgtgtagaaaggtgggttggatttgggttttgcctataggaacagtgggaggaaacaaggtgactctcagatttctttgtatctacccattcttactccataacctcccatgctgtaaaatgatggtggtggtaacaatgactataaaatttgaaggcctgttatattataggtgtgaaacttctcatcacctacaagataaaattcaagtcttaaaggggcatgcaagcattccataatgtgcttgttgcctatcctaccaccctttggtaaacaccctgtgcagtattgctgaccaatttatagttcagaatctaaggtcagaattaacaatatgtattgagccagatactctggtacaaataacagtgatcaaatcaactatgtctgtctttttttttttttttctttaaacagagtctcactctgtcgccaggctggagtgcagtggcacgatcttggctcactgcaacctccacctcgcgggttcaagatattctcctgcctcagccttccgagtagctgggactacaggcgcacaccacccacgcccagctaatttttttttttttgtatttttagtaagacggggtttcaccacgttagccatgatggtcttgatctcctgactttgtgatccgcctgccttgacctcccaaagtgctgcgattacaggcatgagccaccaggcccagcctatgtctgtccttttatggagcttcttttgtagtagatagagacagaaaaaataaaaaccctcaagataaaaagagccgtgaagaaaaaagagtagactaaggagagttcatatagggtgatcaggaaagcatctctgaaaaagaaacatttaaggagaaacctataggaagtgaggagggaagccgcgtggctcactgggggaatagtggaattgtaagtgcaaaggccctgagggaagtacatgttgaatagacgagtagtgtggctgcagcaaagacgcagggagaaaggtaggagataaggcaagaggggtacagaggcctgttcctatagagccttgtaggccattgcgcgagctttgatttttattctaagtgagatgggaaatgattggaaaattttcagcagaagagtaacatttgccttatttcttaaaagaacacctttgtttctctttatgaaccacaccttagggaggcaagggtggaggcagagacagcagtgaagaagatattgcaataattcagatgagaagtgattggcttagaccaggttggtggcactataggcagtgagaaaaggttgattatacctctttgtatgtggtaatataaaaatattatatacatttgtattagtctgttctcatgctactaataaagacatatccaaggctgggtaatttattaaaggaaagaggtttaattgactcacagttcagcatggctagggaggctgcaggaaacttacaatcatggcagaaggggaagcaaacatatccttcttcatgcagcagcagcaaggagaagtgccaagcaaaaggaggaaaagtcccctatgaaactattatatcttgtgagaactcaccactatcacgagaacaggagcatgggggtaactgcccccatgattcagttacctcccactgggtccctcccacaacacatggggattatcggaaccacagttcaagatgagatttgggtggggacacagccaaaccatgtcaacattgtacatgatatatgtagtacctaaatatatatagttttctaaattcaaatatacaaaaaagtaaaaaggggaaacacaggtagaaaccagaaacccatgtccccattactcagcttcgacaattatccactaatgagcaatttcattttttctaaagctgttcttgcccctctggattattgtgaagtagatcccagccataatgtcattaaatatttgaatatgcctctaacatgtaagggcctagctgggcatgatagcatgaacttgtagtcctagttacaggggagactgaggcttggagtgagaacctgctcaatcagtcaatcagtcaataaagggctccttttaaaaaacactgtcacaacattctcatctcatccagaatcttaatagtccttactatcctcaaatatccagcctgttcagattttcctgattcttttaagtgggaatcttatttttgcctttttatagtttgtttgaaccaggatccaaataatgtttatgcattgaagttgcttggttttaaagtttcttctctatgtctcttttgttcctgtgtaatttttgttgttgttgttgttgttgggaaaaaaaaccaggccatttgtactgtagattttccccaagtctagattttgctgactgcatccctgtggtgtcacttaacctgttcctttgtcctctgtgttcccggtagattaaaggcttgatcagacttacattcagattagctttttgcaagactatctcgtaggtcgtgttttgtatttccatcggggatatacaatgtgtggttgtttctgttttttgtcatcactgtctagtgccattgttttattaggggctgcaaatgtaattcttactttttttttttgtttgctggactatttctatgaggaaaaactcttcctcatcagatatttggttatcctggagtaaagttcatatagcaaacaaaggaaaaaggcttgattcttaccctttatttaccagttttcaaaaataaaaagtaggtcccctatccttctctgagggtgacttatgaagcttctctctttctctttttctcttcattttattattatgaactcatatttttaaacacacattcatgtttcagtccactgcagttattacagttggccctctggggattccacatctgtggattcaaccaaccctgaatcaaaaatatttggaaaaacaccaagacaacaacaacaaaaaagtacagaataaaacaatgatttgtctagcatttacattgcaatgtaataggtattatacataatctagagatgatttaaagtatatgggaggatgtgtgtaggttatatgcaaatactacacgattttatataaggacttgagcatccttggattttggtatccttgaagggccctggatccaatctctcgagtatatagagggacatcagtattcttactaatgactaaatggaccatctttggtcatgggagcctctgaagctagctcctgaatgcttctaacacactcaagtagtctttgatgctttccttgctttctggtatcaccagatgttccaggctcatcttgtatgttttctgccccaatcttagaatcagccactttttcaaagggctctagttccttttagagggaaatggtgcataaagacctctggtgtgaggggtgctcactgctcctgagctggtttttgtgtctaggccttctcagtggacagagctaggagcaaattttttaaaaggtaaaatacattatggattcacaattatatttctttctcccatgccaaaattctggttctcagttgcaccagtgtaattacttatttgctttgtgccacaatacacagccacagaatcacaataccaacactatcaccaaaacaggttaaggtagttttgttttttgtttttcttttggtggtggtgggggtactggttgtatatattttgctttaagacagttactttgtatcttaaagttacttgaggtagtttctctctgtgtggttatatcatcaatttcatactaagctgggttggtttggctcattttgctatcacttttgaggggttgctttaaaatttatgtttgtaattatatagaatatttacatagtttcaaattcaaatctttaaagcaggttgtattcaaagaaacagcttctgtccctgccccctctaccctgttccctccctcacaggtaactctctttcaagttttgggtttatcttttcactttgtaaatatgtgtgtgtatctatccactctctcttggataagtgggagctctatacatatcttaaatttcggataaaatttggaggtagtacagacactattttctgaaagattggatgtgaggtatgagaatagagttgaagctaatgcccaggtatgacatgattgactgatagaattgaaccacctggccccgagtgcccttctttccatgtggcctggttagcctcattcatctttgcaaactccagctttctttgctctcaggtgctctcctctgtgctccattgatgccctctgcgtcacattatccttcccatatggtcttatatactgttttcatttgtgtttggctgtcagtagactgtgagcagcttgatgtcagacattatgctttcttattctgttttcccaccacctatcacagaacctttcacacagtagaagctcaatagatacctgagtaaataaataggccaggtgtaatgttgggttcttaagaaaaaaaaaatgaggtggatgttgttgtcctatttcacagatgaaggaacaggcactgaaaggtttaagctgcttatctaaagaaacagctaataaattgctggagtacgaacccgaatcttgtctgatgccaaggccacacagctccaactctgtgttctcattcagcagtggcatgtgagactgtccacaattagcctattaattgtgtgacctctgcaagaaagtgagcctctatgtctatttctacatctacgaatgcaagatagtaatggcgtgtacattatagggctgtaaagcatttagaataatgcctcatacatagtagggactcaaatcttagctgattttaggtacaattgttatttttagtagcggaatattagaatactactactaccactacatacaaagccctgtgcttggcactgtgtatggagtcttctttgactcaccccatcttgccttctaggagtttgcaggcaatgtgcatatgcttaaagatttcaagaagggcaactggggagtggtcagtcaacaggcagtcacttgagattagtgccaaatgcagggaaagaggaaagaaggcacttgcaggtggccaacttgttagataatagtccctcacccctgggcttctggggcaaaaataaaaaacagaagccatggtggagatttgaatgtttctgttccaccaatgtcaccattagtggcagccaaatacttcgactccttgtccagtttggtgatactcctaacagtccttgccttgtagcattaataagttgcacaaatcacaatttaatactcacattatatagactctatgagtcatggggtcacccagagttcatgggaccttggagagcagcaaattccacctccacattttatagaaagagactttgtccagagaaggaaagccatatgtttaagggcacactggtatttggaacttgaactctgttggttaaccttatgggtcagatcatgcagattcccaaatgcctggacccttgcctgggagggagtggactctcaatatgcaagagtgctgagagacgagggatgatggctccactgttgtgctggccacattgtatttggtgagtccaggctcctgctcttatcagaacagcaatggtagctgctggaggaagagctggcctccctcaggatgtagccatttctgctgcctgattcatattgggcaaggtcttctttgggcccttccatagctatagccatctatgtgctattggcgattgcactgagacctctactctgtcaaaaagaggtaaggaagaatgtgatagtgaaagggcatgagatttagagccacacagatctggtttgtgttctgaccccagtgtttcttagaggtgtgacttttatccagtcatttaacttcactggaaacctcaatttcctcctcaataaaatgggcatgataatatccaccacagcaggttgttgtaatgattaagtgtgataatctatatgaagcatttggcagaaaaaaagtgtccaaagaatggtagcttctctgcctctctccccgactctgcctgaccttcatttagggctgtctgtcctctgtcacacagtgtggcatagggctgtggctgtgttattacactttctatttatcagaagctactgaggggtgttgaaagatgtagactttaggctccactctcagagattctgatttgaaagaaatctgaaaatttgcattttttaaaacaggcaccccaggctattctgatgcgtagcctggtacctaggctgacatttaaccttgggaacctcttgcaccactgtttgccagaccccttagcttgggcgggttatgcaacctctctgagcctcatttctgcacctactaactgggactgatagcctgtttagcaaggtccttttcagggtgaaatgaaacagtgtgtgtgaagcatcttgcatgaacctagcacacagcgggagcctggtgaagatgtgaagaccgataccagacaccaaagggctgcattgccttcttccaatctataagctagccgtggccctagttccttctttggaaaccaaacccttgcaatgtatctgtccacctattcttaccattctgtggattttgcagaggacacattgttcatgatggaaagccacctgcttgcctgtcacctgcattttttggagaccctttttatggttattagtgcctgtctttgaaatttcagcacctgtgagctctgattgtgttacctgggatctaaaaaggcagcagaggagaacagatgctgctaatgacttatcagctcttttgtccatagtcttctcaaagaaaaaaggctgtgaccctgggtttgtcagcactgatatgctttcacaccacaaagggacttgacaatgggcaggtttccaagtctgtagagtggttctttgggggaagatggaaagcatatttacagtttggttcttcgggctcatgctctttctccaccttctgtgctctgctgccactacccctggaatgctggtgcatgtggcttttgaacatgagagtcaaagacagcagctattgaccctaaaggctgtgtgtgcctgtggggtgggtgggactgggcagcaagaagaggctgaattaggaaagagcatcttgagccactgtcatcatccctttgtgggaccaagtccgtatgagggaccgcgatcatagctggattgtagttttccactcctgcctgttcaagccttagaaactagttttcattaatttcattgctatgcaatgaatgcatagcagttttccactcctgggtatctgttcttgcaaatatccttagattaatgcagagcagacatcaggccaaggtctgccttttttgttctccagcagtgcttttgggtttgactgtttccttttatgttttaagcttttaacaaatataataggaggcagcaaaatgttgtcagtggaacacaggctttggagtgagacagacctagggaagagcctggctgtatgacctaaatttttgtgttgggtcctgctgtgggctgaatatttgtgtcccctcctttcccagattcgtatgctgaaacctaatccttaatgtggtaatatttggaggtagggcctttgggaggtgattaggttgtgatggcagagccatcgtgaacgagattagtgcctttataaaagagggccccagagaacttgcttgtctctttcaccatgggaggatacagggagaagatggccttctacgaataaagaagtgggccctcactaggtaccaaatctgcaggcaccttgatcttggactttctcgtctccagaactgtgaggaatacatttctgttcttaataagccactcaatttatagtaccttgttacagcagcccaaatggtctaagacaagttctcactttgctcctctgtaaaaaggggataatcaaacttacctggcaacataattgtgaagattaagtaagataatggacataaagcttgtagtctagttcccagggatcaaagggtgcttaataagtgatggctattgctgttatcatcttgctgcacttcaatgcaattgaaattggtttaaaagtgaatagaaacggttggtttcttgatggattcaattcagttcaattaagtgtccttttttagatggcttaccctggtaagtgtcatgctgaatacttgatacagatagaaattaagcactctcttctcgctaagctcttcttgtgcattctcaattttgcgttgcagctttcaacaaaagcatcccctcacccttcccagtgattctaaatttctttatctactcatttgaaggttagtttgactttcaagccttttgagatctgagcatcattcacctttgcggtctcacctctcacccctctctaatataccacccagttctgtgaggaaacaccataatatcttggctctagtatgtaccattgccactgcctgatacacattcctctccatttcagagtcttcctccttcctcctgtgtagtggagacgcaatactcatctgtcagtgttggatgaggatttatgcatataatttttttgtccgaagagcagatggaaccacacagaccagactgcaggaaagagaagagataaacagtagactaccttacctgtggtttcactttccaaggtttcagttatctgctgccaactgcagtctgaaagtgttatgaaaattccagaaataatccattacgttttaaattgtgtgccattctgagtagtgtgatgaaatcttgcaccgtcttgcttggtcctgcctgggatatgcatcatccctttgtccagtgttatgttactgcatattagtcacttagtagttgtgtaagtgatgagattgactatcttggttattgcagtgcttgtgttcaagtgacccttattttacttcataatggccccaaatcacaagagtagtgatgccagcaacttggatatgccagagaaaagctgcagggtgctccctttaagtgaaaaggcaaaagttcctgacttaataaaaaaaaaggaaaaaaaaatattccgaggttgtatagatctatggtaagagtgaatcttttatctgtgaaattgtgaagaaggaaaaagggaattcacgctagttgtgccattacatctcagacggcaaatgttatggccacagtgtgtaagtgctgtattaagatggaaaaggcttcagtttgtgagtggaagacatgaacagaaacgtgttccaattgatggcagttgggtttggtattatctgtggtttcagacatcgactgcaggtcttggactgtatcctctatggaaaagaggggactactgtactagcacctgcattggccagatgctaagtagaaacagaagctgccttgaacttagggaggccctgggtgtacagtgatttttctatgccatttgtggtgccatttctgcagcccaccagggtgcagcctgcagaaggaaagtcacacagctctttcctccctccaggggtccttacaataatgaatgatggcaaagagtcaaagataggatgatgataatgcctactttttattgagcacttcttgtagatacatgcacatgtgtgtatttcattcttaacaagtattattgcaaaactgaggttcagagaggttgcatcacacccttgagcatgaagaagacagggagggtggctgtaataatagggacagtcctccaaagcatgacatccgactcttttgatggttgggcagctagtgtgccagggaaataattatctgtctccttagcaacccccaatatttggcttagttgtcattgatgcatttcagttatcttcatgtcgttaaagaaataggtctcaggaaatttaatccagctagcagtgctatgcctagaattcaattaactccatgatttgcaattaatgagccctcatgccaagattgaggtcatagcattaatcttacttttattttaggatttccactgtcatgatttacagcgaaatccagccaatcttgtcaggattattggagcataattaagccagaaaggcaggcagaacagctagttaacatgggatccagggagggaccacatacctttgcttggtaagcctacctcaagcaggatggggctacatatgaggatttccatctaaggactgtttcccagatgcctgatctgtatacatttcaaatccccatccaatctccaaagaaaatatttccgagtcccagttggtgagcccttgtgagttatgttgttgttaattcaatgctaccacatccacctccacctcaagttgccatttactaagttgtaaatgtaacagacagtgagtgggcttttacagatgatggatttaatatctgtgatgattctatgaggaaggtatcataggccttctctctgtataaggttatacagcaagtaagtggcctttccactgaactgatggaaggttgtggcagttcctagctgcagaccatttttgtgcttctctccctttcgtgtgtgtgtgtgtgtgtgtgtgtgtgtgtgtgtgtgtattttgcccattaggatctcctccactttcccatatagaaataagaaggtaggcatgcataggcaaatattgtttatgattgccttctaggtgacaaatactcatccatcattatctcatttaatcatcgtatacatgggaggaggatattatctacctccattttacagttgagaaaactgaggcttagagagatttactagtttgcctgctgttacacagatagcaaggaaggagagtcagtgttgtgaatccaggtatgcttgtttgcaaatcctaggttcttttaatcacaacacgctagtactaaataaatgctttttctcttttcctggttctccaggagtggttattattgagtcgagaatttttgggaaaagtaacacgtggagagtcaatttttgagtggaaggagtctgaagagagggtaggaaccaacctcctactacccaccaggtaagggtgtacttttggcctttgggatttagcccatgtcttctgtatgtagagtgcagatccaggttggctaccatgtctggccaaccaagcacagaagccaacccctcccattgactttacttttgctcagtgtttggtttttccacaagggagggtagtggccagatgtttatgagaaggtctccataagccaagtccacaccagaagctgaccccacagctagcggtagctttctttgccctagagaccagtgaaacagaggagtagcaggttctctttgtacttaggtagcagattttcctccaaatgcttgctgtgggttttttgggttttctcctaggattcaccttcagactgtatctgcctccctgtgtagttagcatttagaagtgtcctcactgggtttgcttagcctcattgaacatttttatgcctggcatggcttactagagactacctattggaagtgcctactaatacaattttctgataatttagatgctgaaggacttccttgaaattttcttcggctggcttgggatggaatacttgcttttgaaatatgccctaaagagtgtgctatccctggggaaatccacttgtctcaggcaatattaatctgctctgcgaacagcttgttggaaatttgctgataatccattttttttttgtcattccatatctcagtgtgagagagtaagagaatttggtaaaagttcttactttttagcttgaccttctgaggtctgaggagcactcaccttcccagtctcatcttccatccctctctaacacaccctcaagttccctgaggaaacaacattatatcctggttccagtatgtattatagttggtgccttaggaaaattactttctttttcagagacccctgccccacccttcctcatctgcttaggggagactgtaatactcatctttcagtgctgggtaagcctagcatgttccctagtatgcttataatcagagctcagttatgatcctttcacttttatgtctgtccttgacatgatgttctcttaacctttgcttgctctccaacattattttgtactaaataatggactaaaatgcccttcagcccatttccatccaaactgcaattcaggcatcacctctgccataagccatcctctttccaacaaccttcaacaccacccccgctccaccacccctgcctgccacacacacacagacatacacaggctggaaataagctcctcagaatgcttatctactttatatgcaactttataatacttcttggtgtgtctaaacagtagaaaatcaactaataattataatgcagcactgtgagagatatgagagaaaaaatactaatgactcagaagactacatttcattgctaagtggaaatatggcaggtccaaatctatacacagtatcatctttatttctatgtatgtggacacacaacacaaaatgtgtatatgtacgtatacacaaaaacagaactaagaatgtaaggatatatagtctccaaaatgttaacagtggtacccttgtttattttcttctctatcttaatttcatcttctttggtttcagtagacctcaggggtagagaagtgagttaatcatactgctttgcagtctttatacggcacaaggccccgtctggttttattgtagattttcttttttttttttacttcatcagcctcaattccatcctcctcacccagccatttggtttctttctgatgctctttatgtatgtccttaagtgtgcccaaattttccacattctttatgtcttctatattatagatatatatgatattattgtgtaatgcaacgtattttaatgtataaaatataacaaaatataggtaatgtttatatttatatctgaatgaaaccttttttcataaattagaaactggaattcatgtctctgctttttacctcttttccccgttgtctcccctcccctcaacactgcaatcacacacacatgcatgtgcacacacacacacgtgcacacatacacacacacacaaaaatgaagattttcttgaccagtcgtacttccagttccaaaatctcaggattccttgttgcatatattggttgactccctcccttgagctctctgatatatggttttgtaagaagtttttaacatgatttttctcaagtaattgagctcctagtttttagcatagtacagcagagtttgaacagagaatgaccaatggcaatgcagacagccttattggactaaggatggcattttctggtgattcgtatgtttggcttatcttccccagtctaggctctattcaagcatatggcaaaagggacacaccatttgcagttagagcaatatttgtttccttgccctgccagctactagcaagctaagtgacttgagccttaatttcatcattatgccttaaagcacttcaatgaatcttaattgacacccagaaatacgcattttttaaccttttgaaatttgtcgataattattttatgccccagcatatgtaaacacttgataagagggtatattcttcagttgttggttgcagtattctataaatgtcaattagggcaatgtagtattgttgttcaaatgttttcttcccataccaatgttttgtctacttgttcttaaaaagtctgcatttgtgattgtgggtttgtccctttatgtctacttttctgttcatttttgcttcatatacttagaagctgtgcatacatttagaatgatatggaataattgaccctttattattatgaaacattattccttaactctgtaatattgtcttgaaattaatttgtatcatgttaatataggcctacctgctttcttttgcttactgtatgattaatattttctcatcctttgctattaacctatctgtaactttgtaattaaagtacatctcttgtagacagcatataatttgtgttttttttatgcagtctgataatctctgtcttttagtgatagtatctggcctatttagatttattataattattaatataattgggattaagtctactctcgttatttgtttctaactattgcttctgtttttagtttctctattcttttcagctttgttaggattaagcatatattttaatatgaaattttaattcttctggctttttggctatatatatgtggtacgtatatttgtgtgtgtgcatgtgtgtatatatataaatatatataaatatatatgtaaatatataaatatatatgtaaatatatataagtatatgtgaatacatataaatatatgtaaatgcatatataaaaatatatatgtaaatacatatataaaaatatatatgtaaatatatatataaataaatatgtaaatatatatatataaatatatatgtaaatatatatatttggtatgtggtttctccagagattgcaatatttattcttcacttatcactgtatacataaaataaaataagagaatgttatagcagtaaaatttcacttaccttccacccatcttttgtgctattttgtcatatatttttcatctgtgtaataacaccacaatacaatgttgttatttttgcttgcaacagtgatctttcagatgcattaagagaagaaaaccataatcttttatattcacccagacatttaccatttctggtacacttcatcctttcctacagatctgagttttcatctggtaacattgcccttaaggctgaagaactccttttagcatttcttataatgcaggtcaattagcaacacattttcttgtgtttttaatataaaattttgttttgaaaggattttttgctgtctataaagttcttggttgatcatttttttctatcagcactctaaaaaaattcatttcattattttttgacctccattgtttctgatgaatgttagccattattgacatttttgttccgctatatgtaatgtatctttttctctatcagctactaagattttctttttctttttctcattggcagtcttattctgatgtgtctaaggtgattctttgtatatttatcctgttttgggtttgctgagttacttggatctgcagcaatagtttttaaccagggacaatgttggttctctaggaaacgtttggcaatgtttggaggtatttttggttgtctttgcttagagttcagataggagaggatattacttgaaattagttaatagaggctagggatgctgccaaaagttctacaatgtccacgacaggcccccacaacaaagaattatccaatttacaattcaatagtgctaagtgccgaggttgagacatttgcattttgagttgaatttttttccaccaaatattggaaataaaatagtttttctgctccattttcttcctgcgtcccttcttagactctgcttacatgatggtaaactgcttgcatgatgttgtctcacaggtcactgagactctgtttttaatttctgtcgacctgccttcaagttcataacattttcttttgcagtttcgaatctcctgttaagatcatttagcaaaattttcatttcagatattatactttttaattctgctattttcttcttctttttaaaaatattctttgctggtagctcattagactacctctttgtttaagcctttgaacatattaataagcttaaagttcttgtctactaattctaatatctgaagcatttcaggttctatttctatttactgctcttttattgttcaatttttactgctcctttatatctgtagttttattgtatgataaacattgtgatgatactttgttggaagtctggattaccattttctttgaaaacatgttaaattttattctggaagacagttaaattaccgacatatccttctggtcattaggcttgattttattctttgttaaaatgggtctattgtggttttcaacttagtcctaggaatgcagcctttattccaaggtgtagtccttattcctagtgtgatgtggcctttctgatacagaaacactgaatatccagctaaatgcctgagatgctcagcaagagctttccattttggctatgctagagctccaacatatgccagcatttataacctctggtatatagtgctggtttagttctcaaccctgcatcaggcagtctctgctgggccttgtgaagtcttactctctatatttacagcccagacctcagctaaggactcagggtgaatttccatgcagtcttttccctcctatccctccagcacccctaatccctatgtccacactgtgcctctccctattttcttttatattgtcccacatattcctgcttcttagtagtttttgtattttgatccctgccttcacagctcaggggaccactattctacttgggctctagatcattttatggtaataggaaagtgcttccaggcaaaagctggagcaattgtgaggctcatcttgtgtggtttctttctttcaaagatctcagtccttcttagactgttgtttaatgcctaaaaaacagatgttttatataacttatctagtttatcacaggagctcaagtccaataccattatcatggttggaagtggaaatcaggaatatgcattttaagtaaagaccccagataattctgaaactgatggttgtgggttcatattttagaactgctgatgtaaattatttaaagtagatataaagtattcaaagtagccccagctttctgaggaattgtcagaggatctctactctccaggaggtctaggtattttatattttgcaaaggataaaggacttttatctgaaatgtttcttggtgtgagatccctttgagtgtggtgtatgtgtatgcgtatatttgctacagtgctgagttgtactctgtgttttcaccatcttgtgtatagacaatgcacaatagaataccacaccatagcagaatcattgatcaaatatactgcaagaatgaatcatccatacatgtgtgtgtacacacacagttatatatattttttttttcttaagatggagtttcgctcttgttgcccaggctggagtgcagtggcgcgatctcggctcaatgcaacctctgccttcaggttcaagcaattctcctgcttcagcctcccaagtagctgggattacaggcgtccaccaccatgcccggctaattttttgtgtttttagtagagacggggtttcaccatgttggccaggctggtcttgaactcctgacttcaggtgatccacccgcctcagcttcccaaagtgctaggattacaggtgtgggccactgcacccggccttataaacattttcaatatgtagttttatatgtaaatttcatgtgtcaataaagctatttttttcaaaaagttaagtcatggcaatgatttggggaagtcattttattttcctggtgcatccatttgaggcatagggatacattgctaatattctattgagtattaaagtgttatgagtctgggttctttcctctcattgtccaaggggggcttccagctctctgactgttatgttcctgactgtgcctgatgaaatgaaaaaaacatgggtcttgtcttcacaccgacatttggatatatcctaactaagtaatctggtgaatgaactgacctctgactctcttttgatttaggctagaagtccaatgcactatccattgtgccacagagcctgcctgcttgcacgaattgacctctttgagacacagttcccttatctgaaaaataagagcaaaaatatatttcagttttaatgtgtgggatactgtatattcctagcatggtgcctaacatatagtaaggccactttggtatatgtgtagcacatgtgtgtgttgtatgtagcacatagcatatatacccttaccttgatcttgtaaacgacaaacaatattcatccacaaccactgctacttttctggagaacagtaatttgatctttctctcagaagttggcttgcaatggcagctccagaatttctgccttggagctaagagaagacaatcttggtagaaggggaggagcttgagaaaacgcttcttagagctgcatatgcataacaagcacactggttttctaaaattctacctgtatatggggggttgtttgggaagactgatagagttctctcagttgccctttggtgcctatattgtctcccctgtctctcttaaatggaactgaaatgtcgaacagaaaatttttgccttatttttttctctttgcagttttctttaagtagaccatcagtcctctgctatctctattctctatcatagacaaggtcagataacagcaaggacattttctctgttccagggtggtaattaagagggaaatgtcatagtccattttatgcaatttaagccctgatcttttgattagagaagggaggaaaaaaacaattgatggcccctcactttctggagttgaggttccatgtggtgcccagaaccctttctgtttcttcaggtttctattgaggattctgatctcattgaatagatttgattattattatttcataatgcagagcctttttatttggtccacatgttgaagagtaaagattccttatttagaccccttttccctggcacatcataagtacttactttgtctgttgaatcaaattaagcaatatccatgtaaagttttatatgagagtttattgagtagaatttggattggcacctgtagcctgatttctttgatccttgaaggaacaaaatatgttacatccatttgactggaattcccctagcaccaacagcctggttgtgaacactgtgccctatctttattatacgcagagttcattttggtttcaatgtagtcattactttgtatttctcattttttccactcttatcaatcttttttcatgttgtcgatccttttgggaaagaggagctagtattggtttcttaattagttcttctatctctttgaagataaacatttcccatcaaatattagccttctttacaataaagcgcatgttgtatttcaagaaatctccatcttttaggcaggctttctcagtgggtgcagtgttgcaatcagaaattctgaaaagcttgaggagacagtgaaacagtgaaagcatctagtcatatttgctacctacagttaagcaaagaccagatcactgccaaagttgatctgtttggtcttccttgccatctctgccatcttctctttgattattgcattccatagcagctcagtttcacatacttttattgagtgcttactgtgtgccatatattgcacttaggggactgtgaagaggcatgaaacatgcttcttgctgttgaagactcaatagcaagtaattgagttgaggggaggtagactcattcacaagtaattataatgcaagctgactgctctgagtcctaggatggaggaacagaatgaggtgggagaatggaggcatgagagacaaaaagtacctcttgaaagaggcaggatggggaagtgaataagagcagaggctttgggtccagccaaacctagcttcatttcattctgttgtgactgttactaaacttcaccaaaacctcagtttcctcagtgggactcccacctgccactgtgcttagtgcaagcatcccatttagttgtttatggaaactgcttagctgagtgtctagcctagagtacatgtttagtagatggcctttgtatgaggatgatgatagtgttaaagaattttaaaagtggaggggacttaggaaatcacttaattcattctcctatgtttatattcttggagactctgagtttgtgattctcccatagcttgggaaatagctgagccatcatagtctagtattcttcccattaacaacctgaaaagtgagtgtggacgtactcatgtgtgcacgtacagatttcatggtgtctgtaagtgatgacaaaagctttaataactggcacactagcataatatagaaatcaatatatatcaatgtaaaatataacccccttttattctgtaaataaatacacacaagcacatgtatattatcactgtttatagcacaaattatcactctaatttccaattttttaattgatttttggacattctgaagagtattcttgttactagctaaatgatctccatttccgggccatggtttgacatagggaatgccagccaaaccttccagcaacttccccattaaattgattattctggttgggcgtagtggctgacacatgtaatcccagcactttgggaggtcaaggcaggcagatcacttgagctcaggagtttgagaacatggcgaaaccccgttgctgcagaaaatacaaaaattagccaggcatgggtgcaaccctgtagtcccagctactcaggaggtggagttgggaggatcgcttgagcctgggaggcggaggttgcagtgagccaagattgggccactgcactgcacagcctgggcaagagagccacaccctgtctcaaaaaaaaaaaaaaaaaaaaaagaaaaagattatcctaagggccctggcactttattgcagtacaaagagagttgggtgtgctattgccttgtaagagctgtgatggtcttggatgcctatgcttcctatgtggcctgaaacgagaaagcctgactcattggcattacctgctctgtggcctctgcctgccagtgcttagctcccctggagccttccatggatgctacacatgcccctgcttctgctctcttggtctgttgagcagctgtgtccagggccacagctgtagcttataccacgtgccacctagtacataagtattgtaatatatcaaaaaccagtactactgaatctgagtgaacctgaatattagtcctgcaaatagctcacaataagtcctcctaccaggcaccaggtcacgtcaagatgagaagcagaaacttcagagtgataaagaggttcacttctgttaaacatttgttcttctgaactatcaaaagtgaagagtttccatgggccatagcttggatacaccaataggagattcttaccctagggaggcttgctagacacatctccagtctggctttgttaaccctgaaatggaacagcatggctttttttttttttttttttttttctggccaaggctgcgtgagtttgctagaggcagcatttttttgtggctttatcttctatgtgccattctattaatatttctattctacagataaggaaatcaagacttctctagactatatatccagctaatagcagaggtaggatccagatcagttctggctgaactgaagctgacataaagcctgtattttaatacaggttgccttctgtaatgcctaacctcttgtttggcataggggttattgatttgttattttgctaaatgttatctttttttctctgaaattttaatttctagttggattcccagccatttgtgggaggcattccttggaatcatgtactatgagtgctgaatttctaagaattaaaataaaaattctgacaggcatggtggctcataactgtaattccagcactttgggaggctaaggccggccaatcacctgaggttaggagttcgagaccagcctgggaaacatggtgaaaccctgtctctacaaaaaattaactgggtgtggtggtgcatgcctgtaatcccagctactcgggaggctgaggtgggagactcacttgagcccaggaggtggaggttgcagtgagccgagactgcaccactgcactgcagcctagataacagaatgatactctgtctcaaaaataaataaataaataaataaaataaaataaaataaaataaatttaaaaaaataaaaatttctggtcattttagaagatctcattacataaaaatcacaatgtcatgcgtgttattatttgatcctgttgatgacatgaggcatgtagaaaagtttttgttcttaattagttccagtttatagggtggggagttggtggggggaaggaggcctagaggagtaaaatgacatactcaaggtcacacagcttttaagcagaaaaaccaagtttcaagtctgagacctctcttctcaaagtctgttacatttcctcaaagcttccctggagtgagatgaatggggaatgagacgtaagcagcctttggagccaaagcagtggctttttccatggtatatctacttgttatgcccatacgatccatttctctaactgctgggagccaagatctgaaaaatctgttacaaagaaggatgatgaagccctttgtgataatgacacgagttccttccttgccctttgccaagcactgtgaaggaatggcttttccctagagtggggcatctctacagagtcactttagtttcagggatttctatcccacagttgtcaattttatagaagccaggacaagacatttttaacattgtgactcttaaccactgagaaaaatgcccactggtgaatgggaacatgaatatgacatgattctaatgccaagttcactttatcagtcgtctctccaaaaggctgatcctgaacactatgggatactaactcactttactagacctggatgatgaaaacattctggaaagaggaaaagtgatgttctgtggaagtgtttttgtggagtcccagaggatccactgaagaaggctgatgtcccaagaactgcagttggtgccaagtgttggttgaattcttgagagcaagaactgcagttggtgccaagttgctgcccatctcctccctgtccccagcatattagatcatcttgagtattgatgctggagctgagacagttaccactgtgatgaagctgggtctgaagtcttagaataagtcaaatgtagaaggatgttccttcctggcaagcccctagcctgcttggagtgaggggggcacacaggctcttggagggctgttggcagcatttgcctgcctctcccaggccagctgagaaacttgtgtggctgtgaactgtgatgaatcacgcaagaggaaggaggtctctacagctgttgaggaaggacatatcaaacttgaatagcatagcacttggctctttattttatgtaacatatttttaattgtaaaactaatgaatgtggccgggcacggtggctcatgcctgtaatcccagcacattgggaggccgaggctggcggatcactttaggtcaggacttcaagaccagcctcaccaacatggcgaaaccccatctctactaaaaatacaaaaattagctgggcatggtggcgggcacctgtaatcccagcttatcgggaggccgacgcaggtgaatcacttgaacctgggaggcagaggttgcagtgagctgagatcgcaccactatactctggcctgggcgatagagcgagactcagtctcaaaaaaaaaaaaaaaaaaaaaacaaaacctaatgaatgtaacttgcagaaaatttagaaaatataatcataaaaacaaacaaaaatcactcatcattttcccagatataattaaatataattactataactgttttgaaaatgtagtggataaaagcctggactctagaatagcctgcatgggtacaaatcctggcttactaactgtaggacctggggtgaatcactgatatgtctttgcttcagtttccttgtgtataagatgaagatagcaatggtattgccttcatagggtatttgtgaagattaaatgtgttactacatataaagaatttagatcagtggcctagtatgtggtaggcattcagtaggtttcagttgttattattttatgtttattatatcctctgaattgtttctctaaactgagatagttttcttttacaaaagtaagattacacagtggattatgtgttgtagcctgcttattttacatttagcctttgccatgcccttctgtacttttctgcaaaatgattttagtagctaaccatatggcgttattagagatatttaacaattcccttactattgaaaaaaatacatcatttatagcctcttgccatggtaaacactatcttgatgaacgtctctttttggtaagtttttgcataccatccttcttttgatgacagtattttatgggggagcatttcttcttagaggaccagatggaattatccacagcccagggtgccataggcatgtactgaataagcatatgaggggatgatcactatgcattatggacactccttctcctttgataccacttctcacagtgttttgtccacggctaagaaatcaataaaatgtttatgaaaagcagccacacttttttatattttcagttacattaaggcagttaagactagccctagcatttgtgtttatcttctttatataatttctaaatgactattgaatcatctcaaatctcttttggaatgaagctcgatacaaataaatgatcaaacagccaactagcaatctagtgggagacagaaattctctcccaggaaacacaaattttatgtcactcttgacagcaaggactggtcaggttcctacaacttggaaggaataggatactgcgtctagtttcccaaacattaggaatcccaaggaaaacttatttcttacacccttaaagtgactcagaggtaaaagtgcaattctctgatgtttgtccttggtgggcttagattttcacaccacagacatcattgaaacaagaatctacttggagccttagaggcagtcctggacctttctctttggatggcactcacatgctctgtcaactctgatgtcctcaccttcactctcttacaccctcaaatccctgaggacccttagtaagcagagtgttctttccactgggtgccattttagccaaagtatttagaaaggtgttggaggtagcaagctctgcattcctaagaacacaagtggtgttaaccatctgatgcaagggttggaaaactttttctgtaaagggccagagagtaaatgctttagactttgtgggccgtaagatctgtggcactactattttaactctgcattgtagcatgaaagcaaccataggcaagatgtaaacacataagggtactttacttctggacattgaaatttgaccctcataccagtttcatgttatgaaatatcattcttctttctacttttttcaatcatttaaaaatgtaaaagccattgttatttcacagactgtacaaaaacaggccgtggactggatctggcccatgggatccagtttgttaccccttgatctaccgtggtcattgtttgtcttctgcatttctttctcattgcaccattttcttctttgttgtgccatattttgaaacctctctgccctttctcttaactagctgaggctaaaatatttgcagaatctgcacttttggcacttatgtggctcatcagggaaagccagaatatctacctaaaagaaccagtagagcaacatcaaataatgcccctcttcttttttgtgtggccttgccagttcaacgtataatttgaatatatgaaggttacagatggactctggcaagttgttctgatttctgcagcattccaaagctctaatgagcagagcatgcagcctgagggatggtgagagtctgatttttagataatcaaggatatttatatcttttaataggctggtgccttgtagttctattccagcataaaactgagagttgaagagacatctaatcaatttgatgtcctctctttaacagttatatatcaaaggggtgttcaggctgaacacatgaaaatgttacagggatggaaatgggagaattataaacattttatgctgctctatcctcactatatttaaaacaaaaacatgatacagatttttacatggtggggtgtgtttacagggaaataatgtgctctatttcatatgaaacaggacacaagagagcattctcagatttgtaacactagccgtagtctgtggaggtgcccattagacctgttcctggccttttattcagggctgtgaagcagtaggggcgacagaggctcggctgcctgcgtaatgagattgacttggtttgcctggcatgcagtgatttatgagggtgcttattgtagggatatctgccgctgagagcagccagatgaaaggtgtgtgggtgagaggtggaggagagcagggaataggagagaggcagttgtgtataggcaggtaaggctcatcttgattatagttgttggaatcctgagctgagtgaagatgtagaatagtgtgaaatggtagattagcaaggctttggaattgcacagatatgggtttgaattgctgacccttccactcgttaactggactctttggtgagttactttccttctttgagcttccattgcttcatctgtaaactggggataataaccacttccactctcccgctatatgaaactgtactatcataaaggtctgagcacagttcctgttgcattggagagctcagttagtggtagagatgattaatgtttgtccatatgtccattcattgtttgtttaccagtattcaatgtgctttgcaatttctaacagagcctcattttctaatagatgtctaatggtgacttagacatctgttaggtatcaatagctcttaagatcaggatggaagaacatgacagtcaacatgtatttatagatatatgtatgaacatctaagtggcatgtaggagtgtactggtacctgaaatatgattgaaagaacagccacctggccagtaagcacagtaaaagatacttcacctcactagtaatcagggaaattaccaaaataggaccaaagtgagatacttatttatacttgacaaagtggtaaaaatgtaaaagtctgacaatactaagtgttaaggagaatatagagtgaaggaacacatatgtactagttgtaggaatttaaactgctgtgactgctttggagaatggtttgtcaatatctagatatatgaagtgtacataccttatttactggcaaattctgcttgtaggtataatctagagagagtcttatgtatgttatcaaagtcatgtgttcctcactgtgttgcttattataacaaatagcctacgtgtccatcagtggggtaattgatacacacattaattgagctaaagctgcatttggtaccagcataggtgaattttaaacaaaagtaagtgaaaaaaataaagttgcaaaattatgcaaatagaaaaccatttatgtacagcttgaaatcttggaaaataatattaatacattttttgtggatacaaacatatggaatacaagtttgaagaaattaattggaatgacaaatataaaattcaggctgatattaggagaagaaagtgggatgtgattggaagggttgcctgggttcactagcttgtatgcccttagacaagtttcttaacgtctgtgcctcagttttctgatctataacataggaataataatattatctatttcattgggatgctatgaggattaaatgactgaatatagataaaatgcttagaaaaatacctaccagatagtaagtgttatatataagttagcaattatagtgcctattacgtgaatatttttattattctttattttgaaaatcttatatattgcaagttttgaaaaagaatagatgccattcttgtcttttgtcatcatatagttggaaagtgaacaaagattaaaaataccatcaatacaggaatttcaggatgtggcataatagagtttagctacgttctcttgacccctagatttattaggtaccatgccaacagctttatatgcatttatttaatctttccctatggagtaggcacaatttttatccctattttacagatgggaagaaagagatttagaaagactgacttccagggtcacacagctaggggtagcaaagctgggcaggaacccaggtgagaatgactcacgctcttgactgctaggccttaaagccctacctggccactgttcacattaaccacctcctctacacagattcctgcttccttcctgtatcagcctgcataggttaggttgtgctttggttatgaacattcccaaaagatcagcggcttctattaacaaacaggtgtttcttactgtattagtctgttttcacgctgctttaaagaactacctgagactcagcaatttataaagaaaagaagtttaattgattcacagttccacatggctgtagaggcctcaggaaacttacaaccatgacagagggtgaaggggaagcaagtcacatcttacatgatggcaggacagagaaagagagcaaggacggaagtgccacattttaaaaccttcagatctctcactgtcatgagaacagcatggggaaaatccacctccatgatccaatcacttcccaccaggttcctcccctgacccgtggagattacaacttgagacgagatttgagtggggacatagaaccaaaccatattacttactcatgccaaatattcatcaaaggtcacctgggtcatcaaaggtcatatgccacatagctcctttctctgggacccagaagtcatggacagagcagccacagtctccaaccttgctgattgctatggcaaagggagagagaaatacagacagagagagagagagacagagaaagagagaaagagagagagaaaaactatggagaatatcacattgacagttaaatgtaccctggaagtgatgcacaacatacactgtgatacacagcacttcccctcacacacataggctggagcagtggttttcaaccaggggtgattttgcctccactaggggatatttgccaatctctggagacattttttattgtcacaactcagaggtggagtgggggttggggcaggtgctactggcatctagtgaatagaggccaggaatgctactcaacaccttgcagtgcacagggacaaccccctcaaaacacgcacaataaagaagtatttagcctaaaatgtcaatagtgctgagattgagaagccctggactggagctaagcacaaggggccaaaaagcgcaattttaagaagctataaagggaagagaacctgaaatatttgacagatagcactaatagctgccatgcatcctaaggcctaaaagctgtactaaagccccttcagaaggtgtttttcatgatagaagtgaaccagtgctttaagggatagccatggaatggggcttctagtatagtcagcttcatcagagggccgaggagtgccctggactcactgaagttgactactgctcttcctcagcagtctctctggagcagcactgtccaaatgtagtacaataaaggccacatacgtagcttaaaaattttcagtatccacaccaaacaggtaaaaaggagcaggtgaaattgattttacagctataatttctttaattcaatatatttaaattattatttcaacatgtaatcagtataaaaatattgagatactttacattcttttttttttgcaccaagcctttggaatgtgttgtgtgttttatatttactgcacatttcagttgagactagccatatttcaggcgctcaattgttacacatggctagtagcggcaatactggaggtttctgttcctgggactcagtgagggactgacctgggtctcccctgaggaccagtagcaatgctataactcagagtctataagttctgagagtgggacacaatttccaggaatatctgtcccagactcttaaagacagtctgtgtatgttttaagaatgaagagggattggttttccgtggattctctgccatcaccatttttgtttgtttgtttttttttttttttggcaggtgcctcatctccagacatggagcccagctatgggggaggtctctttgacatggtaaaaggaggtgcagggaggctctttagtaacctaaaggacaacttgaaagacaccctcaaagacacatcttctagagtgatacaatctgtgaccaggtacgcacattcttcccagttaatttagtggatccccatgctctcaaaggatctggttacctgctgactgcttgtctggctcaaagagtgtcaattttgggatataattttatgggatctgatgaactgagaaatgtcattgaagacataaagttaagtcctttagaagctataagcacgggctgggaggactcagttcattgccacattagagtataatggttgccctccctgtctttagaatcaaacatcttgggttctaatgcaatatctgcccttgttaactaagagccctcaggcaagttaattaacctctcagagctttttttttataccctgacaggatttgtgtctttgggttgtttagggattaaatgagattaaaatatacatgcaatctgaataagcattacctacggattgtaatcaaatcagaactttgtttttgtttcctactagccctttaacatttattcagtgagagaagtttcctactcttccactgtatgaaaattcttataagcaggtcataggagttattttttattgtttagtattagaaaattctagggtcactttgagttacaatatgcagttcttaatcagaaattcaaacgtcaagtacattatattaatcaaaattttaatctttgttcaaagataaaactattcttacctctgattctcaaccagggcctggtaggcagaaaaatggtgtcatttattttttctcaaccacttcttcccctaccccttagccacttacaattatggaagatatttccaggtaggcaaagaagctagaacaattggtgttgataaataagcagagttttctattctgagattgattcagatcatgaagtggcatctacaagggcattagaatgcaccagttggagtggcatatttatacccctgaggtcacgggctttcttttctcagtgatccttccttgttggagagaagggctggaggggagtcgaaacatgccccctggacagcggtgtcccagttcatatgcgcaagtgattgagagagagaaatcttggcatatttggatcattttaatgagtgcccatttttgtcttgcttttagctacacaaagggagatttagacttcacttatgttacctccagaattattggtaagtttctcatgtttattaacagtcctttggctcagtttcccgttgctgcccatcgttatagcagacgtaaacatttaacctgttttctttctgtgtgatctctctcctagtgatgtcctttcctctggacaatgttgacataggattcaggaatcaggttgatgacattcgaagctttttggattccagacatcttgaccactacacagtatacaatctgtcacctaagtcttatcgaactgccaagtttcacagccgggtaaggatttttagccctgagatcatactgttgaagacgtgatggtgcttttcctcctcagagatacccttaaagcacgtgcccttaggcatctgaagctgaaaaactatacactctggacacttctgttcacaaaatatttattaggctgctatgagatatcctaaagattttccttgggtgaggatacttacaggaaagtgtatctgtcaatgaaataccatcgaagttggggtctcaagtctgttggtgcctggttgttccatggcacagtgttcatgaggcttaagttggagattgaactgctgctagggcagttggctgccttcatgctgttacactaattatgccgttgacccttctttattgctacttggtatcaagataaggcagtgtggatagaccggtactgacaagtattaatgggaacgtgtttccattaatatattttaagaagttttttgaactagagagagaaatattcctagtttcaccttggcttaggtttgaatctgatatcgagcctgatatttctggccactgaattctgacttactcactaaaaaaaggcatttttttcccctctcaagaacatctctaaatatttttgacttagccttcagatatgattggttctgcaacttcatttgggtctattaataaatagaatggactttctatgcatggatcctttaaaagtgaaacttgatgtcaaatgtgtaaaatgatagctggttgacaatgctgtgtatctaggatcttagctttgatgctggaacacacttcgttccaaattccagttaccattgataatctctgggcctcagtttccagatctgtaacacacacaagaaaattggtgtacatgctttatatggctccttcctgccctaatattcaataagctatgggagagttttaaggacctctttttcagcgtattctgagaacagtctcaaattttggtgtgcatcagaatcacttggagggcttgttaaacacagacttctgattcagaaggacaagggaggcataagaatctgcatttctaacagcttcctgggggctgctcctgatgttgctgcggggaccactctttgataaagcactgataacgccattctgaagtggtttgatctaaattgccattctataatgaagattttaaatgcatctctttaaaatcttctgtaataaaataaccttccaactcttattccatctattagctaattcagaacaagtgaattaacatcaaacaaaaatgtggatagatattttgttcttaatgtaaggcaaatcttttgaattatttttcttgactggaggctaagtcagtgccattattttcataatttaaggactgtggaacatcctacacaatatttcatagaaattttatttgaccttgaaagatctgtgataatctggagcattttccctctgaaagtaaataaagatatgatatcattatagaagcatttatacatataaagatgtctctttgtataatgtttataaaaggcaatctctataaagatgtttttaatgaaaggcatctatcagtgtaactaaagattttgtgactggacttaagggtttaccaaaggaatcagagattacatattaaacacctaccctgggctgctcttacttgccctagaagaggagggagcatttttttttttttttttttggatacctagaacaacagttcctgacatagataatcaatgtttttaaaaagcatgaatgtgctgcacccattaactcgtcatttagcattaggtatatctcctaatgctatccctccccaaaaataaaaaataaaaataaaaaagcatgaatgtggaaagaattgttaaacactatagatataaaataaatatttggtttttgttctcaagacacctaagcctagttggcgagagaacccaggacgttctaaagataagtacaaataatatttataatacctgccaagggagattagtaaagggagacaccagtgacagctggaccttagagcaggagaaaggcttatataggtcagaggagtggagtcatttcttgcctatacaaatcataaaatatcttgtgaggctcttgatgatctagcctctatctgctcctctaacttcatcttttaccattcttcattgcccaaaaatcatatgctccaatagggataggcatgtgctcatgtgcacacagacacacacaatcttcttgcatgagctactccttctcccttaaaagctacccatgtcacacacccttcgtctccttccttccttccttcttcccttctctttcctttctccttccgttttccttcccttctccttcccttctccttccttccttccttctttcctcttcttcctcctcttcttcttcttcttcttctcctccttctccttcttctccttctcctcctcctcattcttcttctcccttcctccttccttcctctctcccttcctcccttcctcctcctcttcctcctccttcttcttcctcttcttcttcttcttcttccccctcccctcccctcccttctcttccctcccctccccttcccttcccttcccttccaaaagagcctcactcagttgcccaggctggagtacagtggcatgatcttggctcactgcaaccttcgcctcctgggttctgattcttgtacctcagtcacccaagtagctgggattacagatgtgtgccactatgcccagctaatttttgtatatttagtagagacgattttgccatcttggccaggctggtcttgaactcctggccttaagtgatccacctgcctcagcctcccaaagtgctgggattataggtgtgagccaccacccccagcccatcttcttctttatttgcctaattttgctaaggagaagatttccacatgccacgaggcttttccaattctctctcctaaaacacaggattgcactacatctttagctcttccagatagtcctagaatttggcagaatgcaagtggatcctctgacctgtctcctttacccttagttgcatcttagggaggcagtcccaaagccgtagtatttccatcttacctttgtttttgatttgcctacatctcttttcaaactcctagacctttctttccccagcactaacactgtgaatggatttgcatctcattgttgcatgacttagaaaagttttctttgtttttacctttcagttcatgaggactagaaccatttcttactccttccggttctgtggagtgctacgtctgaaattaaaccttattttaataaatgttgatggtagagtctaccataaatactaaacatggaactggttttatttgtagattcataagggtgtataaggtcttaggaattttttatttataaactcgtgggagtctggatctgcccacatcatatacctctgtgccttgaaacctgaattcagtcattttacatgatgattatgtgattgtttgtatatgttcaaacctgcatttgaggatgtaggtagtgatgttggcaaagacaggctgtttccaggaagattttactttgctgagggttgtcattctgtatttcgattcacttttatgcttagaagccacattggttgacaggaattgtatgaaatgatcaatactgttttcctgatttttctattatgtatttgcatatgtcacagaatgttaaaataggactttgtttagtctcagtttagcagaggctacaactcaaaacaatgcatagcacatagcccagcattcaaaagcgaagtactggaatacctattcaggactgcaaaggatgtatgaaacctcaggtgtttttatttttttttaatgttttttgactctttatagccaatatccaccttgaggaaataagagtactgatgctgacaatgaagtcctggagaccaacaagatgcatcagttaaaccagatgttcataatgactcctctgtgtatgtagatctattgctaggcttcagagagcttaaccatctgtttctgctcctttaaaaaaattattgtggtaaaatatacataacataaacttattgtaaccatttgtagcataaaatttcagtggcattaattatattcccaatgttgcataaccaacaccgctatctatacttaaacctttctcatcatccccaacataaacactgttcccatccactccatgcatatgtgtgtgtatgcgtgtatacactggtttggtttctgcatagaaggtttatagctgtgccccagaatatcaggaacctttacacatttcttggcattactgttggcaataaatggaaagctggatgaatgtacactaagtctaacctgattccagagttcttaagttctgattaatgctattctagggccactttgtctctccttcttccactgtttacccaggaaggacagtatggtgacagagtccttctagcagcaaagaaatctgcagcccagctggttgttttaggctctaccctcttaactatttctaaatgacataatcttctaggatttctttccctttgggaacaatttgatttttggaaaatgtattatcaacttgggtgtcttaaaggactcatgattgaaggtcaatgtttttacccctttttcttcctgagcacaccaaagaggtcgctacagctcccagttgtttctgcattggtgggaggttggtgggagattggctggagtgggagaagtttatagctcatatttcatctctcactctgctaccatgcctcagtgtcaggacaagaaataactggagtgaaaaaaacaatccctggcctgggggccagaggaccagagactcccacattctagttatgaagccttccatgaattgaatgtcttaaccctggtaaaatacagccatcacttgaagctgtaaccactctacaaatgcaaggtggagttattgttatcagtcatcagacaatgtagtataatggagagtgcacaaattttatttttttaaactgagatgaagccatatagtgtatacaaactttagactttaaaaattaccctaggttcacatctcagctgttcttcttcctgggcaagtcacttttacctctccttggactcgtttttctcctgtgtaaaatggatatgccaataagagagtgcctatctcacaagcactcttagaattttttttataggtttgttgtaaggaataaatttgatagcagtctcttgcttagagtcatcatgcagtaagtagtagctatgattaacattggtaataataaaatgctacaataagtgattgactgaattatccccatcctccaaaaatggtgtgtgattcataaaacactagatgtagcaattaagtcatactctctgtagaagcattcattcctatgcttagtgaatggctgcttctgcccatcctgtcttgggcaagggatgatggagagatgaaaattgaatggcatccagctctagcgatgatttggcttctttttcccactgggtggtatcatggcagtgctgtaatctgtatggtgtcctctgatgctaagcaagcccaggagatgttcaaggtgttcaggaaaactggcgacagcattgcgaagtgtcagctactgcatgaagctgtgaaccccagagagctacaaaaatagcttgcagtgattgaattccttttttattttgttggttttgtttatgccttagtgttttccccttttagacagagcacatgcttttaaaaaattctaattgtatgtttacttaatggtgtataattatatatcaagtaaatatataattatggagtactttaaattaatattatttacttgattgagttaatgattctggagctattagcctattgtgctaagaataatttagccaacttttagctgagactcattacagatattgacatttggggtgtgtgtgtgtgtgtgtgtgtgtgtgtgtgtgtgtgtgtgtcatagccagtttttaaaaccttcaaaaatattgctggggaaataaattttctatactttcattctgttacagtctaaaaaaaacccaataaaatgggttcacctgttccctcctcaagatatggtacatgtggacaaatcttattataaaaatagattgccaaatggggttcattcctttattctttcactcattcattcactcagcaaatacctgctgagcacctaccatatgagcaacacatgcacagtggacactggggttacaaaaatgagtaagttatggtctctcttctcatggagcttggtgtctacaaggggagacaggtataagcagtttattcagtacagcttgaccgcaagctagcatttactgtgtttatgttgtgctacttaattctgacaacaatcttgtaatgctcatttatactttacacactagataattgaggcctggagaggttagtaaattgcctaaggttaatcaagtagtaaatggtaaatccagagtgaaaatccagcctgtggatttaaccatgttgttctactgaaaaaagctgtaatagatgaaaataaactggggcatgagtataaagatgactaagcgtttctgtctgtgagtattagagaaacagtcagagccaagagaacacttgaacatttttttcttttttaaaaatttgagttaaaatatgcatatataatgtaccatttttaccattttaagtgtacagtttaattacatttatattattttttcctccttcaaaccctctcccactcctcttcctggcctctggtaactactaatctactctttatcttcatgagatccacatttttagtttctgcatatgagtaaaaaacatgcaatatttatctttctatgcttgggttatttcagttataatggcctccagttccatccatgttgctgcaaatgacaggatttcattcttttttatgtgaataatatttcattgtatatgtataccacattttatttattcattcatccattggtaggcacttaggttgattccatattttggctattgtgaatagtgctgcaataaacatgggagtgcagctttatattcgatatattgatttcctttcttttggatatatacccagtagtggaattgctgggtcatatggaaccttcatactgtcctctatggtgattgtactaatttaccttcccacctacattgtataagagttcccttttctcacattttcaccagcatctggtattacctgcctttttgatacaaactattttaactgaagtgagatgacactatattgtgattttgatttgcatttctctgattagtgatgttggacattttttcatataactgtatgccatttctatgtcttctttggaagatctgttaattctcttcaactcttttgcccagtttttaatttgttttttttttttattgttgagttgtttgagctccttatatattctggttattaatttcttgtcaaatgaatagttcacaagtatttcctgccattcagtgggttgtctcttcacttcgttgattgtttgctttgctttgcagaagctgtttagcttcatatagtcccaattgtgtatttttgctttggttgtgtgtgcttttgaggtcttccacaagaaatttttgtccagatcaatgtcctggaacatttctctaatgttttcttctagtcattttatatttttgggttttggattcaagtttttaatcaattttatttgatttttatatatagttagagatataggtctattttcatttttctgcatatagttacccacttttcccagcaccatctatggaaaagactgtcctctcccactgtaagttcttagaatctttgtcaaagatgaattggtggtaaatgcgtggacttatatctgggttctctattttgttccattagtccatgtgcctgtttttatgccagtaccatgctgttttggttacggtagctttgtaaaaaactttgaagtcagatgatgtgatgcctctaactttgttctttttgctcagggtggctttggctatttggagtcttttgtggttccacatacattttaggggtttttttttatttctgtgaagaatgtcattggcattttgatagagattgcattgaatctgtacattgctttgggtagtattgccattttaacaatattatttcttctaatccatgagcatggaatacctttcctttttttgtgtcctcttctatttctttcatcagagttttacagttcttcttgtgtagatctttcacttctttggttagattgattcccaggtattttatattttttgtagctattggaaatggcattggttccttgatttctttttcagattgttggctgttagtaaatatgaatgctgttgatttatgcatgttggttttgtattctgcaactttactgaattcgtttgtcagttctaacagtttttttggtggagtgtttaggtttttctagccataagatcatgttgagttcgaacaagggtaatttgacttcttcctttccaatttagatgtcctttatttctttttttgcctaattgctctggccaggacttccagtattatgttgaataatagtggcgaaagtgggtatcgttgttgtgttccattctttagaggaaaggccttcaattttcctccattcagtacgatgttagccatggatttgtcatagatggccattattattttgaggtatgttccttctgtatctattttctgaggatttttttttttttgagacggagttttgctgtcacccaggctggagtgcagtgatcttgactcactgcaacctccgcctcctggattcaagcagttctcctgcctcagcctcccaagtagctgggattacaggcacctaccactatgcccggttaatttttgtatttttggtagagacggggtttcaccatgttggccatggctggtctcaaactcatgacctcaagtcatctgcctgtctcagcctcccaaagtgctgggattataggcgtgagctgccgagcctggcctcatgaggatttttatcataaagggatgttgaattttatcacatactttttcagcatctattgaaataatcacgtattttttgttcttgattctattcatgtggtatataacatttattgatttgcatatattgagccatccttgtaccaatgaagtaaaacttttttttttttttttggagacggagtctcgctctgtcacccaggctggagtgcagttgtgcgatctcggctcactgcaagctccgcctcatgggttcacgccattcttctgcgtcagcctcccgagtaactcggactacaggcacctgccaccacgcccggctaatttttttgtatttttagtagagacgggatttcactgtgttagccaggatggtctcgatttcctgacctcgtgatccgcctgcctcagcctcctgaagtgctgggattacaggcgtgagccaccatgcctggccatgaagtgaatctttgttgataatggtgaatgatctatttaatgtgttgttgcatttgttttgcaagtatttggttgaggatttttgtatctgtgttcttcagtgacactggcttgtagttttccttctttgttgtatccttctctagttttagtatcaggtaatgctggctttgtagaatgagttcgaaagtatttcctcttcttccatttttaaaaaatagtttgagtaggattaatattcattcttttttaaatatttggtagaatacagcagtgaatccgtcaggacctgggcctttctttgataggagaatttttatacagcctcaatctcattacttgttactggtttgttgaggttttctatttcttcatggttcaatcttggtaggttgtatgtgtccaggcatttatccatttcttctaagttttctgatttgtttggtatataattgttcatagtagccgtctcttatgagtctttgtatttctgaggtctcagttgttaggtctcctttttcattcctggctttatttatttgggtcttctctctctttttcttagcttacctagaggtttattgattttgtatattgtttcaaaaaaaacaaccttttattttgtcgaaatttttttctttttagtttcaattttcttaatttttgctctggtctttattatttctttccttctagtaattttggctttagtttgttcttgcttttccagttccttgaggtgtattgttaggttgttaatttgaagtctttctactttttcgatataggtgtttattgctataaactttcctcttagtacttcttttgctgtatcccatatgtttttgtatatttccattttaatttgtttcaagaaatttttaaatttccttcctaatttcttcattgactcattggttgtttaatttccatgtgtttatgtattttccaagtttccttttgttatttagttgtaaagttttattccattgtggtcagagaagatgcttggtatgatttctattttatttatttatttattttatttatttatttttttgagacgaagtcttgcactgttgcctgggctagagtgcaatggtgtgatctcagttcactgcaacctccacctcccaggttcaagtgattctcctgcctcagcctcctgagtagctgggattactggtgcctggcaccatgcccagctaattttttgtgtttttagtagagtttcactgtgttggccaggctggtcttgaactcctgacctcgtgatctgcctgcctaggcctcccaaagtgttgggattacaggcgtgagccaccacacctggccaatttctgtgtttttgaatttgtacagactcgttttgtggactatggtctattctagaaaatgttccatgtgctaatgaaaagaatataaattctgcagcagttgggtaaaatattcagtaaatgtcaataaggcctattagatcttgaacctgggttttaaaagatgaattggagtttaccaagagaagaaaatacattgcagacagaaaggagcttgtacaaatgtacattttatgattcctctgacagcaaaatgtatcttcccagttattctgtatttttagtcagtaagtcatttccgttccttgaaaacaaacacgtcaatggggaatatatatgtgggtaaagactagaccagaaacagtcctgaatcatgttgggtaaaaggggcaaggcatcataaagtttaaattgacagaggccaatgctagatcaccctggactgtttgggagctatgccaaacatttcaaatactttgtttaataaaccatacttgtctctcctaaaggtatatgaaagtgggtaacctggaaggtctcctgacatttgccccacagtcatcttgtagaaaaaagttacaaattaacaaaaaagaatgggctttcttggcagccccagacagagaaactcaatgtgtttgcttttagacgtcagctctaccaagagcacagataatttcctagtcgtattttgattatttattatctgattaccagaaaagggctaatcaaacaaattcctcctgcctccctttcccatggtcaaatagaaggaattcgagacatttgggattgcagagcacattctgacatcatctgtatgaagcctcttctttctgcagaattccgtatctcaggaaatagcacttcttgtatccttctatccagccattcaagctggaaacttggagttcaggcttgactctttcctctccctcccctgacacactcttcagtacacccctccacatgcacacactgccaccatgtatcacctgtcttatgtccaggtgtcccaccacctatctcctgagtccctcaagtgtgtttgtaccccactgctactcagctagccttagccactatcatcccttattgacactcctcaccaacctcctgactggtcttcctacctttaggctcttgttatccatttctgttctccatactggagcctgaaagatctttggaaatgtagatctgagagtcattctcctccttaacaagactgtataatctggcccttcagtctacactctcaccatgaaggacttcatttttttcaaacatggccagtcctgactgcagggctttgcactggcagttacccgataaaatgataataattgccaacatttattatcactctgggtgtgtcagatactgagctaagctcttgaagtacatgttcatgtagtatcctgtgagttatgtaagaggtactgttcaccacattttatgaagaaaggcttaaagaggttatgaagtttgtccaactctaagcttctccttgttgtttcttagctagattagtaagtatgtaatcaactggggatcatgccttaacagtattttgaggcaagtgataatgtcagccagtgtgctgttgtaacatgatttatattcagaagatctgggctgcagtgctgacgctgagcagcagtgtgactctggataacctctgagagtcagttttctcatctgcaaaatggggtttatattaatacctgtcttagatgattgttgcatggatcagagccaagcaatattcctataacttagttgatgatccataatgtgtgaaaaaaatatgcatgttaaatgaatgaaaatgccaagggtttcccctgtaagttgtgtcctttgattaaaagagaaaaaaaatagatccatgcacaagcctgcctttggctcactctatagcacttttcatgttatcacgagagctgggataaattagagatggtgcaggacttataaccctataattaaacatttggggggaggtcaaaacattttatgcttaatagaaatgaaattctatgtaacctcacagaatagaaaaaaatccaaggatgtatttgaaatggtctagtttaatttaaaatgtgcttcaaaatgtgttttcatacctttactgaatgagaattctttaatttaaaaaattgctgtgttaaacaccctcttcttcatgcatttggaccctgttcccactattcctatctatattaagagaggatgtggtatcacttccagaagatgttggttggtgtgataacctgcttatgaagaggaagttgctggaggaattaatttccttttgctgtgctcccttaggtctcagaatgcagttggcccattaggcaggctcccagtctgcacaacctttttgctgtgtgtcggaatatgtataactggctactgcagaatcccaaaaatgtctgtgttgtccactgcttggtgagtaaccttttgttgttggtggtgatggtttggtttggtcaaatatggatgagcctgtacacaatggtagacaggtaacatttgagttcaataggatttactgagcccatatttaggaattgggtaatgtgagagttgtaaaaataagaaagggatttattattcttgacttaaagcttgactactagtgggaaaggcagatgtatacacaactcacatagtgtggggactctagaatgtgctaagtattataaaggaggtagaaacaggagtagtgtgtgcacagctaaaaatgccattgacttttgtgtgaataaagttaacattaacatattggcgtatttattttttcttcctgtttgtgtttgaataaaaataaaagaaaaaagatacctatgtccttgtaagaagtcacatagattgactgtattttagagcattcccagtgagactaatggtttttctgaccattgacttcctagagttcctttccctaactcttctcagaactcttgcctgtcctttacaactcaactttcagtaaaatccttctgactcttgagtattttcacaatacagacattcccattatatctaaatgtcttctgtggcttttaatactctgtgtcatagtaagctcttctcctgcatattttcccactagactattataatcttgcaggaaagaaccatgcctttttttaaacttttgtactgcaggcataaaaggcttcaataagtgattgaatacacaaatggaatctgagcattaatgctggaaatttcaaagcttctataaattttaaagcttctataaactttagtgtatatgtttttgctatagtattacttgatgattcccaaccccctgtcctttcttgagagccagttggctaaaacaggaaagaaagttaaagaacattttttctttctttttacttcacatctccaaactcttggcaataaagggataacacttggtgtttgtaagaatttaatgttaaagaccaaaggattttcctttccaaggcacagcagatggtgtaacagaacagattacttttagggactaagcaaccttaaggaccttggtgattttctctttactcaagaatttgctgtaagttcagagagcctacatctgacaacttgatggaggaaagatggctcaatggagaccagaaactcccagttccagtgattcttcataaagaataaaaacccaatgaagaagaaaaaagaagaggcaaacaaaagattatggttctacagggtgctcaataagctcactcaaaaaggacatgcatatgttggaaatgaataccatgtctttgggaaatggaattgaagctgggggagggagtttttttttttttgttttttgttttgttttgttttttttttttttttgggaccgagtcttgctctgttgccaggctggagtgcagtggcacaatctcggctcactgcaacctctgcctcccaggttcgagtgattctcctgcctcagcctcccgagtagctgggactacaggcacgcaccaccacacccagataatttttgtatttttagtagagacgggttttcaccatgttggccaggatggtctcgatctcttgacctcatgatctgcccgccttggcctcccaaagtgctgggattacaggcgtgaccccaccaggcctcttatttttatcttaatatactactggttattatattaaaaataataagcatagtggggcgtggtggctcatgcctataattccagcactttgggagactgaggcaggtggatcacttgaggtcaggagtttgagaccagcctggccaacatggtgaaaccccatctctaccaaaaatgtaaaaagttagccaggtgtggtgctgtgcacctgtaattccagctactggggaggctgaggcaggagaattgcttgaacctgggaggcggaggttgcagtgggctgagatcgtgccagtgcactccagtctgggcaacagagtaggattccctctcaaaaaaaaaaaaaatgataataacaataggctatactagtcttttaataaaaaaccaaagtttttaaaagacctgcatcacaggtaaaaagagaggctacatatccaagagccatggatctgtgaaaagagtgtcaggaaggctaaattctgaaaataaatcagattaagaaaaatatcctttttttaaaactgtgtttggaataagaacaacaacaatttcttgaagcatgtggtataatcttaactcctttattctgttttctttatcagagggaacaaatgtcaaactaggaagaacgtaacaatgatgtttaagacaaagctggtaggtagcaagatagtacgagagcctcacaatcctccaaattaattcactctcaaggcttaaattatgtgacacaataccgaaagcacttggagaagcaattatggatttcatttgtaatatgaagaaacaggaaggagaggtgccaggcaaatgaagagaggagattttttcccaaagtatggaaggaggttgatcctggaaagttgtaggcttgtgaacctggtggtaattcaaggcacaattctgagaaagttttgcacagaagattttaaactcttagcaaaaaaggaatctccattggtttgttatgagcacatatcaaaccaacagaacatttcacatgactaatagactagttgagatagtttattggagtcctgcaagatatttcttagttttttctagtcaagattgagaaatttggctaggttgttatatatttagttgagttgaggctgaatatctgcttccaaaggtaggtgattaatggatcacctttctcctgggagaaggctttatttagttattcattttaatcaacaactttgatgaagatgtggaaattcagcttatcaattttcttagaattataagggtcacatagtgaatttggattttaaaagttcttgtaggttggtcacttaacaaaaattaataatatgaaattaaatacaagataaatgtaaagtcctgaattctggttttaaaaaattaaacatatttgcacattaccttaacatgtcatctggaaaaaatctaggggttttagtggatagagagaataataaaagcttatgttgttacttagcctacatttatactagcttgggctggggttatgttaataaaagcatagtgtccagaataaagaagatgatatttcttctctagtttggtcagaatatatctcatatctttcatttcacatctgggcagcatttaaggttgtcattttaaaacttgaatttgtttagaagaaatgtgctaaatgatgatgtctcttaaaatggaaaatcaagtgaggaagaatagaagggattgagtttgttttaaaagggaaatagaagcattgatagaaagggagggtatttcagatatgtgaaggactgccataggaagaaaggagtaggtttattttttgttctcacaaaaggatgagggtcatttagtggaagctatggaggaatgaaagtcaactcaacatattcagtataaggaagagctctgtaaactggaatgggctacttcaagtatgagtaatctccctgtcacttaaagtgttctagaagaagctaggtcacatctgtcagggatgttactgaattttgtcttaattagcttgagctgctgtaacaaatataccatagaccgggtggcttaaacaacaggaatgtagttctggaggctggaaagtccaagatcaaggtgactgcagttcttttctttctttttttcttttcgaagagttggggtttcaccatgttgcccaggctggtctcgacctcctgagcttaggcaatctgctcgccttggcctctcaaagtgctgggattacagacatgagccactgtgcccaaccaaggtgcctgcacttgtaatgtctggtgagggcctgcttctggggtggcagatggctgtcttcttgtttttcacattggccaagggcagagggagttgacagcaagctcttttgtctgttcttataagggcacaattcccattcatgagatctccactctccctacctcattacctccccaaagctccacctcctaataccatcacattggggttaggatttcagcatatgaattctggggcatacaaacattcagtccacaacagatttatttctacattgaatgaagttgaatctggtgaaggttctttattttatacgaatctaggaacatactttgcatgagatacatatatgccatatcccaacaagcagcatttacctaacctgtgagctcgttacttccagtcctaaaccaagagacttcaactattaattcaacaagtccaaaattactttgaagattatattatttttcaccaaatatatacaaatcaaattgggcttctcagattagaatcaattttattctaaggataagtctttccttgctgcctttgatttaaaaagctgaaacaaattttggttttcaagtgaataatttttaaatgaaaagcacccacagttaagaggatttctcctctctctgtctcttaattgcaaattctgccattttcaatggagaatggctgatttgatcatgttcataatgattttatgcattttctttgacaggatggacgggcggcatcatcaattctggttggtgctatgttcattttctgtaatctctactctactcctggcccagccattcgattgctatatgcaaagcgaccaggaattggactttcaccatcccataggaggtaaagtaagctagatgcaggctaggcacagatgtagtctaattggtatcatgtactgttttaaatctgccttacaaatcctttcataagtttcttttactttatctctgtattagtccattttaatattgctatgaagaactacttgagactgggtaatttataaagaaaaagagtttcaatggattcacagttccacatggctggggaagcctcacaatcatggtggaaggggaaggaggagcaaaggcacatcttacatggtggcggggaagagagcgtgtgcagggaaactgccctttatgaaaccatcagatctcatgagacttattcactatcatgagaacagcatgggaaaacccgcccccatgattcaattacctcccaccggatccctcccacaacacgttggggattatgggagctacaattcaagatgagatttggatggggacatagccaaaccacatcaatctgacattatcctgaactatgcaaaaactgaattggattaggatattagattgtcattcagtttgtaagcccccatacgaaaatttatgatgttaaaactagaaggaaactttaaagaatacttatatccaacttccctcattttacaggtgaggaaactgggactcaagacaggttgtgatttgcctcaggtctaatgcccagtggacagagccagaacagcattcttgatcccaagctctaagaccagtccctttttgttttattatacaggtctttattgaaaaacagcagtagctggttatacttatcactggtgatcctcctgtgggaaacctgatttaacaaagggaaatgcaaaaatacatagagaataaagcgttttaaaattcactttttcatgtaactctgatatagaaataaaagattacaaaagataatctgaaaaatggaataaaaaagaaaactgtttttagataacattgatttttcttttatcacaatttcttcatttttttaaaaactacatctccttaattttttggattaaaagtgcttctgatgataaaattctaaaatttatccaaagccaaattttagctgataaattggatctgctagataaaataggaatagatgttcaaatattgaagtactataaaattcccataagctttttgatttaataaataccccagtatcagttcattggggaagtacagcaatctcagtagataaaatgtttcctaaattattgatcgcattatcttttgctagttaatatttaagaaattgatagaataagtttttattataacagtaatttgcaagaagaatcttcatagcaaatattgattgcttgcttctcctgatgtgatgggccccaagagagtgccaaccttctgtttcagatacctgggctatatgtgtgacctactggcagacaagccctaccgccctcacttcaagcctctcacaattaagtcgatcactgtcagtccaataccctttttcaacaaacagaggaatggatgtcgcccttactgtgatgtactcattggagaaaccaaaatatattcgacttgcacagattttgaacgaatgaagtaagtcatgatactttacttcttcctatgtacttctcaattctcatgtaaatgagcaggaatgagttgaatcatattcttcctgcaagactatatcattgtgaaatagctgatatataaaaaatgttcaacatcagtggtaatcatagaaaagtacaagtaaatcaggggatgttatggccctttttcaaatgaaaccatgatataggctaagggactagcataagctgtatacaggattaagaccaaggggaacatgggacacctggtcattgaagaaggagatggccttgatgggattaggtgagggtaatggaagaatcactgatgaatgaggtttctaagtgagcaactaggtagacggtgatgtaattaaagaagttacagaatccataataaagagcaggtgccagtgggtggtcataggggatgtggagagaagggagtgggtggtaacataacatgaaattagttaggaatagattgaatttgaggactggcatccaagactttcacagagcaagacatttctgtttgtatcctgatctccagtggattttttgttccctttatctctgcttttagtattaatttaaagttaagaaaaggcaaatacatgggggctagatgcatttgaggaaaatgagatctgcaaagcaggcatgggcaattgcagtccagatgggatgcagagagggggcctggcattagaccagcaccatcctactgcacaaccagttggcactggctgcactcctgtttttgctcaagataggaaatagtttctgggtccgggcctgggcgaacagtcctctgggccagagccatagagaactatacctgtgtctgtgtgattgtaccagattggactctctttcaatgtatattttggtctgtgtttacagagaatatcgtgtccaagatggaaaaatcttcattcccttgaacatcactgtgcaaggagacgtggttgtttccatgtatcacttgaggtcaaccattgggagccggctacaggctaaggtatggtttttggaagaatcatggcataagttcatctgagtcttcaataggagtatttctgaatcttttctccccatcactttgggcttgagtcacttgtagttttagaatgaaaaagagcgtttaaagattgcttagctcacctccttcatcttacaggggaggaactgagactcaaagaggttgtgacttgcccaaagtccttggcatgatgtccgtgccagaggatgacagccctggaactcttagcaaaccatactctttagaagcctgtgcttttcttatagtgccccatttggatcagtgtaagggaagagatttctactgaggatgtggaattaagggattgtattttttcaattttaaaaaattgagataaaaccacataacataaaagtcacccttttaaagtgtacaatgcagttgtttttagtctattcaaaaggttgtgcaaacatcaccactaattccagaacattttcatcactcacaaaagataccctgtacctatagcagtcacttcctattccctctcctccatctcctggtaaccactgatctacattctgcctctatggatttgtctatttgggacattttatttaatggaatcatacaatatgtggccttttgaggcttccttctctcacttagaatgtttttgaagcttattgtgttatagcatgtgtcagtacttcattatcttatatggccaaatattattccattgtaatgtcacaatgtattaatcttagttgataatctcagttaataatcatcagttggtgaacatttgggatattgccattttttgctattaggaataatgtggcaagtaattgtgttttgattcatcacatattggctaagtgagtgctttgtgccagccattgctgaggtttttaggattgacaagagtaagactatgtctctgcctttaagggactcaatttcacaagggaaatccatgcaagtacaaatatgcatgataccatattagagggaggatgaggtgttataatgggagcagtttgttttagccagcagtggcctagaaaggctacagagagaatatgaacttttaagacatgccctaaaggatgagttcattgggttggaacagggcatcctgggtagaaggaatgcaatgagtcgaagtatgcctgtgtgcaagaacatagtatttagcggatgagaaaatggtttgccaaggcagagttcaagtagaggagaggctggaaatgaagctgagcctattctaactggggaggtcatttaatatccatagtaaacacaaattcagatattgaaacagttgaaggtgcatgtctccccaaaatctaatcttttgatcagattcccttttcgctgattgattgtaatgtgcttctctcatgtatttttaggtgaccaacacacagatattccagcttcagtttcacactggattcataccactggacacaacagttttaaagttcaccaagtaagtactggttgggccaaaagtctatttgaatcaaattagctgtgaagtgctgaggctcaatggcaccaggctgtagcataccctggaatcctgtgctgctgaactactgagtgtcactcagtagcacagagaggctgtgggcattctaaagctttcagttgaatatgatttatcttcagaagtacaaagggaccaaagacttcaaacagaaagttctaaaattctatgtgagggaataagggtaaacaaagcgggacaaagtatcactgcttttgatcctttgcatctgtgtatccccttgtgttttccagtggggatggcagtttaatcagtggtatggtatcagcaatgatgcatcagaatagaagccccgctatagcactgaagcaggcttctggaggacctttctgcaccgacattaacctatctcatagtgtggtctaggtgaacgcagttgtgggggtggctagagccgggatggagttgctggggccaggataggagtagatgttcaagggctcaggacagtggctgtgggcctattgcactattttaataatggattttgccgtgccagtcacatcagccctgctttccagaatgcttttacatgcagtagcattcaaatttgttgagcaggcattattctcctcttttctctagattaggaaactgaagctcagaaaagtaaagtaacttatctggttatgactgagtcttttttagaaatgagacttagatttaacctaagagtcaacctaagatgacttctgtgccaaacatcataccagttccattgtttttcactgaatttatcttttttaaatccctatttaggcctgagttagatgcatgtgatgtaccagaaaaatatcctcagctatttcaggtgacactggatgtagaactacagccccatgacaaagtaatagacttaactccaccatgggaacattactgcacaaaagatgtcaatcccagcatcctcttctcttctcaccaggaacatcaagatacgctggccttaggaggtatgagtcacctgatggttttgtttttcaggatgaagcctctctgttatttatttcctgtgtctcattgatgctacatggtctttttgtcttgcaggacaggctccaatagatatccctccagacaaccccaggcattacggacaaagtggtttctttgcctctctctgttggcaaggtatttacaagtgtttctttaagtcacatggtttgatgattatgtatttcttctgtaaagatgttggccctagaagcagactacattaaagcagcacttagaggtcattcaatccaggcacacggactcccacctgtaagcccagcactttggaaggccaggataggaaggccaggagttcaagaccagctcaggcaatatagtgagaccctatctcaacaaaaaattttaaaaaattaggtgggagtggtggcaaatgcctgtagtcctagctatgtcagaggctaaggcaggaagactgcttgagcccaggagttcaaggttgcagtgagctatgattgcgccactgcactgcattctgggtgacagagcaaaactccatctctaaaaaattttttaaaagacatcattcaagtttacatccttccaattcattcccttttcaaatcaggcaacttccctactttcaactcagtagatgctcttagactgatgcaaaaggccattttaaactgaattctcccttctctctgctgtgtttttggtcacgtcattcctggactgacaaataagtgtgatttgtttatgatctccctttagactgctgcctctgtaatgagattaacacaggattctatcttccgctgtcaactaaatattataaaaatatcaaatcagcattccccccagggagccttaaccactagcagggcagaactgagcttaccctgctgcagagaaagcaaacacttggcctgtatatctctgctcttgctttaacagccataccagaaataagggctcgattactaggttcttttctctcaaacctggagatattttcagaatcctcctcaatataacacttccagctgctgccagcagtagcctgacgttggcatcctaatcaatacccattggctatccttgctttagagctggctgaggctaactgtgagattcagtgtagacgtgggtagtcagtgtttgggtatgaaaggcatgggaaactggctatggtatggtttatctgaaattatcctgattgaccttcctctgttgtgtgaatgtaagataatattcccatcgcctgcaggcttcagtttgatgaaaaagttgttcataaaattccgttgaattgaaagactcactttcagaattttctttcgagaaatggaactagcaaatcctcaaatttggaaaacccagtggtatctggacagtaggtagatttcttatcccctgttggcctttcttacctcttattttcctcacagcgagggcttttaatacaacttcactctttcctctccactgtcattttagcaaataatttagagataattcctgtagactctgaaataggttttagtatagatgcacagtctcttgtctgaacctctcagagccaggtatgtttaggaatgcagaactttttggattttagaaggatgatatgctacataaagtgatgtaacttgacatcccaagtgatatctcagataataacctataatcaaacatattaatatttctgcagtagaacatataaacaatagccctaagtgagataaatgaagactataagtatcttcatattcacgtctgtcagttttccaccaactgaattcatgccaaacttaggaaaatcttttccttttcatagcttattacattttataatttggaataaaggatgtggatccatacttgacttggaatgtgggtctatctggcattaaatatcaaatttttgtgggaagatctatctcagggagggcttagaaggtcactccttccccagaggaggcctctttcctgctgctcattttgtgctgaaagtacccctttcaagctggtataaggacctttcacagcagagctcttcttttcactttttaaatgtgtggttcacttctgctccagactgttagagaagggatttgcttttggctacaggacacatggagaagtaaagacagtgagaagtgtcagcaaatgactagcagataatggtttgtactaccctccccggccaaagcacctagcatagtgcctgaaaaaaaaaatcaacacttaggtactacttactattgattggagtgatttataatatcatctcatgtatttctcacagtagcctgtgagttaggtactatttatttatttagacacagtttcactctgtagcccaggctggagtacaatggcatgatcttggctcattgcaacctctacctcccgggttcaagcaattctcatgcctcagcctcccgagtagctgggattacaggcacacgccaccatgtgcagctaatttttgtattattagtagagatggggttttcaccatgttggccaagctggtttcaaactccttacctcaagtgatcctatctcagcctcctaaagtgctgggattacaggtgtgaaccaccacgcccggccgttaggtacaatttgttatccccactttgctgaggaggaaaccaaggcacagagaagtaaagtaacttgcccagtgtcatagagccagtgagtagtgaagctgagattcagtcctaggctggctccagagttcctgctccttacccctatgctctactgcctctcagatgctcaacaagtggtagttgaatgtaacgtgaaatacatcaagtgttccactgattagggtctaaaaacactgtttgctcagggctgaatccttctgtctttctggaattatatacatatattataacaaaaaccaacaatgctgtggtcagcaactaatctcttatggtatactggccttcctcagatcagaaatcggagaagtcattctgtgaggaggaccacgctgccctagtgaatcaggaaagtgagcaatcagatgatgaacttctgacactttccagtccgcatggcaatgccaatggtgacaagcctcatggagtcaagaagcccagcaaaaagcagcaggagccagcagcccctccaccccctgaggatgtggaccttttgggcctggaagggtctgcaatgagtaacagcttctctccgccagcggctcctcccaccaattctgaactactgagtgacctgtttgggggtggaggtgcagctggtcccacccaggctggacagtcaggagtggaagatgtgtttcatcctagtggacctgcgtctacccagtcaacaccacgccgctctgccacctccacctctgcgtctccaaccctaagagtgggagaaggtaattttttctatgttgcactgtgcctctcagatttgaattctaacctttgggccaaataggtggaattgaactttcctaataagctagacttttctgatttcactgtaagtcctttagaggaggtctgtatctttatttaaattgagagcgtaagagaaaatagaaatattgtccatttgggtagcacactaaggtagtgtaagagtggacgtttgagcttcacactcttacttctaattttctttgtttagcacttcaacccctgagctgcattagtctgcttaaacatactgattgatgaattattattgataaaaatagctaatatttatgaggtatttactatttgccagacatggaatttaatactaaacattatttaattcttacagaaactcaataaataagggctatttttatccccattttatagttgaggaaatggaagcatagaattaaatcagtagcataggtttatatgactagtaattgataaggccagtgtccaaacctaggttatttgactctagggctttccctctgttttcctataacggcttcctgaagttatagttttctgaatatatgtgggctatccagagaagtgtttggttatttgaaaatatgtttaagtgactcatgccggaagcacagcttcctagaacagagcagttggtactaggtaaggagtttgagccccttgaggctctgttagtttcactgtctcattgccagagactcaaaccttctactatgagtcatctaggattttttgacatttataagacagtgtagttgggtaagcagagatccagcacagctcctgaagaacccactcaaattagctgccccttggtcctgtcaccattaaccaagatgacttcacattaggaagggtaaagagaaatgtctcaactcttcaggcctatagtatcctataggaacattttttttccccaagcgtatccttcccagaaggctctgggctggtcttgacttgtgatagttcagctggaggcatccttcatgagtgtgggtctcagaattacagagtattggtgttgaggctcaagctccaatgttagctattggtggacccaggatgtgaactcaggtgccctgaatcctatgccaatgctatttcatctgtacttcacttccttccatacagttttaacttgccaaagtgaaaaaaagctctgtcaggaaaacagtttccaagatccaagatatcagtactcgataattgcattttaagactgtgcacctggtgtgactctcatgatttcattcatcatagtttcaggcagctagtggaattccagtgccagaaggggccttagacatcagttaattctctgcctcatgttatagacaatgaaactgaggcttagatgtattgattgacctgtctgaggatacccactggattagtggcatacccaggtctagaatgcaagtattctatccccccaagaggaagtagaaagaacaccaagtctagagttaaagacctggatttgaatcccaggacttaactgtctgtgtaacattattgaaaaatcttctcagttgtaaaatggggataatagttacatattagcattgttgcaaagactaaattttgagctcttgtcttgtggtgttgggcagttttagttattggagaatgcccctagtttaacataaattgatattttaaatgtactgagtatggtaagaagggataaggctagataacaaataaatcctgctcttaaaaccgaggtgggatatatggcttaatacgttttcagctaagacttcattggcataatgctctcctaacaactgctgggcagattagccttgtgtagcagcaatggtatcgactgtagttcatccaacaggtaagtccagactactcctttgtccacaaagataggaaattcttggagtccactgttagccctacaggaagtgacaattctgtgacatttagtgaatgaactcatgggacaaataaatatattttcccattgttttctaggtgccacctttgacccatttggagcaccttctaaaccatcaggtcaggatttgctgggttcttttctgaacacatccagtgcttccagtgacccctttctccagccaacaagaagtccttcgcccacagtacatggtaaggaaatattttatattgtgttcagtggaacatagttttctgcaagatatcagtaagtgctcatatataaaagcaccctgtgggtgcttttttgataaaagcttcctcacacatctctgtttttgaaattaacaactcaccttaacatatcaaaatctctgggctgtcttacaggacagaaacctgcttaactttgttttgctctgctttcctatttgactatggtatccttttttgcattagagctacatggacagaatcataaatgacccttgattgtaggacatatgattattttatgtaccaataagaaagaaaaaaacactgccactatgaaatgattggaagatacttcttggttagagaaatctttgaaatgtgggaaaatatgtcttaaataaataaaatatgttagtagtccacaaaattggtattccaaagaacaaagtttgggatatgatagccactagttacgtgtggctgttgatgactctacatgtggctagtctgatttgagatacactccaagtataaaatacataccagatttcaaaacttagtacaaaaagggcatgtgaaacatctcatcaatatttttatattgatcatttattaacataatatattgaacatactgggttaaataaactatattattaaaaataatttcaatagtgtctttttactttttaaaatgtgactgctaggaaatataaaattacatatgtggcccaaattatatttctatgttagagacttaggttgtatagaaagagtaataataatcacatccatttataaaagtgtgtcacttaggtaacattgattaaaaccggaggtctgcagtgagggataaataactttgagccagagagttgtagctcattcctgatgtcgaagtctattgaacattattggccacaacctagaaggtgacgtattgttgaaggcatcctgagcttgcttggagaatgcagtccagtcatcagttgactttgggaaaccatgccaatgcaaaaggaagatgacttttgcaacactggtgaaactgaaacttgactaaaaaagattccaggaacaacttttgtggttcatttccaactagtctttaatctcaaactatttgaagtgcatcctcaggacaatatacaagaaattcccctcttacctctgagtcatgctcacttgagagagtctcctgattggatgttgactacctgtaggagaaaagatgcaggaatgtagagtagagttggttttctcactcatttaaaatgttaagtcatgtcattgctctgctcaaaatgcctccccattttactcagcatgaaaaccaaagtccttgaaatggcctgtgtagcctctgtatgctctagcatctcagtgcccgtgacctcatttcccattctttcccactttactctctgcattccagctgtactggcctctttgctgttgcactggctgtttcctctgcctcatactcttccccaggcatctgcatggctaagtccttcacctccttcaagtgtttgctcaaatgtcaccttctcagtggagtctactctgattcctccgtttcaaattgcaactcgtctccctgccctactctacattcccctttctgttgtgcttagtaacttccagtatatgcagtaattaacttatgtgttacatttttttgtcatctctctctctctattagaacatgaattccacaaaggcagggaattttgttttgttcattaatgcatccatagtgcctaaaagaattaccggcacatggtagctgctatctatctttccaatattaaatataaaatgaattaactcatttttcccatcaaagtttctttgatgcacagtgatagtgtcataaggctatatgttttcctgattttaatactttgaaattattgttttaataagagtactaccctttgtgtcccatggacgtgggtgttcatacttggcagcttggcagttttggatccagttttctgtttctgatgagctgattagaacatggtgtttataacccagtttaggccagttagtactcctttgttttgtggttacatttctcattttggtctgtattgtactagcgagtggaaagaattttctcctctccttgttgggaaagcaatgatcatttcactgttactgaatcaactccccgtcttcacataggacagaatataggtgacactcagatgtctgctttgggaggtcagacatcctcagggtacttcccccgggtttctgcaaggcgtcgccaatctctcatgaaaataaaaaaaatactgcctttgggctcaacaaatatttattgaacatctattctgaagagaataatcacttgggacatgatgttggaagaacaaataaataatcataataaaaggcaaaatagagactaaaatattaggtaattacctttttgaaaaaatatattcctgtttctctaacagaccttaagtttcttgaggatagataatgcatctttcagtctctgtcccctgatgtggtgccttgcatgtggtaggtagtcataagggtttgtgggtttgattagcaacagggttgaagttctgatacctacttctgcgtcttaattggatgtaagactaggatcagagcttaaaggaaatcagatagaacgtactagcaaaaccgtctaacttccacctcagtggaatgggttactgtgtaaaaatagaagggataaatagaaaagaaagaattattattgctgataatggcatatcctttttaacttaatgatgggaaggtactagatgacttggttggtactaagtaaacaaaacaaggaaataaaaggtttggaatgctaatcttgatgccttctggtggtgatggggtgtgtgtgtgcgtgtgtgtgtgttttaaatcccagttgcaatgtcagtttagtatttgcattttaataattgatttgtgtgggcaaaacctagaggtgcctcagaaagaaattcttcatcatggcatcctgtttcctatatagattttatagatgtgtaaaaaacttactacgcacatgtattcctctagtacacctgattccttttagccaaatatttcttttaaattatatgtttggaactttgagggggggtcagaatgatttattttgaagctgtaatgagtttattttgagtaccatagacacatccctgacaaccagcatagtgatgatgtatagccagtgcccagtacatgttctgcatgactcattattctcaactcatgtcacagcagaggagaaaacaaaatgtcagttttgagtggattatgcttctatacttaatgcttagcaaaggtaaactgagcttaaggtgttttcccccttttcttattgcacactgactctgtgttaaatttagaggtgggacacacacacataagatagttctttcctgacttcgagggactgacaattgaatggagacagacacatgctcaatgataactcaaagcgtgtggatatggaggtaaaaccaaagtgagacaaagaaggagcagagacaaataatatgtcgtttctgtcaagcctcatgtgaacaaccagaggtgaaggcagaacatattgaatgttgcagagtgtggcaagaactcagaaggaggagtggatatcttgggatcttgctggggccatgcaggcttcagggatggaatggcattatcctgtgtgaactcagaaaagtgggttctgagctctcttgttctcattctttttcttttccccatttgcagcttctagtacgcctgctgtgaacattcagccagatgtttctggaggttgggactggcatgctaaaccaggtaaaagcaggttattttctgtacacatttatataattgcaaaagcataatccttacccaagatgaagtgagtactcacagagtattgtggcctacctgtgtaatttgtgtcactttttcctaaagattcatattctagaagagcttttcccaatgcacttgatgacatgatagtgctacttatcatacaccatttaacttttctaaatttcatttgctgaatgtcttatcttgacaatagaatcagacggatataaatatatatcaaactctatcacttagaaactcttgggtttttttggcaagtctgagcctcagttttcttatctgaacaatggggataataattttggtcccacatagttgtgtaagtttaaataaaaaaaacttatataagaatttctggcacagtgtagatgctgacaaatgtgaatattcttccttctttacaaagtacttacttcagggtgggatttgtctgtcatcaacaaggtctcctcctcatgaccactatggcatttatggagctgtcttgtgtgactgctcctgacattgagcaagttaagtgcacgcgtgcacatacaaacacatacacaatgggcttatcacaacaactttctgaagcagttgctgtttcctttttttattgtagcaaccccttccccacaacgtaacatttaccctgccaataatttccaagtatacaatacagtattatcagctacatgcactttgttgtgcaacagatccccagaacgaacccacctccccactgaccttctcacataactgaaactctacactcactaaataactccctacctctgcctccaccagcccctggccaccacccttctacatgagtttgactactttatatacctcccataagtagaatcatacagcatttgacttttgtggctggcttatttcacttagtataatatcctcaaggttcatctgtgttgtaacatgtgacaggatttccttctgtttttaatttaaaaattttttttggctggggcgtggtggctcacgcttataatcccagcactttgggaggctgatgtgggaggatcccttgaggccaggagttcatgaccagtccgggcaacatggcaaaaccccatctctacaaaaatacaaaagttagccaggtatggtggtgtgtgcctgtagtcccagctacttgggaggctgagatgggagaattacttaggcccaggaggttgaggctgcagtgagccgagatcacaccactgcactccagcctcggtgacagagtgagaaacctgtctcaaaaaaagatttttctttaaattgacagataaaattgtatgtatttgtcgtgtacaatatgatgttttgaagtacacatacactgtgatatggttaaatgtagctaattaacaaatgcatttcctcacatggttatcatttttgtggtgagaacatttaacatccattctctttggatttttcaagaatgtagtagatcatcattaactagagtcactatgctgtacaatggatctcttgacttattcctcctttctagctgtaataatatatcctttaaccaatgcctcctcatccctgccctacctccaaccaccccagcacctggtaaccaccattctactctttatttctatgagaccaacttttttagcttccacatgtgaatgagaacatgcagtatttgtctttctgtgcctggcttatttcacgtaacataatgctctctaggtttatccatgtcatctcaaatgataggaattcttcctttttatggctcaatagtattctattgtgtatatacaccatattttatttatccattcatccattaatggacacttaggttgattccatatcttggctgttgtgaatagtgctgcaataagcatgggagtgcagatatctctttgacatactgacttgatttcctttggatatatacccagtagcaggattgataaatcatatggcagttctatttttaatattttaaggaatctccaaattgtttcccataatggctgtactaatttacattcccaccaactgtgtccttttttctctacatccttgccaacatgttttttgttttttttaatagcaattctgacaggagtgaggtgatatgtcattttggttttgatttgcatttctatgatgattagtgttgttaggatttttttatacatctgttggttttatacgtctgttggttttcttctggtattcatctgtatgttttcttctggtaattccatagttttgggtcttacatttaaatctttaatggattttgagctgatttttttatatggtgagagataagagtctttttaccctgttgccttcttattctgttgattgttaccttccctgaacagcagtttttagcttgacaattgtcccatttgtttttcttttgttgcctgtgatgttggtttcatattatttctcttttttaaaactaatggtaaaatgctgaagctcaaagatgttaagcaagattcccacggtcactcaggaattggcaaagccagaatccagatccagacctaacttcgaatcttataggaaagagtgaagtcaggtgacatgaggacctggaaataaaacaaacactggaaataatagttcacacttgtggcctggaaacagcatttgtcttttctgtggtctgtccttgttcaaggccaccattcacccaggtcagggaaacagggtctagcaacttcttagacattttcaaaccctgtcctaatttgcctaggagacaaataaacagtaactctggaattctgaatttcacaattcagcctcaaacaactaactcattttcaatgaccttatttccttttcaggaggctttggaatgggaagcaagtcagctgccaccagcccaaccggatcctcgcatggtactcccacccatcaaagcaaaccccagactctggatccttttgccgaccttgggacactaggtacaaactcagaagatcaagatacaaataacatttatttatagctataaagcctcaaatctcagtctttggtgttacagcaagctggtattgtcacctggaacctcaaatagtgtgtattcttaagctatcctctgaaacctgagattggctttttaaaaaaggaaagcgataatcagatgtggggttagaaatcatctttattgattcatttctccagtgcctaattctggatgtgtagcatgaataaagttagagctttcaggggctcatggcaacagagtttggctgcgcaaaagtaatgcgtagggaaacagtatgagacagggctggtcagatggatttgtgccacatgatgccaaccttgcagaacactaactgtgatgcggtgatgttacctgtgagatcttcacaccgttccccttctctccattaactgtggtgctctccggtcaatttgtaaaattctatacagaaaatagactcaagtatcgtatttccagaatattttcaccatatgttaatagatgttacaggataagtgttctgagagcaggtgagattgggaagcactggtttcagtggattttgattaccactaagagggacacagtatccagagttctcaaactgatttcaccaaggagcctgttttcaaggaggggttcactggactactatgttctgaaacattttcttcctcctttttccttcctcctctagggcagtgcagatttgttaaataagggtggggtagccctgacacaaaggtttatcttggctatattgatagtctgtgatctcagaaagccctactgaggcatttagagccagatggagggaatgtgagcctggctaccgttgttgtctgtaactagtgtcagcatctttatcttccattctgtactatttagatgtttttcccttttaagaactctcaaaattattttatgcagtcattttcttctccacctttctttgtatcttactgaaaatttcaaattttaaagtaatattatatcagatgaaattttacttcaataaaatctcatttattatttatttttaatgcatttaatgcattgattcatccaacaagtatttaaggcacttttgtgccttctaggtgctaggactgttttagtaaaaaaaataaccaaacaaaacaaaactcctgccttaataaaacttacattatagaaggggaatcaaataataaattaacaaatatataatgtcaaataatgaaaacaataaaaataacagttaatagttattggggccttactatgtgccaggcactacttaaagtgttttacatatatcatttcatttaatcttcctcataatcttttgaagtagtgactgttataatcctcgttttacagatgaggaaacagggacacaacaggttaagtaacatgcacaaatcacaagctttcaacaccaagaagtctagctctggagcttgcactcataaaaggtttagaggttgatgtagctgagtgtgggaaggggtatcagttcagttcatccagtcaatggttttctacccttgagcattaattccctcatttcacaggtatttttgagtacttattatgtggtaggcattcaggatgtaataaagaatcaaagctgatgatattcctgttctttgaaacttgcactacagtgggaggaagaaactttaatcaaatgtaaaatatccgctactgtaggggctacacaagatggagcattttttaaaaagctccccaggtaattctaatgcacaatcaaggttgagaactactgctttgcttttaatgaggactgcagtggtctctggatttagctaccactttgtatttctgtaagttctctgcttcaatagcattaacaattagacttgctgagcatggggagaaaatattctagaagggtagacatcagagagtcctgcaatgttgatgagccccatgagtgcggggtcagcgtctgctttttcaccactgtatctgcagcctggcatctagaggatgctcagtagtgtttcctaaattaatgaataactggcagtgtggtaggcatatggcaaggttttcttagttctttaggcttttctgtatttaccaaattttaaaataaaaaaaacacatatgttcagaacagagtaagcttccttaaatataaaatgaaaccccagtgtagaatgaataccaagttttaggtgtatgttcccgtgctattggcaggagggctctgggacataggaagaaggaattcatgctgctagttatggaatgagtggggcaatgccaagcttgaagacaagccctgtcattacattttcctatcaccaagtgtttattgagccctgaagatgtaccaggcatgtgcttattagcatatgagcttacattattttataatatataacgtctctttgtttgcttaattgtgtaatactttcctatagttgttgtgtctttacagtatacctgtgatatagacatagttttgattaaacagatgaagaaactcaggctcaaaggagtgagttttttttacccagctttagaagagcaaagattctctatatcctgttttcagctatattcttagtgcccagcatagtacatgacacttggtaatgctcatcaaatagtggtgaattagtgtatatatgtatgaatgaatgaagaacgaatgcaagaatgaatgacagagctgagactcaaactcagattgatggtaagtccagtgatcatgatgcatttccagcagggaaggaaagtggagccccaggatcagaatagggaaagtatctatagaaagaagagatagtaagggatgagttgtagtgaaaggcttagcaattaggagaggaattaaggattactgagtgcagtaaatgaacatgacatttggaggtaggatgcacatagtctaatcccagctccattaattggctgtgtgatcatgagtatatcaggaaacctctctgagccttaatttccttatttttaaagtggagccagtgatactacttacttcctaagagtgttgtgtagatctgagcagtaatgtacataaacacattttgttaactctaaagagctatataaatattagttattttattattgttactttagacttattacatgaaagggtctttggacatcagcacatttcagttttctcattttacctctttaaatgcaagccacagctggttttcatattttggacatagcccagcttgtatgcaatgagtgcttaaaagtttggagattatggaatcaagattctacttaaattcctggcacaaaataacatcattttcaaagcttgaataagatcctttgtcctgtttaaagttatcagaatgttgactgtttttgctctccttcagtgaaatgcaagtagtatgaagttaaaacctacttgtgaaatttcaaaacatctttatttactcttgggcactaaccatgctttataacaaaaaatgatgaatcctaataattgaagtttaagtagcaccttaatgagtggactgttttattccccattcttgtcatttggtggttttttttaaattttattctagtgaagaaacagaatctgctcagaagatggaagggtggggaaggatggcacagtgggaagagccagggttcttttgacctggaggcaaagatccagaatcaagtctcggctcagctacttgctgtgtgcctctgagaaaaatcacttaactgctctgacctgcagtttgttcatctgaaggaaaaatgaggccattaaaacatacctagaaatgttattgtggggatgaaggaaataatatgtatgcctgcaattgctttatctatattaggaagattacttatgctgtcagtcaagggaatgactattaaagccactgcaaacagtgtcttaagacacaagagttagaggccactcaaaatagttttaccttctttatctctttttttctttaggtagttcttcctttgccagcaaacccaccacaccaactggattgggtggaggattcccgcctctcagctcgccacagaaggcgtctccccagcctatgggtggcgggtggcagcagggaggtgcctacaactggcagcagccacagcctaagcctcagcccagcatgccccactcctctccccagaaccgacccaactacaacgtgagcttctcagccatgcctgggggccagaacgaacgtgggaaaggatcaagtaatttgggtaaggataatggtatgggacctagctatggggcagcctgtctatgttgtcatactgcctgaatgtgtctctctgaaggtgacagtattttctgggtagtttcaattcagtagtttctgagggaatcttatagttgtagagataaaacatgattcctacccccaacgctgtacctggaggctcctaggttgactatgctcctaacttttataccattttgtgaccgtgggctcacttggctgtttatctccagactggaaccagatggagggcagggactgtgtcttagttgccatggtatcattagcacctagcatagtgcttggcatagggtaggcactaaatgaatgttgaagggatatgagtggagaggtagatggatcttaaagctgttattcctttggaagaggaagtggaagaaaaagttggggaatctttcaagcacattggtcatatttgccctttggtcccagttggtggactgcatgtgtcttggaaaacttggtctttcttatgctctgcttggtggattcctgagatcagcggggtacctatgatggtgccaacacctgaggctggaggatactctggataggatcttgacaatgaatgaaaagtaatatttttgcataggaaggatggttagatttgagtttattaaaagcctattttggtacattttatatttcagctgattttgtcagaccctccaatgaagtacataggaacatggtgagggaagaggcctttctctctatggaacatggaaaggcaattcttatgctcttcctaatagctgtagctaacatttattgagtccttactgtatggcaggtgctatcctaagcatttttcatgtacaggcatccccctttatttgtggttttatttgcagtttcagttacctgaggtcaactgcagtctgaaaatattaaatggaaaattccaggaataagcaattcatacatttcaaattgtgcactattatgagtagcgtgatgaaacctcgcactgtcttactccatcctgcctaggatgtgaagcatccctctgtctagcacatctatgttgtattctctacccacccattacttacttagtagccatctcggttatcagatcaaaaaaaagagtactgtatatatagggtctggtactatctgcagttttaggtgtccactgggggtcttggaacataccgcctgtgaataagtggagggactcctgtattatttcttataatcttcaaaaccaaccgcatatcataggaagctgtgacacagatcgatgaagtaatttcctaagtttatacagcttataagcgacagagccaggattcgaaccctggcaatctggctccagaacccctgcccttcattgctaccctctactggctagaacacaggtgctcacaacaccagcatgttaggaattcagttgtcggggatatgtaacatcatgtttgttcttgactagcagggatatttcctggacaattccatagagtcatgccaattcccctccatttttgagtagatagatgtggggcgagtgacttcaatcagcaaatacttatggagcatcttcagtgtagaaaacattgaggatgcagcagggaacaagaaacaaaatccctagtttcagagcacttacatttcagtgtgtgcaaaaacaggtatgtgtatgtcttacagtatagagatagcaaatggttttcaactcaaaaactgattttggttgatttgaatcgactgtatggactgttatgttttggttctattttgttttaacaagcatttagatagccaggcactgttctaagcattttaaatgttaactaattcattttcaaaacaagtccataaggtgagtaatattcctaacaccatccccattttatggatgaggaagttgaggagtagagataataagtaacttgcctagattacatcactaataagtggcagagctggaatgcaaacccagggagttggggtccaaagtctttgttcctagccaccatgctcggctgcctctccaaacaaattgagaaagattaagaggctacaaccagacttggagagaaagagcaaagtgattgactaaaatatcaacagaatatgggcagagaagtggtagcatgcatgaatttcaagtaccaaaccgagatcccagtgccaacactgatatgagttagttataatctggagggataatgagtatcctcatctaaagagaaggtacagtggaaatggaattggatttggcttcatgatccagcctccagttttaaccttgccacatatatgattctggacaggttcattttcttcatctgtagaatggatgcaacagtctcttaccctactcacagggtaagcaagcatgagggttaaggactgaatgcatattaaaaacaccttgaagactccagatgctgtgagataatgatacagcattatgtttaagaatgaaaactgtaatgattttcaaaaattatattgcagaagggaaacaaaaagcagctgattttgaagacctactctctggtcaaggtttcaatgctcacaaagacaaaaaggggcctcggacaatagctgagatgagaaaggaggaaatggccaaggaaatggatcctgagaaattaaaggtgagtgaggcccctgacgcagcttgattatcctatatgacaaagtcatgtgataaagtcatgtgtatggagctatcgccatgagagtaacctattgtcttagcccattcaggctgctataacaaaataccataaactaggtggcttataaacaacaggattttttttttctcatagttaatgaaggctgggaagtccaagatcaaggtgccagccattttggtgtctggtgagggccatcttcctggttcatggatggtggtcttttccctgtgtcctcataggcagaagaaagaggtcttgctcaggcctctttcataaggacactaatcccatttataagaggtctgtctcatgaactaatcacctcccaataggaagccctaacctcctaataccatcacctctggagttagaatttcaacatagcaattttggggggacacatacattcagaccatatcacctataaaaggcatgatagtagatttctggtggccactctatttcatttggtctttgcagctgtgatttgagtacagctgtgccctttaatagcaaagtagctctgaggaggttgcacacactgtttactttctttaataaaataaatgttattccatgatatggcaatatagatttcttttgtttgcctgttcaaatgagcagtggcactttctaagaggtgattttgttattcagatggcattcacattctaaagatgagtcattagaatttgctggtaagaagaatgcattatttatgttttctctttctgctttgagagcttttttattaaaccagattgactgaagcccccaggatcttttctctaccgatagagaaatatttatgtacctgagacttaccaattcctgcaacattagacctggagctttggaaagtagaggagagaaaggctgagggaagtgtggctcctgtcttccccattgtctccctctacttttaaccaaagcagttccacttttctctctttctgattctggaggtttaggtaaaattagatttgaggtttttcctcaaatcaaatcaacatacttttttcctcaaatcaacatactgttttagcatgtttcagcattttgtttttttaagtttgcaattcagcgaatctaacccctttgtttcacagctgaaaaaaaaccacataacttcatagatgaagatgttgtatggacaggcggatgcggattagctgggaaacagagggtggttctgttgatgagtggtatgaggtctggaagagtttgtaaagatcaagagaattggaatgctcttcacagatggagaggttgagttcctatgtgacaaaatactaaatatgctgatactacaacaaactgaaagaggaggatgtaatctgtctctgtattaaagcatctgcaaaaccagtacttaaacagcaagtcaatcttaacacattctgaaaacatataccaccgttctgtataatttcctgacagatttgttgcagatgtatataatatacatctaatataacttagattctttgatacattttttagtacaatgtagggtctttcatttgcatgtttttcactccacccaatgtcacagaagcttaatatttcttccaaaaactttgtgcttcatctcaataaccgttgttcattaggcaaattcggacagtttcctataaaagaaagctgtttatttcatttaaaccatgtttgattatttaattggtacagggtatgtaattgtttgggagggtagctgtcattaatgtgactaaaccattcatccagcaacactcacttagctgaactcctgttaggtactcaatgctgatacagttttatgatccctctgacttaatcacctcatttgttcaaactgtgaatgttcatagttcaaataaatggctaaatgggtcaattcacgtaacaagcctttttgagctctgttctgcaccaggttacttatttggttccgagatacagtgatatataagaaataatacttttcctcaaacagctctgcctaatggcaggcaaagagaaacacacaattacaataaagtgtggtacatattatggtagaaatatgtttaaggtagagtggcccagagaagtttggcccttttttaaggtttacttatttagtgcagtatctaccctcatggagtttatattgagtataactctgggggtggggatgggagagaaaggaattcaaactcgcaaagtctaacagtgtgaaatttctcagcacccttttgaaagatgatagagttaaccagggagacaaggtaggagattgaggaggagaagcattccaggtagaggaaacagcctggatcatacaggttgccctaagtgttttgatgttgctggagcagaaggggtttctagagtcctagtggaaaccttctgaactagtaagtaagcatttgaatttcttaatcccctttgtgtttacagattctggaatggattgaaggcaaagaaagaaatatcagagcccttctttccacgatgcataccgtactatgggctggggagaccaagtggaaaccagttggcatggcagacctggtaacaccagagcaggtgaagaaggtgtacaggaaggctgtcctggtggtgcacccagataaagtgggtataacctgccctgttgtgtaacttgtcaggtccttgcttcattatcttatgagtatgtgttttactttaaatgtgctggttcatatggcctatttttaataaaattaagtcaatgagctaaaatcagatatttaaacaaatagttatactttatgaaatgagaaagacgatatcaaactatatattacaggggcttatttagagagagtaagatttacccagtgattaatttttagggctcagaagtaaattgtgtctgagtacggtggctcatgcctgtaatcccagcactttggggggggcagggtaggcgaatcgctcgagccctcaagtttgagaccagcctgggcaacatgacaaaaccccgtccctacaaaaaaaataaaaaaattagctggtgtggtggcataagcctgtagtcttagccactcgggaggttgaggtaggaggatcacttgagcctgggtgatcaaggctgcagtgagctgagatcgctccactgtactccagcctgggcaacagagtgagaccctgtctccaaaaaaagaaaagaaaaagtaaattgtgtcctggcttacaatagtaaggacaggctaagagctggacagaagaaaactcctttcctttagagatacagcagtatagttagctaggatggtaatgaaaaagcttcagaatgtagttggtaaaatttgtgagaatcaataaaatattcagaatggaattaaatttgccctctcttgattattactacattgattatgtcagtttatgttttcattgaagtatatatacatctaagggctctaccttgtcagaaacttcaagtaactcatggacaaatgaaatcatcatataatacatagaaacattcagcaagaagtgagtcatcttgctgtcacatagactataccagtcatatgacatgaagctatgatcgaagtgccacttgggaacacaggcttgaatttgatgcatatgattttcatctctccacatttttttgtactagtctgaaaagaagaattaatgagaagcaatggtagtgcttgaattttgatgaatcaaaagagaaggagaaacaagagcccagaaaaatccacaaactgtattccccattatgactctcaaagaactttttagaaatgggaaaatgggagttaaaaacagtcaatagagatgggctgtcatgaacctttgtcatttggcagatacgtctggagaacagagatacgtcttgtgctgcctgataagctctctgttgtctacttcttgatggattactactacccttgtgcatttctagggggaggtcattatggggaggttatagtaatttgggtcagatatagtagattaggctgaaaaggagaaatggccaaatagaaaaacatttccattgcttagagcccatatattggcagtgaaaaatttaatattaatgaaattttggtctgtggtatctaatgtgtgtttttgttttctctacaggctactgggcaaccctatgaacaatacgcaaagatgattttcatggagctcaatgatgcctggtctgaatttgaaaaccaaggccaaaagcccttatattaatttatgagcttttccatctctgctgcagacctgtgctaatgcttagtgtgtgtcacaattctgaggttttcgcagatgaaccaaaaactccagtaacatgttttcagtactaaaccgttaagttactcatgaattaatttctcattgataaggaatgtggatgtttggtttctccaaagttcccaccataaaagatccaaagcatgagaggaacttctagtcagatgaccttgcagaaccaccgcattccaccctgccctttggggagcctactcagcattctacctggggaaatggaaaacagaggccaccacccatgaaggcataacacccatcacattgtctgagaataggattaatgagcaaaagttatgataatagagttatatgatggtttaatggtttctagatttttcttggaaagatataatttgagcagtggctttatgcagactccaagaacaaaaccaccaggtatttttttttaagtaaaaatttactaaggcctttagcataatactgtaaatgtcttttggtcaagagaactaacaaatataaaggaacttgaaatgtggggagtgataatagtccagtgattaaactacagtccagtgattaccaccaactttctgactaagctaaaaatgaatgaaaatggtggctaaagaaaatagggactctgaagatgtcgaaatctttattcctggttaggaaggtgggccgctacccttctttccctttagaaaactgtgattaattaaataaaaagtcttactactataacaactctaaacctggtttaaatgaaacatctaattttgctgtaaggcttaatgctcttcttttgtttagccaagaaaacattcttagttggaaacaggtggtaaagtagtttggcctgttcacaacttatcaggaccaatatctagtgtggactcagtgttctctaggtttgtgagcagttgtggtaagagaatggaaggcaacactgaataggagttaagggaatggcacgatcacagtgagagagctgcactcacctgcagacccagtcagatggcttgtcagtatctgctctgaggaaccaggtcccacctccccacaaggcaaatctagacccattaaattattacagtgggcttttttgttttaaaagtggttggggatccacaggaacgacattcatacagggacatttgtgaaagcaaagcaagaatgaatgctttcccgatctcagactggctggattcagatcagtgtgttggctggttctcattttaaggggtaagcagtttgctattctgtgactttagtagatctcttttgtgtgcacatatacaatgtgcattatacatatatattaaatatatccacaaagcagatgggcaaaaagattttcatgctaatcttcaaaggttcatgctcaatattgtgaaaagcttttaaaagttgttttgaaaagacaatcattttttgtttttgttttaactttcttgtggcaagctataccggaaaagcggcatgtcaaaaatactttaggttctacatagatctctttctctcttttgttttgtttgtttgtttgttaaagttcattatttattttaccttttactgacaatgtgaaactcgaagaaaatgttctctttttaaatatacagtcataaactgttcaaggtaaccataacaaactaggtgttatttattaacgtattataaaataatgtttgatccagtatgtgcttgtcttatttaaaattggaatgtgagacatgttgctgtgacctgtttttctttctcattcacatttgtagatattgtgtgaactacagtatataatgataacaattaaaaggatattctgtggatgtcacgtattttgaaatgatagaactacattagctttgtatcatgtttggataattcatcaatgttcacagtttaaaacatcattaaacattatgtaattacaatgagaaagaatcttacttaaatttggagattttcccccacatctcttttccggatacattataattctggacccctatttatctcaaaactcttaatatatgcagaccaacaggtctttgcattccttttaaataactggttgtgacaaagcttgttgttgatcagattcactgtttcatcatatttattgtaatatattttttgttttgtaaatatgttacaacaaaatgtgattggtctaaaatatttgtaatgtatattaaaaggttcaaaaatatttgtataaatctaagttatttgggtacttgtaggaatacaatgaggagcttgaatgccaccttctgacatgatttacttttaaggaaagttatgaggagagaatacaaaaagcatgcaccaaaatgtaatctgacaggatttctggatttatacgtaatcactcctgccccaacacacacacacacacacacacacacacacacacacatgcacgcacacatgattttgattatgctacatgatatatgtttcaaaaagaattagcatagaaatcctggtctcctagccaaaaaaatcaaaggattttcaaaaaaacgaatctgtatgttgaggcaaaaggattgaacctggaagtctgggactttatcatagaaacaaagtctcagatattttagttctttggaaacaaatgctgtaattcaaaagcatttgacctgtcactgtactatctacatgtggaagaatgttcaagttgaatcctaatgccgtgaatgaaacacagtctgtgtagggaatgagcaaaaaagttgaattccaattgctttttggccttttggctaaaataaatgtagcatctaattttatcagttt

SEQ ID NO: 88 - DNA, 7562 bp, Homo sapiens
agtagcgaggccgggtctgaactatcaggcgcggcctctgcgagctgggggcggggttctgcaccggcgggggcggggttgtgagtggtgggggcggggtctggagcagcaggcgccgcgtttgcgagctaaggtcggagttctgcaccggcgggggcggggctctgcgtggccggggcgggctcgggatccgcggggcgactcccggtctggcttgggcaggctgcccgggccgtggcaggaagccggaagcagccgcggccccagttcgggagacatggcgggcgttaaaggtacatcgcggtccccggctcgcttgtcgtgtggtggggttgccacctccgttccggtcaagcctggggctgcgccttccgcgcgccgttggggaacggcctcaccacccttcccgcctctccggttcgggaggcgatcgaccgctcccttcgtcccttggggtgtgggtggagcggcgtttcgggggagccttggccctttttgcaaggccgctggccttcctgctctccagtggcggcaccagacccctccccagcctgagccctcggcgagagcggcgccctccacctctcctgagtttttaaacaaggtttccacttcttgacgccaccctaacgcctttcttctggttttctgcccctccgcagtttcctatttgccacaaaggaccctttgtctccagcgttcttagcattgggaaacttaatcctctttttcctaatgatttttccaactgggcagagttgaccgcgggcgggtgtcaatggaaagcacccagaaagacggtgtttctcgcagtcgtggagagtagattacgtgtaattttaatactgctttcttcggtgttttctctgtttatggacagagaagaaaccagtgtgtgtgtagtatgtgttttttgcatggggcagttggtaaaaacaccgcgtcccttatctgtatggcttcagagcaatgcgagacggaaaaggttttttgcaaggcttcctgtattttggtaggaaaacattccatttctaatctgtcgaatagagtagcatgacttgtttttatattggcttttatatcatccttgaaatttgcacccaaagatatccccagttaacatctgctataaacatgtagatagtatatatacgagtacgcctctgttcactatgaatttatccgagtatgtgagctgttagcagcagacattttatcgttatttctggctgacttttatacttaatatcagtttagtaaacatggtttacttggagagtgtcgactgtgttatatatccatttgaagccaatgccgaaaacagatgaaaagtagtgtctcagtactacacatgatcagaaactaccaaatcatgatcacgtttatgtgtgaatgtgttagaaaattgtgatgtagtgaaaaaaaaggaagtctgaaatggaaacggactaagggaaggaagcattttacagattgttcaacttttattgaggaactactgtatgccagagacttaggatacaaagataaatgagaagttattggtgggtgacagagctggaaataattatattactatgtcagtgtttatgttgggctcagatgcggtgggagaacagatggtgggttggattttgtcctccaaaaagatgtgttcaagctctaattccctggtacctgtgaatgtgatcttatttggaagtagtatctttgcagatataatcaaattaaaatgataactggtttaaggtgggccctaatccaatgactggtgtccttataagaagaggggaatttagacatagagacatacagggagaataccatgggaagacggagacagaaattggagtgatgcagctacaaagtcaggagcaccaaagattgttggcaaccatgctggcaaccactgagtgttaggaagaggcaaggaagggtgcttccctacagccttcagagggagtgtggtggcgctgctgacaccttgatttcagaagtccagcctccagaactgtcagaagataaatttctgttgttctcagccatccagtttgtggtactttgtaacggcagccctaggaagctgatgcaggtgggattgattcccctgctccagagaaaggactgttttcacagaagaggcgatgcttgaactgaatctgaagggatcaatgtggcttcccttggcaaggcatggagtgaaggtggagtatatcccaagtggggaggacagcacgtgacatggcgcagggcttatgaaacaacatgccttcttctcttcaggtacttaagctacattagtaagaccagaacttagtggtgagggttgaagctggctggacaggcagttaggagtgagtcaggcgatggtgagcctccgtgccagaacaacttgtaggctgtggaagcaaccgcaaagggatggcagcggtgatatatatagttgaaagatcactgtctgctgtgtagaggatggattggaagagtcacagaggcaggaataagaggttaagggcctgcaccagggctgtagcagagagtttaagaagtctgggagattgagtcaccttgacctactgattcattggaaggtggaatgcaatcatggtgtcagtcctctaagataggacctttaaagtgtagggatagtggtttggttttacacgtgttacacatgttgaatttgaggttcttgttggcggtcaaggcagagaagtccagactggaggtggaagtacaggcctagttctttaggacctactctgggctggagcatcagttgcggccgggcccttgtggtagtaggagctttgggttgaacataagttttcagcaggagtgcgtggagtgaaaagagagatggggttggatttttggtcaactccaactttaagagattcagaggatgtgattcctgaaaaaagaggaaaaaaaagaccaaaaagaatcaaacagaaagatggttgtgaacgttgagaaactggtatcagaacagaaggaagaggtctgcagtacctagctttgacaggcctcatggaggagggggtactgccgatggtcaggcacagaggagaggagcaaagcctgctgggaaaagatcatctgaatgaaatagtatgtggtatttgctttccatccacacatgggcattttccattaaagagtggaaatgtaaaaagatatgttaaaattgacagtgtttctttgtcccttaacatgtgtatactttcagatgttttttaaaaagcactttggcaccttcctattaaagagtctctctaaatcttctctcaagtaaaaggaagcaatcaaaaatgttcattggcttaattaattagtttaatactaattatgagtattatggacttttttcagaagaaaatttggataagatagtctcctatgcttttgatttctacctttatcaaagaacattgctaaaatgagtagatacctgagtcagtcagcatttatttggctacctccttttgccaagcactttacatagattatctcatttaattcccataagctcaataaggtggcaccattatttccattttacaggtgagaaatcaggttcagaggattagcttctacccaaagtcataagaccagatggtggcagagttaagatttgactcatgtttgtgactcagagctcaagattttgtaacaaccttgatactctgtttctcactcagcagcacaacaagggcaaatacgttcctactcccgcagagactagtgtccaatagatacagggaatacatattttattcagtgcacactagttgggaattgtttcctacaaagacatgaaaacaatcttcaaatacttgcagtactgtggtttggggaggcaaaatgatcaaaggtatatattacagggaggcagttctggatataatttaaagaaggagggctttcaacatttagaagctgttggaattaaatgacttgccttgggaggtagtgagttttccttcactggagttatgtggaccaactggctgccctctggtgacaaatacagagggaattcatccattggataggggttaggtactggaattacttgagacctttgtatactttatgatttcaaggtggcagacatgggtcattgtcttaatcagtttgggctactataagaaatatattttagactgggtggcttaaacaacaaacatttagtttccacagttctgaagactgggaagtccaaaattgtggtgcagtcagatctggtgtctggtgagagccagcttcctggtttgcaggcctgctttctgctctcacattggagaacagagggagagaaacacagagagagtgtgtgctctactttctctcttcttataagggcactcatcccatcgtggagaccccaccctcatgacctcatctgaacctaattatctcccaaaggtccacctcctgatagcatctcacggtgagagggatggagccgggaaggtttcaacatgtgaatttgaaagggacacacataatgcagtctgtaacgggtcaaatgtaacctcaataaaatgagtaaattgctacatttgcttgaatttgggacctttttttctttcttttttattttagtaaatgtttttattgataaatgattcacataccataaaattaacattcttaaagtgtaagatttcatggtttttagtatattcagaaggttatgcagccatcactactatctaattccagaaaatttactcatccgccaaagaaactctggacctattagaagtcactccccatttccccaaaccctctagtgcctgacaacctctactgtgggaactttaacttttggctttatttttcacagctctcgtggcattatccttcagtggggctattggactgacttttcttatgctgggatgtgccttagaggattatgggtaagttatcatttcaaaaagaactattcctctttctgtgtctttgtcactattagtatgggtgttagagagttcggtcaatttagcaccaagttctaaccagtgagttagtggagcccagtttatgaacacagtccctttgtgggtcaggtgtacttttgcagagggctctgttaaaaattgatgtattcattccataagcatttgtttaacacctactctggactagctggggacacacaaatgaagagagagtcctgtcctcaaagaggaggtaaagttctagttgtgagtgagagacaggcaaacggtctagtcagtaatctggcagctgcagtggagatgccagcacagtacgctggagctcggataaagtgcacctgagtttcagtgggacagtcagggaaggctgcatggcagaggttgtatctgagccaagactaggtggatgaataagagtttttcagggtgatgagtcaggggaggacattccaggcagagggaacattctacacattttttcattcaaccattgttggttgaatgcttcccatgtgccagctactgttatgggaactagggattaagacataagaaaacaaaggtcctgctctctcagagtttgtgtttcagtgggggagacggacagtaaacaacaaaagtatgcatactgtcagaggtagaaatggtacaaaagatgaagagcacagaagctgggaagacagtggtcagggagggcctctcagaggaggtaaaaagtgagaagaaatgtcaagaaaatcagcaagcaggccatacagatctctagggaaaaagcactttaggcaccaggaaagctgaatgctaaggcccggagacatgaaagtgtatatagccttttcaggaaaccacacatggtacattatggtacagcataaattgtagtggagtggcaaaagaagggttagtcaagagtgtaaaagtcagcacttagggctctatatgcctgccgtgtagaggaggttccattttatacatcagacaatagaacctgggaaaatatcttgagaatgggtttggaggagggggttatgttaaaatgtcattcttgccataacgtgagactagataggaaagagctgagactgcagtcagggagaatagtaggggactactatcataaatcaagcaaaattgagggctggggcagtaggaatggaaagaaaaggagagtgagttaggaaaccaaaccaaccaacaggttttgttcatcgatgtcaggattcaacaaggagggagagttcttagatgtctcccaggtgattggcttgaacaactagatagaagatgatgtgattaggccaggcaccatggctcacgcctgtaatcccagcactttgggaggctgaggcgggcagatcacgaggtcaagagatcgagaccatcctaggcaacatggtgaaaccccatctctactaaaaatacaaaaaattagctgggcgtggtggcacacgcctgtattcccagctacttaggaggctgaggcaggagaattgcttgaacacaggaggtggaggttgtagtgagccaagatcgtgccactgcactctagcctggcgacagagcaagactttgtctccaaaaaaaaaaaaaagatgatgatgatgtggttaagacctattgaagtgagttattatgacagtgatgaattcaaatccatcaccgcagtcctggccaactattacagaaattgtttaaacccaagagggatccagatataagcggtcacttatatttgtttagagccttcacagcaattactttattctagcttttggaatgtaatacggtattattatcctcatttctcgctgggaaaccaaagcccagggtagttaaagacttacccagattgaacagcagtaagtgacagagcccggccgtggtggctcatgcctataatcccagcactttgggaggcaacggtaggaggattgcttgaagccaggagtttgagaccagtctgggcaacaaagtgagaccccattctacaaaaaactaaaataagccaggcatggtgcctgtagcagggttgggaggctgaggtgggaagattggttgagcccaggggttggaggctgcagtgagctgtgatcacaccactgcagtccagcctgggcgacagagtgagactttgtctcttaaataaaaaagtagaaaaaaaattaaaatggcagacatggaaatggagctcatgttctgacgcccttgaccaaacgtttttccactattccacaaccaactgtaaatctaggagttttaattctctgtgatacactgtctttgtaaggtaagaaaatgactcattactgctactacaaataagtttgttttctatctttattttaattttttgttttttagagatgccacaacacccagctgattttttttagaagtttttgtagagaccgagtctctctgtgttgctcaggctggtcttgaactcctggcctcaagtcatcctcctgccttggcctcccaaagctgtatcttgatagtgaaccaggattatcatctatattggaagtcagcaaactgccacatataacctgctacctgtttttgtaataaaggttttattgaaataca

SEQ ID NO: 89 - DNA, 15560 bp, Homo sapiens
agtagcgaggccgggtctgaactatcaggcgcggcctctgcgagctgggggcggggttctgcaccggcgggggcggggttgtgagtggtgggggcggggtctggagcagcaggcgccgcgtttgcgagctaaggtcggagttctgcaccggcgggggcggggctctgcgtggccggggcgggctcgggatccgcggggcgactcccggtctggcttgggcaggctgcccgggccgtggcaggaagccggaagcagccgcggccccagttcgggagacatggcgggcgttaaaggtacatcgcggtccccggctcgcttgtcgtgtggtggggttgccacctccgttccggtcaagcctggggctgcgccttccgcgcgccgttggggaacggcctcaccacccttcccgcctctccggttcgggaggcgatcgaccgctcccttcgtcccttggggtgtgggtggagcggcgtttcgggggagccttggccctttttgcaaggccgctggccttcctgctctccagtggcggcaccagacccctccccagcctgagccctcggcgagagcggcgccctccacctctcctgagtttttaaacaaggtttccacttcttgacgccaccctaacgcctttcttctggttttctgcccctccgcagtttcctatttgccacaaaggaccctttgtctccagcgttcttagcattgggaaacttaatcctctttttcctaatgatttttccaactgggcagagttgaccgcgggcgggtgtcaatggaaagcacccagaaagacggtgtttctcgcagtcgtggagagtagattacgtgtaattttaatactgctttcttcggtgttttctctgtttatggacagagaagaaaccagtgtgtgtgtagtatgtgttttttgcatggggcagttggtaaaaacaccgcgtcccttatctgtatggcttcagagcaatgcgagacggaaaaggttttttgcaaggcttcctgtattttggtaggaaaacattccatttctaatctgtcgaatagagtagcatgacttgtttttatattggcttttatatcatccttgaaatttgcacccaaagatatccccagttaacatctgctataaacatgtagatagtatatatacgagtacgcctctgttcactatgaatttatccgagtatgtgagctgttagcagcagacattttatcgttatttctggctgacttttatacttaatatcagtttagtaaacatggtttacttggagagtgtcgactgtgttatatatccatttgaagccaatgccgaaaacagatgaaaagtagtgtctcagtactacacatgatcagaaactaccaaatcatgatcacgtttatgtgtgaatgtgttagaaaattgtgatgtagtgaaaaaaaaggaagtctgaaatggaaacggactaagggaaggaagcattttacagattgttcaacttttattgaggaactactgtatgccagagacttaggatacaaagataaatgagaagttattggtgggtgacagagctggaaataattatattactatgtcagtgtttatgttgggctcagatgcggtgggagaacagatggtgggttggattttgtcctccaaaaagatgtgttcaagctctaattccctggtacctgtgaatgtgatcttatttggaagtagtatctttgcagatataatcaaattaaaatgataactggtttaaggtgggccctaatccaatgactggtgtccttataagaagaggggaatttagacatagagacatacagggagaataccatgggaagacggagacagaaattggagtgatgcagctacaaagtcaggagcaccaaagattgttggcaaccatgctggcaaccactgagtgttaggaagaggcaaggaagggtgcttccctacagccttcagagggagtgtggtggcgctgctgacaccttgatttcagaagtccagcctccagaactgtcagaagataaatttctgttgttctcagccatccagtttgtggtactttgtaacggcagccctaggaagctgatgcaggtgggattgattcccctgctccagagaaaggactgttttcacagaagaggcgatgcttgaactgaatctgaagggatcaatgtggcttcccttggcaaggcatggagtgaaggtggagtatatcccaagtggggaggacagcacgtgacatggcgcagggcttatgaaacaacatgccttcttctcttcaggtacttaagctacattagtaagaccagaacttagtggtgagggttgaagctggctggacaggcagttaggagtgagtcaggcgatggtgagcctccgtgccagaacaacttgtaggctgtggaagcaaccgcaaagggatggcagcggtgatatatatagttgaaagatcactgtctgctgtgtagaggatggattggaagagtcacagaggcaggaataagaggttaagggcctgcaccagggctgtagcagagagtttaagaagtctgggagattgagtcaccttgacctactgattcattggaaggtggaatgcaatcatggtgtcagtcctctaagataggacctttaaagtgtagggatagtggtttggttttacacgtgttacacatgttgaatttgaggttcttgttggcggtcaaggcagagaagtccagactggaggtggaagtacaggcctagttctttaggacctactctgggctggagcatcagttgcggccgggcccttgtggtagtaggagctttgggttgaacataagttttcagcaggagtgcgtggagtgaaaagagagatggggttggatttttggtcaactccaactttaagagattcagaggatgtgattcctgaaaaaagaggaaaaaaaagaccaaaaagaatcaaacagaaagatggttgtgaacgttgagaaactggtatcagaacagaaggaagaggtctgcagtacctagctttgacaggcctcatggaggagggggtactgccgatggtcaggcacagaggagaggagcaaagcctgctgggaaaagatcatctgaatgaaatagtatgtggtatttgctttccatccacacatgggcattttccattaaagagtggaaatgtaaaaagatatgttaaaattgacagtgtttctttgtcccttaacatgtgtatactttcagatgttttttaaaaagcactttggcaccttcctattaaagagtctctctaaatcttctctcaagtaaaaggaagcaatcaaaaatgttcattggcttaattaattagtttaatactaattatgagtattatggacttttttcagaagaaaatttggataagatagtctcctatgcttttgatttctacctttatcaaagaacattgctaaaatgagtagatacctgagtcagtcagcatttatttggctacctccttttgccaagcactttacatagattatctcatttaattcccataagctcaataaggtggcaccattatttccattttacaggtgagaaatcaggttcagaggattagcttctacccaaagtcataagaccagatggtggcagagttaagatttgactcatgtttgtgactcagagctcaagattttgtaacaaccttgatactctgtttctcactcagcagcacaacaagggcaaatacgttcctactcccgcagagactagtgtccaatagatacagggaatacatattttattcagtgcacactagttgggaattgtttcctacaaagacatgaaaacaatcttcaaatacttgcagtactgtggtttggggaggcaaaatgatcaaaggtatatattacagggaggcagttctggatataatttaaagaaggagggctttcaacatttagaagctgttggaattaaatgacttgccttgggaggtagtgagttttccttcactggagttatgtggaccaactggctgccctctggtgacaaatacagagggaattcatccattggataggggttaggtactggaattacttgagacctttgtatactttatgatttcaaggtggcagacatgggtcattgtcttaatcagtttgggctactataagaaatatattttagactgggtggcttaaacaacaaacatttagtttccacagttctgaagactgggaagtccaaaattgtggtgcagtcagatctggtgtctggtgagagccagcttcctggtttgcaggcctgctttctgctctcacattggagaacagagggagagaaacacagagagagtgtgtgctctactttctctcttcttataagggcactcatcccatcgtggagaccccaccctcatgacctcatctgaacctaattatctcccaaaggtccacctcctgatagcatctcacggtgagagggatggagccgggaaggtttcaacatgtgaatttgaaagggacacacataatgcagtctgtaacgggtcaaatgtaacctcaataaaatgagtaaattgctacatttgcttgaatttgggacctttttttctttcttttttattttagtaaatgtttttattgataaatgattcacataccataaaattaacattcttaaagtgtaagatttcatggtttttagtatattcagaaggttatgcagccatcactactatctaattccagaaaatttactcatccgccaaagaaactctggacctattagaagtcactccccatttccccaaaccctctagtgcctgacaacctctactgtgggaactttaacttttggctttatttttcacagctctcgtggcattatccttcagtggggctattggactgacttttcttatgctgggatgtgccttagaggattatgggtaagttatcatttcaaaaagaactattcctctttctgtgtctttgtcactattagtatgggtgttagagagttcggtcaatttagcaccaagttctaaccagtgagttagtggagcccagtttatgaacacagtccctttgtgggtcaggtgtacttttgcagagggctctgttaaaaattgatgtattcattccataagcatttgtttaacacctactctggactagctggggacacacaaatgaagagagagtcctgtcctcaaagaggaggtaaagttctagttgtgagtgagagacaggcaaacggtctagtcagtaatctggcagctgcagtggagatgccagcacagtacgctggagctcggataaagtgcacctgagtttcagtgggacagtcagggaaggctgcatggcagaggttgtatctgagccaagactaggtggatgaataagagtttttcagggtgatgagtcaggggaggacattccaggcagagggaacattctacacattttttcattcaaccattgttggttgaatgcttcccatgtgccagctactgttatgggaactagggattaagacataagaaaacaaaggtcctgctctctcagagtttgtgtttcagtgggggagacggacagtaaacaacaaaagtatgcatactgtcagaggtagaaatggtacaaaagatgaagagcacagaagctgggaagacagtggtcagggagggcctctcagaggaggtaaaaagtgagaagaaatgtcaagaaaatcagcaagcaggccatacagatctctagggaaaaagcactttaggcaccaggaaagctgaatgctaaggcccggagacatgaaagtgtatatagccttttcaggaaaccacacatggtacattatggtacagcataaattgtagtggagtggcaaaagaagggttagtcaagagtgtaaaagtcagcacttagggctctatatgcctgccgtgtagaggaggttccattttatacatcagacaatagaacctgggaaaatatcttgagaatgggtttggaggagggggttatgttaaaatgtcattcttgccataacgtgagactagataggaaagagctgagactgcagtcagggagaatagtaggggactactatcataaatcaagcaaaattgagggctggggcagtaggaatggaaagaaaaggagagtgagttaggaaaccaaaccaaccaacaggttttgttcatcgatgtcaggattcaacaaggagggagagttcttagatgtctcccaggtgattggcttgaacaactagatagaagatgatgtgattaggccaggcaccatggctcacgcctgtaatcccagcactttgggaggctgaggcgggcagatcacgaggtcaagagatcgagaccatcctaggcaacatggtgaaaccccatctctactaaaaatacaaaaaattagctgggcgtggtggcacacgcctgtattcccagctacttaggaggctgaggcaggagaattgcttgaacacaggaggtggaggttgtagtgagccaagatcgtgccactgcactctagcctggcgacagagcaagactttgtctccaaaaaaaaaaaaaagatgatgatgatgtggttaagacctattgaagtgagttattatgacagtgatgaattcaaatccatcaccgcagtcctggccaactattacagaaattgtttaaacccaagagggatccagatataagcggtcacttatatttgtttagagccttcacagcaattactttattctagcttttggaatgtaatacggtattattatcctcatttctcgctgggaaaccaaagcccagggtagttaaagacttacccagattgaacagcagtaagtgacagagcccggccgtggtggctcatgcctataatcccagcactttgggaggcaacggtaggaggattgcttgaagccaggagtttgagaccagtctgggcaacaaagtgagaccccattctacaaaaaactaaaataagccaggcatggtgcctgtagcagggttgggaggctgaggtgggaagattggttgagcccaggggttggaggctgcagtgagctgtgatcacaccactgcagtccagcctgggcgacagagtgagactttgtctcttaaataaaaaagtagaaaaaaaattaaaatggcagacatggaaatggagctcatgttctgacgcccttgaccaaacgtttttccactattccacaaccaactgtaaatctaggagttttaattctctgtgatacactgtctttgtaaggtaagaaaatgactcattactgctactacaaataagtttgttttctatctttattttaattttttgttttttagagatgccacaacacccagctgattttttttagaagtttttgtagagaccgagtctctctgtgttgctcaggctggtcttgaactcctggcctcaagtcatcctcctgccttggcctcccaaagctgtatcttgatagtgaaccaggattatcatctatattggaagtcagcaaactgccacatataacctgctacctgtttttgtaataaaggttttattgaaatacagccatgctcatttgtttatgaattatctttggctgcttttgcattgctctgccaattatctttggcagagttgagtagttgagatagtctttatggcttgcagatcctcgttatttactctttggccctttatagaaaaagttggcccacccctggcctatgtatttattgaattgtatatatttaatatttacattttatatataaacaaggtttcttgtacattaatatttctcttagttggatatcggtggcttactatgaatgaaaacatagagtcagattgtttttcacaaaactgtcactgtattccaggaaaaattaagagttcttggctgtggatatgtaaggtgacatatctattccaaaccccttcccctctctgtgtctcctttctcactgttgaaagaagggctttgaagtagagaatgtctaagggctacttcccacaatattgtttggtgattcttgaaacatactatcatccctctagtttaaaatcaggggtccaaatccactgtttccatcctgagtcctcttgaaggacacattcccttcttgccttttggttgcctagatctgtggctggaatgggaggctttcattagtgtggcttcatcccaactcctgcttgtaggtgctgtctgggcgtatctgtgtgattacagtattgtggtgatatgaattattgtagtgtatatataaaaatgagcagagactttttttttcttaagaaatgaagcataagaaatgtctgatggagaaaaaaagattatttttgaagtactgatagagaaaatactgttggaaaccagatggcaattttttttttataattgcaaaatgttgaaatttgggaggaaaacagttttgttttgtttttgcattacactattaattgtgagctcttataatgaagatcaaagtacatctaagcttttcactagtgagcatatttattttcatgccttccgtacttaaaatttatttattattttattcatttaacaagtataaatggagtacatcattctaggccctggagataaatggcgtttgatcaagactaatctatcagatgggaataagtgttgtgcagaaagttcaaagagggtggtatgttcgagggtgacctggggtacattagaatagatgaccagggaaagttctgcttttagaaaggaatctgtcagtttagatcacatggtatgaaggagtcagccaatgagaagatcatggggaaggacattgcaagcagggggcacagctagcgcaaaggccccaggataacagctatgagctcaagagtgttcaagggacagaaaaaaggctggtgtggctacagattaagcaaatgaagggaaaagagtacaaaatgaatggaagaagtagataataccagaccataaaggctttgtaggctagggcaaggaatttagggtttattctaagctcttaaaaggtttcaagcatgcgtgcactcaaaagatctttaccgaactagcttttgcaagacactctactatgttctatagggaaggcagaaatgaccaagttaaaattctgtctttaaagaaattgtggctcagtggtacagaaaacagtaaagtttctagggtatatattatatagtggcttcttaacacaatataagctacctacatagtaattttaaaattatcactacttatctatccctggtagaaatcatcttatgttctaatattcacaattaattaattttttgacctaaacatttaaaatagcaatgattttgaaatagtagtatgtctttcatttaaaatgtaactgttacttttctttttggattttgcctgggtccaactgacagcgtttactggcccttattcgtcctgattttccacgccatctcccccatcccccatttcattgccaaaagagtcacctatgactcagatgcaaccagtagtgcctgtcgggaactggcatatttcttcactactggaattgttgtttctgcctttggatttcctgttattcttgctcgtgtggctgtggtaagttttattttctattgttttgcccaaccgttgctgagtttacttcagaggcctgtgtctgggacctccatttcatgctcattacttaggctttatactcaaggccgtgtgtttttagtttctctgttcctctactttagacctgcctaacagtagttcggccatgccttcagagtgctttctttatttctcttacaacttttagccagacgatatgatttcttactttttctactttaagctattctctggaattgttcttaaattcctgcctcttaaatcttacagtaatccacagatactatgctagcagtacttttctagttgcaagatgaagatatttcaaattcttctcctgcaaatgggatcatggactcaactctcaactcagtataataggtatatgttgagggacaactgtgtagcttccagaaaatgcagtgaataagttgacatcttcacttccaagacaaaaactttctttttgtcttcagagtacacattgtaggtataatttattcaattatttgctattcactgtctttcctactatttgattttattccctccaattacgttctattttaattttatgaaactcttatttgaggcattgaatatcagataagcgcaagtcttgttcattcaataaatatctttgcaacaactgctacttgtaaaacaccagaaataagaaataggtactgtctctgctcctgaggaacacagaaactagcttgctgggtaagtatactataagtgtactaagtgagacggttgaagcatgatcagaatgccataggggcaccaagaagagagaaattccgactggcatttgatatgggcctctaaggataaatagcatttgtattgaggtaggatggctgttgtatggaatgacattcaagtgtaagaatgcagtatatagaataaagaagaatccagtgtggtagagctaaaagaaagttgttgaggttaaggctggaagggttgtgaaacctgattagcaatggtcttgaaccccatgccagtttgatctttgtctagataatggggaaagattgaaggtttttgaatacaacaagattgtcatgactttatttttcttgtgctttagaccagcccttcttaagcgctgcagtaaatatttatattttttcctttcaatactgccatcatattttgtgaagaaactttcattgatgtttctcttgcttaaagtaaaacaaaaaatgcccactagagggtactctcacccccaaatgtgcttctgtaaaaccatctacaaaccatctactaagctggaaagcagttttcagttgtatgaagactattatttaaagtcttttcttgcctagaaaagaaacacacaaatttataactctacaatttttattttccatgaaagaagttgatgtgtgcagaactttcagtacccaatattgtaattgcactatttataatcttaccacttgagttttacttaaggcaatcattgtcaattaaaaacaagtagagaaatatgtctaattgggaacatgttaaggatgataccagacttaattaacaagcatcacagaagtaattagactcattactgaacagttcattgtctcctgttacattattaagccttttagcagctttgtgtaacatttcattggatgtttctaatgcagaaaataatagggattgcaaagagtacaatatgaaggaagtaaggatttaatccttcttttcttgtctttcagatcaaatggggagcctgcggccttgtgttggcaggcaatgcagtcattttccttacaattcaagggtttttccttatatttggaagaggagatgattttagctgggagcagtggtagcactttattctgattacagtgcattgaatttcttagaactcatactatctgtatacatgtgcacatgcggcattttactatgaaatttaatatgctgggttttttaatacctttatatatcatgttcactttaagaaagacttcataagtaggagatgagttttattctcagcaaatagacctgtcaaatttagattatgttactcaaattatgttacttgtttggctgttcatgtagtcacggtgctctcagaaaatatattaacgcagtcttgtaggcagctgccaccttatgcagtgcatcgaaaccttttgcttggggatgtgcttggagaggcagataacgctgaagcaggcctctcatgacccaggaaggccggggtggatccctctttgtgttgtagtccatgctattaaaagtgtggcccacagaccaagagcctcaacatttcctagagccttattagaaatgcagaatctgaagccccactctggacccaggacattttgatgagatccaaaggagttgtatgcacatgaaagtttgagaagcatcatcatagagaagtaaacatcacacccaacttccttatctttccagtggctaaaccacttaacctctctgggtgttacctgctcatttgtttaaaaaaaaaaaaaaagtctcacctgctttcatgctgaggacaagttcagatgttcaagcctataatatttaggcagttcctcaaatttatgaaaagtgttctcagaattgggagacagtcaaagggtacaaagcctcagttaggaggaataagtgtgatttttttttaaagatcacttgcacagcatgctaaatataggaataattgaatgtatatttcaatattgctaagagagtaaatttctaatgttctcataaaaaagttaaatatttgagatcatatgttaattagtgtaatcattccaccttatattcaaaaatcataaaaccgtattgtaccctataaaaatatacaataatttgtcaatatataatcaaaataaaaaacaaaacatactctctcccccaaaaaaacatctcagtggggaacagatgtatcttttcatctgaaagacaatgctgggggaagagctccactgagatgcgggcagggaggctgggctcgagccagcccctgcgttagcaggagggggagaacagataggtaactcttttacatttcctttatgatctggcacttctccccagctccttccctctgccccccacccctactcctcaacagttctggtttgccctgacttctctacggctctggcttcttcccgaagagatataggagccatgtaagcacgcagtgggtgaactgcttaatttcactacgtgttgatgtacttgtcttccgtcctgtaggtcttttctatataactttatgccacccttaaatgaatcattgggtatacctgtcatgttggatcctgtaatcacagttttccctgctcacctttttgtctaagatctattgagaaagggaaatatgggaaggagaaccatttgatcagaatacaaccaatagtctttaagcattgttaaagtatgaaactgaaatacattcaaaacacttaatccttgaggcttgtgatctgagtaattagcaggtatgatgctgggactggaaaatagaaagtaataactaaagggttaatgtgcaacgttattttttggccttgttcatgattttatgttttcagtgtcctgtgtacatatagaattgttaaagttgtcatttccaatatttatattagaaaaattatttagatactttataattttaaccggcatttttaataatgacacttgcatttattgtattgtaataaatttcacttttaactttaaaagtttaactttaaaatttttttgtgatgttgccttgcctgaaaagataacaaaaatgagagaatttcttgatgttttaaaatgggcagttttgagcaataatctgtcctaacagaacagtagcaataagttttaggataccatcttgaatgtctagttggtgtgcaatagcttttctttctaagatggcaataatgattcatttctactacattttgcaaaagtgtttttgttgcttatacacattttcaataaccaaggtagccttcatatgtagccttaaagcattacctcttgattgtatctttagattgatataaagtacttgcatatagagtatttgaagtgatagattattagatttgctctatgtctgaaaagagagctattctgcagtgcctaaatatcatttaaacagtaaatattaataggaaatattgctatatctgaatatataatacaaaagtttgatcatggtgacacaaatgttggacatttttttccttataaaaggctctttttttatatattgtacaatatatttggagattcagagcatagtgactatagtcgaaaactgagattgcacttccaaaattggccacaagtaaataatcttatgaagggattctttatcatgtttcaaacaagtgggttacaagcagactttgagacacttttccacagaaacaatactatgaattggtgattgagttcccaggccaagcctccctcaacaggttcaactctaatatacctaacctgtgatactgaaggtgcctgcctgagttttgggtctctgagacagggtagtgtgagtagtttggaggaaggacagtgcaactttccaccccttttcctaagaacaaggtctttctccttttaatttttccactcattttcacctcctaatgcccttgagatccaggtacactcctgggagttttgttcacctctcccaactgagaaccttcccactgggctccatcctccctcctgaggttcttcatattccagagtcacccacccttctcctcccattagtcagttctctaagtacagctgatgtcatgtggtgctgagaagaaagcagatcacacttcatcacagaaagaatgccttgtgattatcttctccacatctgaaattccttttgacacctgcattgggccgactgccattcccatgactgctgcacctgcgtttttagagaatgcctcataacccactgattctcattcacagagaatgggagaacggaatgaagaaagattccagcagcttatagaaggatagcaatattttgggacagggaaaatcctgtcatacctcatctcttcctcaggaggagttctgagctggtcctgcttttcatagttgtttcttttcttccacttaagaactcatagatttttcttactgtcctaaggaagtccttacctctgaggtatctcctcaatgaatactgttttcaaggctgaaatagttcattatgttaataaccttctttatgttctcagggaaatgcttaggtggtgtcacaaaatgtgccttttcttttctttttttttttttttttttgaggcagagtctcgctctgttgcccaggctggagtgcagtggtgcgatcttggctcactgcaagctccgcctcccgggttcacgccattctcctgcctcagcctcccaaggagctgggactacaggctcccgccaccacgcctggctaatttttttgtatttttagtaaagacgggtttcatcgtgttagccaggatggtctcgatctcctgacctcatgatccgcccgcctctgcctcccaaagtgctgggattacaggcctgagccactgtgcccagccaaaatgtgcctttgcaaagtttgcgaaatcagattttgtatcccaatagaaccaaaatatttatgaggatgctagcattttccaagcatagtaattagttcacaactgagaaatattatgtctgtagtagataaatattagttgtgcattttaatttaattctcctttttccattttgtctcatgaagtaccttattgcaaaaatcccactgagtaatagctcataaattataatctttcaaatagccatgctaccagcgtacaacagtgatacatgtaaccccaaatgtgatgtgagaggacgattactttgtaaataaaacttgttattgacattttaa

SEQ ID NO: 90 - DNA, 209761 bp, Homo sapiens
ccggtctggcttgggcaggctgcccgggccgtggcaggaagccggaagcagccgcggccccagttcgggagacatggcgggcgttaaaggtacatcgcggtccccggctcgcttgtcgtgtggtggggttgccacctccgttccggtcaagcctggggctgcgccttccgcgcgccgttggggaacggcctcaccacccttcccgcctctccggttcgggaggcgatcgaccgctcccttcgtcccttggggtgtgggtggagcggcgtttcgggggagccttggccctttttgcaaggccgctggccttcctgctctccagtggcggcaccagacccctccccagcctgagccctcggcgagagcggcgccctccacctctcctgagtttttaaacaaggtttccacttcttgacgccaccctaacgcctttcttctggttttctgcccctccgcagtttcctatttgccacaaaggaccctttgtctccagcgttcttagcattgggaaacttaatcctctttttcctaatgatttttccaactgggcagagttgaccgcgggcgggtgtcaatggaaagcacccagaaagacggtgtttctcgcagtcgtggagagtagattacgtgtaattttaatactgctttcttcggtgttttctctgtttatggacagagaagaaaccagtgtgtgtgtagtatgtgttttttgcatggggcagttggtaaaaacaccgcgtcccttatctgtatggcttcagagcaatgcgagacggaaaaggttttttgcaaggcttcctgtattttggtaggaaaacattccatttctaatctgtcgaatagagtagcatgacttgtttttatattggcttttatatcatccttgaaatttgcacccaaagatatccccagttaacatctgctataaacatgtagatagtatatatacgagtacgcctctgttcactatgaatttatccgagtatgtgagctgttagcagcagacattttatcgttatttctggctgacttttatacttaatatcagtttagtaaacatggtttacttggagagtgtcgactgtgttatatatccatttgaagccaatgccgaaaacagatgaaaagtagtgtctcagtactacacatgatcagaaactaccaaatcatgatcacgtttatgtgtgaatgtgttagaaaattgtgatgtagtgaaaaaaaaggaagtctgaaatggaaacggactaagggaaggaagcattttacagattgttcaacttttattgaggaactactgtatgccagagacttaggatacaaagataaatgagaagttattggtgggtgacagagctggaaataattatattactatgtcagtgtttatgttgggctcagatgcggtgggagaacagatggtgggttggattttgtcctccaaaaagatgtgttcaagctctaattccctggtacctgtgaatgtgatcttatttggaagtagtatctttgcagatataatcaaattaaaatgataactggtttaaggtgggccctaatccaatgactggtgtccttataagaagaggggaatttagacatagagacatacagggagaataccatgggaagacggagacagaaattggagtgatgcagctacaaagtcaggagcaccaaagattgttggcaaccatgctggcaaccactgagtgttaggaagaggcaaggaagggtgcttccctacagccttcagagggagtgtggtggcgctgctgacaccttgatttcagaagtccagcctccagaactgtcagaagataaatttctgttgttctcagccatccagtttgtggtactttgtaacggcagccctaggaagctgatgcaggtgggattgattcccctgctccagagaaaggactgttttcacagaagaggcgatgcttgaactgaatctgaagggatcaatgtggcttcccttggcaaggcatggagtgaaggtggagtatatcccaagtggggaggacagcacgtgacatggcgcagggcttatgaaacaacatgccttcttctcttcaggtacttaagctacattagtaagaccagaacttagtggtgagggttgaagctggctggacaggcagttaggagtgagtcaggcgatggtgagcctccgtgccagaacaacttgtaggctgtggaagcaaccgcaaagggatggcagcggtgatatatatagttgaaagatcactgtctgctgtgtagaggatggattggaagagtcacagaggcaggaataagaggttaagggcctgcaccagggctgtagcagagagtttaagaagtctgggagattgagtcaccttgacctactgattcattggaaggtggaatgcaatcatggtgtcagtcctctaagataggacctttaaagtgtagggatagtggtttggttttacacgtgttacacatgttgaatttgaggttcttgttggcggtcaaggcagagaagtccagactggaggtggaagtacaggcctagttctttaggacctactctgggctggagcatcagttgcggccgggcccttgtggtagtaggagctttgggttgaacataagttttcagcaggagtgcgtggagtgaaaagagagatggggttggatttttggtcaactccaactttaagagattcagaggatgtgattcctgaaaaaagaggaaaaaaaagaccaaaaagaatcaaacagaaagatggttgtgaacgttgagaaactggtatcagaacagaaggaagaggtctgcagtacctagctttgacaggcctcatggaggagggggtactgccgatggtcaggcacagaggagaggagcaaagcctgctgggaaaagatcatctgaatgaaatagtatgtggtatttgctttccatccacacatgggcattttccattaaagagtggaaatgtaaaaagatatgttaaaattgacagtgtttctttgtcccttaacatgtgtatactttcagatgttttttaaaaagcactttggcaccttcctattaaagagtctctctaaatcttctctcaagtaaaaggaagcaatcaaaaatgttcattggcttaattaattagtttaatactaattatgagtattatggacttttttcagaagaaaatttggataagatagtctcctatgcttttgatttctacctttatcaaagaacattgctaaaatgagtagatacctgagtcagtcagcatttatttggctacctccttttgccaagcactttacatagattatctcatttaattcccataagctcaataaggtggcaccattatttccattttacaggtgagaaatcaggttcagaggattagcttctacccaaagtcataagaccagatggtggcagagttaagatttgactcatgtttgtgactcagagctcaagattttgtaacaaccttgatactctgtttctcactcagcagcacaacaagggcaaatacgttcctactcccgcagagactagtgtccaatagatacagggaatacatattttattcagtgcacactagttgggaattgtttcctacaaagacatgaaaacaatcttcaaatacttgcagtactgtggtttggggaggcaaaatgatcaaaggtatatattacagggaggcagttctggatataatttaaagaaggagggctttcaacatttagaagctgttggaattaaatgacttgccttgggaggtagtgagttttccttcactggagttatgtggaccaactggctgccctctggtgacaaatacagagggaattcatccattggataggggttaggtactggaattacttgagacctttgtatactttatgatttcaaggtggcagacatgggtcattgtcttaatcagtttgggctactataagaaatatattttagactgggtggcttaaacaacaaacatttagtttccacagttctgaagactgggaagtccaaaattgtggtgcagtcagatctggtgtctggtgagagccagcttcctggtttgcaggcctgctttctgctctcacattggagaacagagggagagaaacacagagagagtgtgtgctctactttctctcttcttataagggcactcatcccatcgtggagaccccaccctcatgacctcatctgaacctaattatctcccaaaggtccacctcctgatagcatctcacggtgagagggatggagccgggaaggtttcaacatgtgaatttgaaagggacacacataatgcagtctgtaacgggtcaaatgtaacctcaataaaatgagtaaattgctacatttgcttgaatttgggacctttttttctttcttttttattttagtaaatgtttttattgataaatgattcacataccataaaattaacattcttaaagtgtaagatttcatggtttttagtatattcagaaggttatgcagccatcactactatctaattccagaaaatttactcatccgccaaagaaactctggacctattagaagtcactccccatttccccaaaccctctagtgcctgacaacctctactgtgggaactttaacttttggctttatttttcacagctctcgtggcattatccttcagtggggctattggactgacttttcttatgctgggatgtgccttagaggattatgggtaagttatcatttcaaaaagaactattcctctttctgtgtctttgtcactattagtatgggtgttagagagttcggtcaatttagcaccaagttctaaccagtgagttagtggagcccagtttatgaacacagtccctttgtgggtcaggtgtacttttgcagagggctctgttaaaaattgatgtattcattccataagcatttgtttaacacctactctggactagctggggacacacaaatgaagagagagtcctgtcctcaaagaggaggtaaagttctagttgtgagtgagagacaggcaaacggtctagtcagtaatctggcagctgcagtggagatgccagcacagtacgctggagctcggataaagtgcacctgagtttcagtgggacagtcagggaaggctgcatggcagaggttgtatctgagccaagactaggtggatgaataagagtttttcagggtgatgagtcaggggaggacattccaggcagagggaacattctacacattttttcattcaaccattgttggttgaatgcttcccatgtgccagctactgttatgggaactagggattaagacataagaaaacaaaggtcctgctctctcagagtttgtgtttcagtgggggagacggacagtaaacaacaaaagtatgcatactgtcagaggtagaaatggtacaaaagatgaagagcacagaagctgggaagacagtggtcagggagggcctctcagaggaggtaaaaagtgagaagaaatgtcaagaaaatcagcaagcaggccatacagatctctagggaaaaagcactttaggcaccaggaaagctgaatgctaaggcccggagacatgaaagtgtatatagccttttcaggaaaccacacatggtacattatggtacagcataaattgtagtggagtggcaaaagaagggttagtcaagagtgtaaaagtcagcacttagggctctatatgcctgccgtgtagaggaggttccattttatacatcagacaatagaacctgggaaaatatcttgagaatgggtttggaggagggggttatgttaaaatgtcattcttgccataacgtgagactagataggaaagagctgagactgcagtcagggagaatagtaggggactactatcataaatcaagcaaaattgagggctggggcagtaggaatggaaagaaaaggagagtgagttaggaaaccaaaccaaccaacaggttttgttcatcgatgtcaggattcaacaaggagggagagttcttagatgtctcccaggtgattggcttgaacaactagatagaagatgatgtgattaggccaggcaccatggctcacgcctgtaatcccagcactttgggaggctgaggcgggcagatcacgaggtcaagagatcgagaccatcctaggcaacatggtgaaaccccatctctactaaaaatacaaaaaattagctgggcgtggtggcacacgcctgtattcccagctacttaggaggctgaggcaggagaattgcttgaacacaggaggtggaggttgtagtgagccaagatcgtgccactgcactctagcctggcgacagagcaagactttgtctccaaaaaaaaaaaaaagatgatgatgatgtggttaagacctattgaagtgagttattatgacagtgatgaattcaaatccatcaccgcagtcctggccaactattacagaaattgtttaaacccaagagggatccagatataagcggtcacttatatttgtttagagccttcacagcaattactttattctagcttttggaatgtaatacggtattattatcctcatttctcgctgggaaaccaaagcccagggtagttaaagacttacccagattgaacagcagtaagtgacagagcccggccgtggtggctcatgcctataatcccagcactttgggaggcaacggtaggaggattgcttgaagccaggagtttgagaccagtctgggcaacaaagtgagaccccattctacaaaaaactaaaataagccaggcatggtgcctgtagcagggttgggaggctgaggtgggaagattggttgagcccaggggttggaggctgcagtgagctgtgatcacaccactgcagtccagcctgggcgacagagtgagactttgtctcttaaataaaaaagtagaaaaaaaattaaaatggcagacatggaaatggagctcatgttctgacgcccttgaccaaacgtttttccactattccacaaccaactgtaaatctaggagttttaattctctgtgatacactgtctttgtaaggtaagaaaatgactcattactgctactacaaataagtttgttttctatctttattttaattttttgttttttagagatgccacaacacccagctgattttttttagaagtttttgtagagaccgagtctctctgtgttgctcaggctggtcttgaactcctggcctcaagtcatcctcctgccttggcctcccaaagctgtatcttgatagtgaaccaggattatcatctatattggaagtcagcaaactgccacatataacctgctacctgtttttgtaataaaggttttattgaaatacagccatgctcatttgtttatgaattatctttggctgcttttgcattgctctgccaattatctttggcagagttgagtagttgagatagtctttatggcttgcagatcctcgttatttactctttggccctttatagaaaaagttggcccacccctggcctatgtatttattgaattgtatatatttaatatttacattttatatataaacaaggtttcttgtacattaatatttctcttagttggatatcggtggcttactatgaatgaaaacatagagtcagattgtttttcacaaaactgtcactgtattccaggaaaaattaagagttcttggctgtggatatgtaaggtgacatatctattccaaaccccttcccctctctgtgtctcctttctcactgttgaaagaagggctttgaagtagagaatgtctaagggctacttcccacaatattgtttggtgattcttgaaacatactatcatccctctagtttaaaatcaggggtccaaatccactgtttccatcctgagtcctcttgaaggacacattcccttcttgccttttggttgcctagatctgtggctggaatgggaggctttcattagtgtggcttcatcccaactcctgcttgtaggtgctgtctgggcgtatctgtgtgattacagtattgtggtgatatgaattattgtagtgtatatataaaaatgagcagagactttttttttcttaagaaatgaagcataagaaatgtctgatggagaaaaaaagattatttttgaagtactgatagagaaaatactgttggaaaccagatggcaattttttttttataattgcaaaatgttgaaatttgggaggaaaacagttttgttttgtttttgcattacactattaattgtgagctcttataatgaagatcaaagtacatctaagcttttcactagtgagcatatttattttcatgccttccgtacttaaaatttatttattattttattcatttaacaagtataaatggagtacatcattctaggccctggagataaatggcgtttgatcaagactaatctatcagatgggaataagtgttgtgcagaaagttcaaagagggtggtatgttcgagggtgacctggggtacattagaatagatgaccagggaaagttctgcttttagaaaggaatctgtcagtttagatcacatggtatgaaggagtcagccaatgagaagatcatggggaaggacattgcaagcagggggcacagctagcgcaaaggccccaggataacagctatgagctcaagagtgttcaagggacagaaaaaaggctggtgtggctacagattaagcaaatgaagggaaaagagtacaaaatgaatggaagaagtagataataccagaccataaaggctttgtaggctagggcaaggaatttagggtttattctaagctcttaaaaggtttcaagcatgcgtgcactcaaaagatctttaccgaactagcttttgcaagacactctactatgttctatagggaaggcagaaatgaccaagttaaaattctgtctttaaagaaattgtggctcagtggtacagaaaacagtaaagtttctagggtatatattatatagtggcttcttaacacaatataagctacctacatagtaattttaaaattatcactacttatctatccctggtagaaatcatcttatgttctaatattcacaattaattaattttttgacctaaacatttaaaatagcaatgattttgaaatagtagtatgtctttcatttaaaatgtaactgttacttttctttttggattttgcctgggtccaactgacagcgtttactggcccttattcgtcctgattttccacgccatctcccccatcccccatttcattgccaaaagagtcacctatgactcagatgcaaccagtagtgcctgtcgggaactggcatatttcttcactactggaattgttgtttctgcctttggatttcctgttattcttgctcgtgtggctgtggtaagttttattttctattgttttgcccaaccgttgctgagtttacttcagaggcctgtgtctgggacctccatttcatgctcattacttaggctttatactcaaggccgtgtgtttttagtttctctgttcctctactttagacctgcctaacagtagttcggccatgccttcagagtgctttctttatttctcttacaacttttagccagacgatatgatttcttactttttctactttaagctattctctggaattgttcttaaattcctgcctcttaaatcttacagtaatccacagatactatgctagcagtacttttctagttgcaagatgaagatatttcaaattcttctcctgcaaatgggatcatggactcaactctcaactcagtataataggtatatgttgagggacaactgtgtagcttccagaaaatgcagtgaataagttgacatcttcacttccaagacaaaaactttctttttgtcttcagagtacacattgtaggtataatttattcaattatttgctattcactgtctttcctactatttgattttattccctccaattacgttctattttaattttatgaaactcttatttgaggcattgaatatcagataagcgcaagtcttgttcattcaataaatatctttgcaacaactgctacttgtaaaacaccagaaataagaaataggtactgtctctgctcctgaggaacacagaaactagcttgctgggtaagtatactataagtgtactaagtgagacggttgaagcatgatcagaatgccataggggcaccaagaagagagaaattccgactggcatttgatatgggcctctaaggataaatagcatttgtattgaggtaggatggctgttgtatggaatgacattcaagtgtaagaatgcagtatatagaataaagaagaatccagtgtggtagagctaaaagaaagttgttgaggttaaggctggaagggttgtgaaacctgattagcaatggtcttgaaccccatgccagtttgatctttgtctagataatggggaaagattgaaggtttttgaatacaacaagattgtcatgactttatttttcttgtgctttagaccagcccttcttaagcgctgcagtaaatatttatattttttcctttcaatactgccatcatattttgtgaagaaactttcattgatgtttctcttgcttaaagtaaaacaaaaaatgcccactagagggtactctcacccccaaatgtgcttctgtaaaaccatctacaaaccatctactaagctggaaagcagttttcagttgtatgaagactattatttaaagtcttttcttgcctagaaaagaaacacacaaatttataactctacaatttttattttccatgaaagaagttgatgtgtgcagaactttcagtacccaatattgtaattgcactatttataatcttaccacttgagttttacttaaggcaatcattgtcaattaaaaacaagtagagaaatatgtctaattgggaacatgttaaggatgataccagacttaattaacaagcatcacagaagtaattagactcattactgaacagttcattgtctcctgttacattattaagccttttagcagctttgtgtaacatttcattggatgtttctaatgcagaaaataatagggattgcaaagagtacaatatgaaggaagtaaggatttaatccttcttttcttgtctttcagatcaaatggggagcctgcggccttgtgttggcaggcaatgcagtcattttccttacaattcaagggtttttccttatatttggaagaggagatgattttagctgggagcagtggtagcactttattctgattacagtgcattgaatttcttagaactcatactatctgtatacatgtgcacatgcggcattttactatgaaatttaatatgctgggttttttaatacctttatatatcatgttcactttaagaaagacttcataagtaggagatgagttttattctcagcaaatagacctgtcaaatttagattatgttactcaaattatgttacttgtttggctgttcatgtagtcacggtgctctcagaaaatatattaacgcagtcttgtaggcagctgccaccttatgcagtgcatcgaaaccttttgcttggggatgtgcttggagaggcagataacgctgaagcaggcctctcatgacccaggaaggccggggtggatccctctttgtgttgtagtccatgctattaaaagtgtggcccacagaccaagagcctcaacatttcctagagccttattagaaatgcagaatctgaagccccactctggacccaggacattttgatgagatccaaaggagttgtatgcacatgaaagtttgagaagcatcatcatagagaagtaaacatcacacccaacttccttatctttccagtggctaaaccacttaacctctctgggtgttacctgctcatttgtttaaaaaaaaaaaaaaagtctcacctgctttcatgctgaggacaagttcagatgttcaagcctataatatttaggcagttcctcaaatttatgaaaagtgttctcagaattgggagacagtcaaagggtacaaagcctcagttaggaggaataagtgtgatttttttttaaagatcacttgcacagcatgctaaatataggaataattgaatgtatatttcaatattgctaagagagtaaatttctaatgttctcataaaaaagttaaatatttgagatcatatgttaattagtgtaatcattccaccttatattcaaaaatcataaaaccgtattgtaccctataaaaatatacaataatttgtcaatatataatcaaaataaaaaacaaaacatactctctcccccaaaaaaacatctcagtggggaacagatgtatcttttcatctgaaagacaatgctgggggaagagctccactgagatgcgggcagggaggctgggctcgagccagcccctgcgttagcaggagggggagaacagataggtaactcttttacatttcctttatgatctggcacttctccccagctccttccctctgccccccacccctactcctcaacagttctggtttgccctgacttctctacggctctggcttcttcccgaagagatataggagccatgtaagcacgcagtgggtgaactgcttaatttcactacgtgttgatgtacttgtcttccgtcctgtaggtcttttctatataactttatgccacccttaaatgaatcattgggtatacctgtcatgttggatcctgtaatcacagttttccctgctcacctttttgtctaagatctattgagaaagggaaatatgggaaggagaaccatttgatcagaatacaaccaatagtctttaagcattgttaaagtatgaaactgaaatacattcaaaacacttaatccttgaggcttgtgatctgagtaattagcaggtatgatgctgggactggaaaatagaaagtaataactaaagggttaatgtgcaacgttattttttggccttgttcatgattttatgttttcagtgtcctgtgtacatatagaattgttaaagttgtcatttccaatatttatattagaaaaattatttagatactttataattttaaccggcatttttaataatgacacttgcatttattgtattgtaataaatttcacttttaactttaaaagtttaactttaaaatttttttgtgatgttgccttgcctgaaaagataacaaaaatgagagaatttcttgatgttttaaaatgggcagttttgagcaataatctgtcctaacagaacagtagcaataagttttaggataccatcttgaatgtctagttggtgtgcaatagcttttctttctaagatggcaataatgattcatttctactacattttgcaaaagtgtttttgttgcttatacacattttcaataaccaaggtagccttcatatgtagccttaaagcattacctcttgattgtatctttagattgatataaagtacttgcatatagagtatttgaagtgatagattattagatttgctctatgtctgaaaagagagctattctgcagtgcctaaatatcatttaaacagtaaatattaataggaaatattgctatatctgaatatataatacaaaagtttgatcatggtgacacaaatgttggacatttttttccttataaaaggctctttttttatatattgtacaatatatttggagattcagagcatagtgactatagtcgaaaactgagattgcacttccaaaattggccacaagtaaataatcttatgaagggattctttatcatgtttcaaacaagtgggttacaagcagactttgagacacttttccacagaaacaatactatgaattggtgattgagttcccaggccaagcctccctcaacaggttcaactctaatatacctaacctgtgatactgaaggtgcctgcctgagttttgggtctctgagacagggtagtgtgagtagtttggaggaaggacagtgcaactttccaccccttttcctaagaacaaggtctttctccttttaatttttccactcattttcacctcctaatgcccttgagatccaggtacactcctgggagttttgttcacctctcccaactgagaaccttcccactgggctccatcctccctcctgaggttcttcatattccagagtcacccacccttctcctcccattagtcagttctctaagtacagctgatgtcatgtggtgctgagaagaaagcagatcacacttcatcacagaaagaatgccttgtgattatcttctccacatctgaaattccttttgacacctgcattgggccgactgccattcccatgactgctgcacctgcgtttttagagaatgcctcataacccactgattctcattcacagagaatgggagaacggaatgaagaaagattccagcagcttatagaaggatagcaatattttgggacagggaaaatcctgtcatacctcatctcttcctcaggaggagttctgagctggtcctgcttttcatagttgtttcttttcttccacttaagaactcatagatttttcttactgtcctaaggaagtccttacctctgaggtatctcctcaatgaatactgttttcaaggctgaaatagttcattatgttaataaccttctttatgttctcagggaaatgcttaggtggtgtcacaaaatgtgccttttcttttctttttttttttttttttttgaggcagagtctcgctctgttgcccaggctggagtgcagtggtgcgatcttggctcactgcaagctccgcctcccgggttcacgccattctcctgcctcagcctcccaaggagctgggactacaggctcccgccaccacgcctggctaatttttttgtatttttagtaaagacgggtttcatcgtgttagccaggatggtctcgatctcctgacctcatgatccgcccgcctctgcctcccaaagtgctgggattacaggcctgagccactgtgcccagccaaaatgtgcctttgcaaagtttgcgaaatcagattttgtatcccaatagaaccaaaatatttatgaggatgctagcattttccaagcatagtaattagttcacaactgagaaatattatgtctgtagtagataaatattagttgtgcattttaatttaattctcctttttccattttgtctcatgaagtaccttattgcaaaaatcccactgagtaatagctcataaattataatctttcaaatagccatgctaccagcgtacaacagtgatacatgtaaccccaaatgtgatgtgagaggacgattactttgtaaataaaacttgttattgacattttaacaaaggcttttatgtacattattaaatgaaaaagtttatattttactttgcggtacgttacatttggaaaggagatcagcaagttaattttcccagtgtttttgtctgtataatcttaatgtgaatctgaccagtttgaagcctgtacttgctgtagttgaagagaaacagttcaggaatgttgtgctgactggaaggaatccaggccttaatttctgtggctgacactccccatggtggacatggaagattggaaaagctgtattggaaaagaaaaaaacctgacaccttaagaaaagtgctctacatattttgaagagtctttttgcacactacagaaaagaatgcactaatagaaagtagtctttaaggaataatatgtcctccttatgcacaaaacatttgggaaagatctgatgttttactagtggatttaggcagccagattgtaaagaaatcaagctagttatttctttgcattgccaagctaagtgtaaagttaaacttttaatagaaatagaaataaaaatttgataataccaacataactataaaatggccataagaaaagtcagttcccaaggaaaattaatagatgaccattttgaaacatttatttgtggtcaatacgaggcacataggcaaagtggtcttaatcctgagattgctcatttggagaagagcacacttggagactgcacaatctctcttcacttttgattatatctttatcaaaattgaataattctaagtgtttacacacttcggaatgaatgactagatattaacttaagtgtgtgcattcatttttcccctcagaataattaaataataaaaccatcagttcaactttagctggataatcattgcacttatcaatttaaagcataaatgcctctgcctcaacactttcatttcctctgtggttgagagacaaattatatcaccacactctgtaaagtttcatgatttcttacagccttctcctcaaaattgtatgcttgttcatctgacaaacccagaattctccagtacttccaaccatccctgctgcagccttgccatttgtggttccttgacagtgctgctgttaaaatccacttaaccactgatggaaatgagttacgtgagttctgaacacaggttttaatcggattcctgattaaattaatggcagtgagtcttaggcttgatttattcaagattccatggtgtggaactgacagttgctcagctctttaataaaatcatgtatatatgtatatattttgagatggtatctcagtatgttgcccaggctccctgggctcaagctatcctcctgcctcaacctcgtaagtagctagtacttctgctggaaacatgcaaatgtccattaactgatgaatggataatgtgatatatccattcaatggaatgtttttcagacataaaaaggaatgaagtactgaaacattgctacagtgtggatgaatcttgaagacaatatgtgaagtgaaaagagccagtcacaaaaggccataaaaggtcacaaaaggctgaggcaggagaatcctgaacccgaaaggcggaggttgcagtgagccgagatcgcgccactgcactctagcctaggcgacagagggagaccccgtctccaaaaaaagtttatatttcagtgtaagtagaaaaaaactaggtaaataaagtatatgatacggtaggcgctactggaaaaaatatagtggggaaggaggataagtagtatttgggtcattgtggttttagatagggtggccatgaaagcctcacccaaaagaggcaaagaaaagagccatgtggattttagggtctccttctgttgcccaggctagagtgcagtggcaagatatggctcactgcaaaccttaacctgagcgcaagggttcctcccacttctacctcctgagtagctgggattacaggcacgggccaccgcagctggctaagttatttattttttgtagagatgaagtttccctacattgaccaggctgctctccaaccctggcctcaagcaatcttcttgcctgtctcagcctcccaaaatgctgggattactggtatgggccatggctcctagccgcctttttttttttttttttttttcaaaaaatattccaactgaggtttggcatttattgcttgagaaataaataatataaataaaatagcttgatttaggaaatgaagttgtgctagctggaacactggccaggttatggccacgataaagaagagaccagccgggcacggtggctcacgcctgtaatcccagcactttgggaggccgaggtgggcagattacgaggtcaagagatcaagaccatcctgaccaacatggtgaaaccccgtctctactaaaaatacaacagttagcagggcgtggtggctcacgcgtgtagtcccagctactcaggaggatgaggcaggagaactgcttgaacctggtaggcggaggttgcagtgagccaagattgcaccactgcactccaacctggcgacagagcgagactctgtctcaaaaaaaaaaaaaaaaaaaaaaaagacagttgagctagagagtaaataaagtggcccctaatacagtgggtatagattcatgaagtggcagtagctgaactgtagctactgttaactttgaggactaattaagacaatgtcaggaaaattttctttttcttttttctttttttctactctgtgtttcttcattatctgaatttatcctcatgcaggttggaaactgctgaaagcagtccatttttatgagctcttttattctaagccaaatcagtcagattacaaaccccattgtattttagataacccaagtgattattcaggtgctcaaaagcttttagagaactgctaaacctcatgtacttctgggcagtatcagcaattaaaagagtttaattttctaggtgaaactgattctggtttggatttctttatttggactgagagatattttaaccaggttaaaatattggtgcaaagccatctctgatgagacttaaaatcataaagctacttccccatgcagttcttgtcaccatttcagggtactgctgggcaataggacatgagttcccattgcttgtgggatcttcagatgtatatccctccagtgaattggactcagtattgttgagacatcaattttccgcaacatgatttatagattgaaagcaatcacagtaaaaatcccggtaagatttttaggagaaattaatatattccctgatttctaacttattacaaagttatacattagacaatgcgatattggagaaaggacacccatataaatcaattgaatagaatcaataattcagaaatagacccaaaaatatatggtcaaatgatttttgatgttaaggaaaaaataaaaacattttaagctgaggagatacaggacaaattatttgccctcatggagcttaccttcaaatgggcaagacaaataatttttaaagtaaaaaataattcaatagtgaaatttgggctgggtgcaatggctcatgcctgtaatcccagcactttggaaggctgaggcaggtggatcatctgaggtcaggagttcaagaccagcctggccaacctggtgaaaccctgtctctactaaaaatacaaaaaattagctgggtgtggtggcagatgcctgtaatcccagctactcaggaggctgaggcaggagaatcacttgaacccaggaatcacttgaaggcagaggttgcagtgagccgagatcatgccattgcactccagcctgggcaacaagagtgaaactccatctcaaaaaaaaaaaaaaaaaaaagctgggcgcagtggcgtgtgcctgtaatcccagctcctagctactcaggaggctgaggcaggagactaacttgaacccggaggcggaggttgcagtgagccaagatcgcaccactgcactccagcctgggcgaggaagagagattctgtctcaaaaaaaaaaaaaaaaaaaaaaaagaaaaagaaaattgacagtagtgaatgctatgaagaaataaatcaggataaaggcatagagaatgacttacagtggtgctatttaaatagggtggatagagacgattggtggctgaatagagctattgaataatgagaaggaatcaacacgatgggacctatttttaggtctactctttcgattctttttaattttaggtctactctttcacttattctttcaagaaatatttgttgagcacctattatgtgctcaacataattatattattctaggtgctggagatagaacagtaaataaaacagacaaaacccccagcccccatggtgcttactttttttttttttggtagggaagcaaaaaataaacttcacaaataagtcaaatggatggtatgttagtggaaatgctaaggcaaaaaaaggaagaaagggatgtagaatatgtgtgagtgtgcgtgtgggcgtgaacgggtgacggtggcttctgtttaagatacagtgcccaagaaaggcttacctagaagatgacgtttgaaggaagtagaggcagttatggaggcggcaatgggcaagatggttcaaaaagagggataagcaagtgcagcggccctgagctggagcgtacctgtgagctggcatgaagccttcagggagagtggagggagataagataatgtgtgtgtaggggtggatggatcctatggggcccagcaggtcattgtaaggcgtcggcattcatttagagatgagacgccactagagatatgagcaggagtggcctgattatgttttattcggattgctctagctgtgttttaattaaaactattttataaagagaggaaaaaacaattttgcttttccaaatcaatcatgtttatgtctttgaaagaggagaacaacaaatcacagaaaacataaataaatgcattttgttcagggacagatggctgaagcaacgagagtgaatcacagagtcacagaatcacagttatgtgcaaagcactcaggaaatagcttggtccctaattaatcattccatgttgttaaactctgtggagataaatttagccagcagtaggtagaatgagatgaattctcatgaaaacatgttttcaatgaagttggcaaagaatgctgtgtaaaccccaaatagctgaaactatgtcctaatagcattgagcttggtgtgccacatccttagcaataaccacttgagtgtctgtccctggggcctgcagatgaggatgttaacatctgatttagcagaaggggtggggagagtgatgggggacaagggagagagtcctgaaacatacaggtggtgaccctaggagctgactttggtgccatttaggcatatttgctttcaggactcacacttccttaggtttaagctatcaataaaaggaaagtggtttctaagtcctagcctttggactgtattcctttaattcatatagtggagcagggggaaagttatcattttaatggctggtagcacaattccgagaagaaaacttttttgtttatttaatcttagataagccatttgagtgttaagagctatggcccacgacagggaagggatttgaaatgttttagataataaagtgaggagaatttgggatttgcatcagaatgacgaaggggaagtgggggaggggtgatacactaacaccagtggagaagaaatccagggaaaaggtgacagaaatcctggccactgaagggctggagcctgaggctaaaacagtgccagggagaccctctggggtgacagcctaagaatttttgataacaaggatattggcagagcagtggtgaaaccctctccccttttcccattgcttctccctcctttgccccagattcccactcaaagcctgtgatacatactgttgttcactgtggtgttcaggtatactgaggggtaggagagtgaagaaaaggagaatggtttgcaagtggggttaatgtgggctgagagagaagaggacagcaaagaggcgtgagacacagggtaaagaaagcattcagagtaaaatggaccaagaggtgagtaggagaataagttaccccaaatgcctcagaaatatttgttgggaggactctgctatatgagacttaagccctttttaaaaaaataaaataaaatgaaaaggtgattcccaaaaggttggtgccttatgaggcttcatctgcataggatccctggtttcacaactccttatcttgaccagactttctattgattccaggtctttagacaataacttaattctttcaaccaactgtcaatcagaaaatctttgaatccacctatgacctatgacccctcccctactccaccccactgatttgagtttgtcctgccttttccaactaaactagtatatatcccacatgtattgattaatatcttttgtctccctaaatgtataaaaaccaagctataacccaaccaccttgggcacatgttctcaggatctcttgagactgtaccttgggccttggtcatttatatttgactcagaataaacctctttaaatattttacagagtctgactcttttcatcaacagctggaatatttgtttcttgatctaatgatgattacacagcagttttaagtttgtgcaagtttatttggttttatacttacaatatatacactcaataaaatatgatatacctcaataaaaataaagcaatgccttccctgcctccaaaaacaaaaccaacctgggaatacaaagatcaaataacagtgcctgcagaagcttagaaaatcggcacagatgtgacatttgactcagttcagcacacattatggagggttactatacaagggagactgcacacagagaccatactcaggagcctgaggatcctgaatcactgacctagagggaagaagtaccagcccctatcttgaggacctcatattacaaggcagtaatagacatgcaaaaattaatagcaacagtctgattctggcaattggctgatatgccaactcttaccacttttcaacattgtgctagatatgtaagtggcagaaagactgaaaaggaataaacagattattatttgcattctatgctcttatttacttagaaaatccaggagaatctatacactattagaaaaaaattacacttataaaacttactagataaaagatcagtatcaaaaaaatcaattgctttcctaaacaccagtactaactaattagaaaatgcactgggcacagtggcttaagccaataatcccagcattttgggaggctgaggtgggaggatcacttgagcccaggagttcgagacctgcctgagcaacatagcaagaccctgtctctgaaaatgcaattttccaaattttcaataggaacaattacataaatgattataatatatatatataattttatatatacacatctatatctgatgttataaagatgtgcaatacttggagaaaaatttcaaaaattttttgctgggtatataagctctaaatatataaaaagatatactatatttaaatactaagggataaagtattaagcattcaatgaatactggaaaaatgattggatgagttcatattggacagagccacatctcggtcttcttttggaatcctttcttcatatagtacctagaatagtgcctgacactgtgggaaaccaaaatatgtcacctcaaaatatacttctttggcgtattttcagttggttattcagagaagtagcagacaggaatagttctgaaaagctgttcttttgggggtagatttgcatctgtagaggaaatctgcattggtgaggtaaagaacagacacagaggctttctctgaggtccacctatctggatcaggaaaaaggaactcaataagaaaaggagactaaagacctgatactttttttttttttttttttttatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgttaagacctgatacttttaaagtttggacagtgaaacttttgctgcatctcttccttctgagggctgctcccagagagacttcatctgcatcacaagacagcctttgctcaccatgcctttcctccccacaccctctcataatgtgttgctacctccctgcaggagcctttaggaccctatttctttctgtagcttaaaatgctattgaagcttcaactatctggcccttctttgattcttcgagtctcgtagtttgtgtggctcctgtgcacatgtgcatgtgataaatgtgtatactttgtctcccatgaatctggctattgtcagtttcttttatagactcagattaacaaactttcagaagggtggaggcgggcggggggtggggtggggagggaaatccctttgctcctacagcaaagtagtagggactcaaaaaatatcgaagagaagaaaacaaaggagaggaaaggaggaagggatgaataactttatttaaatgagaaaagtggcactgagttaaaaattattaaatattttgaattctttatgttattacaatttttacttttgctaacatcctcttgctttattgttgtaataatgtgtgctcatatagtcattaagagtttacaaaactgtgtcaattaggtccatataacaatgaaaaagcagcagcatcactggaaaatctcgaggctcttcaaggttaaggggcttgccttagatgacaaataacctgactgttactcagacccaagttttttgacttcaagggcagcgactttgtactctacagatgccaatctaaatgggctgcaagctagatgtgtaggctatggattgccatcctaattgggacacttttgagagcagaagtaggtgttatccattatgttgggacaataggtgtaaattggtaccatcttgggtacatccaaggtacagtttaccttatctatggctgaaaactgagtttaaattaattcttcttacgggcagcacaagtcaaaaagccctttgccaagctgcacagattgtaaatgctgctcctggctgtgttcaatgtatatttggacaaagtcaataataaataaataaaggtcaactatgaattaaggtaggtttgttagtttgttttttggtaaaaggaatgtcacttgcttagagaggttaatatactgcatgtggggcaaagttgctggtaagtatcattcttccttctgtccttcgaaccccaaatgacacatcttgttcacgtatccactatggtgtaagacatcactgggtgctggctgtaattttatcttccttcttaaagtctttataacgtgaagataatgagtggatctgtgcgaaactcactaccaggatcagccaatacttgtttttctgtggagcttttggtgattactttaactgaatagagttttttttttttaaacagcaaatctttcaatgtattagcaattttaagtaagaatctctaacttgtaacacacactgaacttagagttttgttttttttctacacatgccatttctgcaagtgaacttaagaaatttcaactaatatagaagacttaatcaattctcaattacatgttgtaaattaacctgctaacaggaacaggtgaaactctcttaacattttaaggacataaagtaatcaaatatgcagatttaacacaaaaccattaatattatggggttcttttcaatatttctatgcttaattttaaatcttttttaggataaaattgttttccaactaagaaaagtattgtcatcctattttgtgagataccactaagtcaaatgagattgcgtaatgaccagagatattattagttgaggtgctgactgtatttttatctgatataccaatgagtcttttcacttgggtaaatatgtaggagctggatttctgagttgaatggtaagtctgtttttaactttgtactaaactgggattttgttttccaaagtggctgtacaattttgcattccaaccaacaatgtatgagagtcctagttctgcatgctcatcagtaaatagaattgtcagttgttaaattttagccattctaatagttcctacccttttttagaccatatagggtaatgacattgccatggcatctgtaaactgtcatggcgctagtgggagtgtcttttggtatgctaatacattataattagtgtataatgagcaatgatatcgaacagaggtcactttcattgccatgtgggtttgggtgggttttggccagcttctttactgcaacctgttttatcagcgaggtcccttctgactaatgatgttaagaatcttttaatgtacttatttataatctttctatcttcagtaaaatgtctatagaaattattggtccatttctttattgagttgtgtgatttcttaatactgagttttgaaagatctttatatattctgaactcaaggctttattgtatatctcatttgcaaatatttatccagtgcatggctggtcttttaattttctttttcttttttctttttcctaactgctagatgatgtgggagtcttttcaaatccttagcatctttggaagagcagaagtttaaatttttgataaaatctaatttatcttttttgagacagggtctcactctgtcactcaggctggagtgcagtggcacaatcatggctcactgcagcctcaaccttcagggctcaggtgatcctctcacctcagcctcctgagtagctgggactacaggtgcccaccaccatgcctggctaatttttgtattgtgtgtagagacaggatttcgccatgttgcccaggctggtctcaaactcctgggctcatgtgatccacctgcctcagcctcccaaagtgctaggattaaatttatcatcttttttttttcttggatggatcatagttttggcatcttcttagaaatctttgcctaatgtcgtgatgattttctcctatgttttcttcaaagttttatagtttaaaattttagatttaggtctgtaatacatttgagttaattttttgtaaagggtatgagtgatcaatcaaggccctccctccttcctttccttccttccttgtatattgaaatccaattattccagcaccatctgttgagtcttcctattcatgaacagggactgtctctccatttatttagtttctatttgatttctttcattagagttctatagttttcctcatatagatcttgtacataatttgttggatttataccgaagtagtttggttttgggggtgctggtataaatggtattgtgatttttcttttctttttttttttttttgatacagggtctcaccctctcacccaggctggagtgcaatggtgcaatcttggctcacttgtaactttggcctcctgggctcaggtgatcttcccacctcagccccttgagtacctgggactacaggtgtgcaccaccatacctggctaatttttttgtatttttgttttgcagatatgggtttttgccatgttgcccagactggtctcaagctcctgggccccaagtgatttcattcacctcagcctcctaaagtgctgtattgtgtttttaatttcaaattccacttgttcattgctcatacataggaaagtgattgacttttgtatattaatcttgctctagttacttattagttccaggagtctgttgtttattcttttggattttctacatgaacaactatgtcttctgtgaacaaagacagtaatatatattccttccagatccatgtacctttcatttcatgttcttatcccagtattatctaggatttccaatatgatgttgaaaaggagtggtgagagggaacatccttatcttgctcttgatcttggtgagaaagcctcatgcttcttatcattaagtatgatgttagctgcaggttttttgtagacattctttatgaagttgaggaagatccactccattcctagtttactgacagcttttatcatgaatgtgtgttggagtttgtcaaaagctttttctgcatatattaatatgattatgtgatttttttcctttagcctgttgatgtagtgaattttacattaattgatttttgaatgttaaaccagctttgcatatctgggatgaattccacttgctcatggtgtataattctttttatacattgttagattcaatttgctaatatcttgttgaggattttgcatccgtgttcatgaaagatattggatctgtagtctttttatgtaatgtctttgtctggttttggtaataaggtaatgctggcctcatagaatgagtggggaagtattccctctgcttctgtcttctaaaagagattgtagagagttggtataatttcttccttaaatgtttggtagatattaccagtgaaactatctaggccttgtgctttctgttttggaaggttattatttattaattcaatttctttaataaatattggcctactcagattatttattgattcttgtgtgagttttggcagattatgtctttcaaaaaattggtccatttcatctaggttatcaaattaaatttgtggtcataaagttgttcatagttgtccattattatcccgttagtgtccgtgggatctgtaatgatgttccctctatcctttcttgctttgttgttgttgttgtttttgagatggagtcttggtctgtcgcccaggctggagtgcagtggtgctatcttggctcactgcaacctccacctcccaggttcaaacgactctcttgcctcaacctccccagtagctgggattacaggtgcccaccaccaagcccagctaatttttgtatttttagtagagctagggtttcactatattggtcaggctggtctcgaactcctaacctctagcgatccacctgccttggcctcccaaaggcgtaagccactgcacctggcctcatttctgatattaggaatttgtgtcatctttttgtttttcttggttatcctagctagaggcttagtggttttatttatcttttttttttttttttttgctgaggttttattttggaaaaaaagagcaattgaattgttttgtagctggagagtgcctcaggcagtgaactcctcctggggatgggctgagggcaagggctaagcctcaggtgggtctcctgttccctgtgctcccctgcacagctgcctccctctcggaccctggggcagccgcaggaagggtaggctgggaggggctgccatggctgttcacttgggcaggacatcagaggactcgaacaccagcctcccatcacaggtcttgattttcttcacaactacagccctggtggagctgctgcagctgaaggagctggagcctgtgccagagccaaagctggagcccagcttccctccggcaactacctgtaggtggcaatctccatgtccagggcctatttatcttttttttttttttaaatagcttttagtttcattgattttttttctattgattttctgttttcaatttcattgatttctgctttcatttttattatttcttattctttctttagaattaatttgttcctcttttttctagttttttaaggtgaaagcctagatgattgattttatatctttcttcctttctaatatatacatttaatggcataaatgttcatctaagcactgtttttactgtatcccacaaattttgaaaagtcatgcttttattttcatttagttaaaaataattttaaatttctctgagatttctcttgtgacccatgtgttattttgaagtgtgttgtttaatctccatgtattttggaattgtccggttgtgtttccgttattaaatttttagtttaattctattgtggtttgagagcagatgttgttttaaatttgctaaggtgtgttttatggcccagaatgtggtctatcttgctaaatgttccatgtgaactggagaagaaaatgttttctgcaaaagttggatgaagtagtccatagattttttttttgttccagattaaatgcttttttaaaaaatttattattattatactttaagttatagggtacatgtgcacattgtgcaggttagttacatatgtatacatgtgccatgctggtgcgctgcacccactaactcgtcatctagcattaggtatatctcccaatgctatccctcccccctcccaccaccccacaacagtccccagagtgtgatgttccccttcctgtgtccatgtgttctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatacacccagtaatgggatggctgggtcaaatgatatttctagttctagatccctgaggaatcgccacactgacttccacaatggttgaactagtttacagtcccaccaacagtgtaaaagcattcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaattactttgagttcattgtagattctggatattagccctttggcagatgagtaggttgcgaaaattttctctcattttgtaggttgcctgttcactctgatggtggtttcttttgctgtgcagaagctctttagtttaattagatcccatttgtcaattttggcttttgttgccattgctcttggtgttttagacatgaagtccttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctacatatggctagccagttttcccagtaccatttattaaatagggaatcctttccccattgcttgtttttctcaggtttgtcaaagatcagatagttgtagatatgcagcattatttctgagggctctgttctgttccactgatctatatctctgttttggtaccagtaccgtgctgttttggttactgtagccttgtagtatagtttgaagtcaggtagagtgatgcctccagctttgttcttttggcttaggattgacttggtgatgcgggctcttttttggttccatatgaactttaaagtagttttttccaattctgtgaagaaagtcattggtagcttgatgggtatggcattgaatctgtaaattaccttgggcggtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctgtctgtttgtctgttattggtgtataagaatgcttgtgatttttgtacattgattttgtatcctgagactttgctgaagttgcttatcaatttaaggagattttgggctgagacaatggggttttctagatatacaatcctgtcgtctgcaaacagggacaatttgactacctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaatgccttttctgcatctattgagataatcatgtggtatttgtctttggttctatttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctctttttttgttgtgtctctgcccggctttggtatcaggatgatgctggcctcataaaatgagttagggaggattccctctttttctattgattggagtagtttcagaaggaatggtaccagttcctccttgtacctctggtagaattcggctgtgaatccatctggtcctggattctttttggttggtaagctattgattgttgccacaatttcagatcctgttattggtgtattcagagattcaacttcttcctggtttagtcttgggagagtgtatatgtcgaggaatttatccatttcttctagattttctagtttatttgcatagaggtgtttgtagtattctctgatggtagtttgtatttctgtgggattggtggtgatatcccctttatcattttttattgcgtctattagattcttctctctttttttctttattagtcttgttagcagtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttctctaattcttttaattgtgatgttagggtgtcaattttggatctttcctgctttctcttgtgggcatttagtgctatacatttccctcgacgcactgctttgaatgcatcccagagattctggtatgttgtgtctttgttctcgttggtttcaaagaacatctttatttctgccttcattttgttatgtacccagtagtcattcaggagcaggttgttcagtttccatgtagttgagcggttttgagtgagattcttaatcctgcgttctagtttgactgcactgtggtctgacagacagtttgttataatttctgttcttttacatttgctgaggagagctttacttccaagtatgtggtcaattttggaataggtgtggtgtggtgctgaaaaaaaatgtatattctgttgatttggggtggagagttctgttagatgtctattaggtccgcttggtgcagagctgagttcaattcctgggtatccttgttgactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaagatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactccgtatccaatttgccagtctgtgtcttttaattggaacgtttagtccatttacatttaaagttaatattgttatgtgtgaatctgatcctgtcattatgatgttagctggttcttttgctcgttagttcatgcagtttcttcgtagtctcgatggtctttacattttggcatgattttgcagcggctggtaccggttgttcctttccatgtttagcgctttcttcaggagctcatttagggcaggcctggtggtgacaaaatctctcagcatttgcttgtctgtaaagtattttatttccccttcacttatgaaacttagtttggctggatatgaaattctgggttgaaaattcttttctttaagaatgttgaatattggcccccactctcttctggcttgtagggtttctgccgagagatccactgttagtctgatgggcttccctttgtgggtaacccaacctttctctctggctgcccttaacattttttccttcatttcaactttggtgaatctgacaattatgtgtcttggagttgctcttctcgaggagtatctttgtggcgttctctgtatttcctgaatctgaatgttagcctgccttgctagattggggaagttctcctggatgatatcctgcagagtgttttccaacttggttccattctccccgtcactttcaggtacaccaatcagacgtagatttggtcttttcacatagttccatatttcttggaggctttgctcgtttctttttattcttttttctctaaacttcccttctcacttcatttcattcacttcatcttccatcgctgataccctttcttccagttgatcgcatcggctcctgaggcttctgccttcttcacgtagttctcaagccttggttttcagctccatcagctcctttaagcacttctctgtattggttattctagttatgcattcttctaaacttttttcaaagttttcaacttctttgcctttggtttgaatttcctcccgtagctcgtagtaatttgatcgtctgaagccttcttctctcagctcgtcgaagtcattctctgtccagctttgttccgttgctggtgaagaactgcattcctttggaggaggagaggtgctctgctgtttagagttcccagtttttctgctctgtttttccccatctttgtggttttatgtacttttggtctttgatgatggtgatgtacagatgggtttttggtgtggatgtcctttctgtttgttagttttccttctaacagacaggaccctcagctgcaggtctgttggagtacccggccatgtgaggtgtcagtctgcccctgctggggggtgcctcccagttaggctgctcgggggtcaggggtcagggacccacttgaggaggcagtctgtccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctctttgagctgtggtgggctccacccagttcgagcttcctggctgctttgtttacctaatcaagcctggacaatggtgggcgcccctcccccagccttgctgccgccttgcagtttgatctcagactgctgtgctagcaatcagtgagactccgtgggcataggaccctccgagccaggtgcagggtataatctcctggtgcgccattttttaagcccgtcggaaaagcacagtattcgggtgggagtgacccgattttccaggtgccatctgtcacccctttctttgactaggaaaggaaactccctgaccccttgcgcttcccgagtgaggcaatgcctcgcccagcttcggctcgtgcacggtgcgcgcacccattgacctgcgcccactgtctggcactccctagtgagatgaacctggtacctcagatggaaatgcagaaatcacccgtcttctgcgtggctcacgctgggagctgtagaccagagctgttcctattcggccatcttggctcctccccccatagatgttaattatatccagttaattgatggtgttgttgagttcaactttgtccttactggttttatgcctgctggatctgtccatttctgacagaggagtattcaggtctccaactacaatcatggattcatctatttctctttgcagttctgatgtttttgcctctcattttaatgtatgtggttaggcacatacatattaaggattgtatatcttcttagagaacagacctctttattgctatgtaatgcccctctttgtccctgataactatttttgctttgaagtctgctcttaatgaaattaatagaggtactcttgttttcttttgattagtgttagtatggtatatctttatccatttgtttttaatctatactgtctatttttaaagctggttaattgtagacaacatatacttgggtctggtttcttcatccactccaacagtctctgtctttgattggtgcattagaccactgacatgcaaagtgattattgatatagtgggattaatacctactctatttgttagatttttatttgttgcccttgttctttgaccctgtttttgtcttccactctttttctgtcttttgtatttttaattaaatactttacatggttccattttctctgttatacttttttccatatctattgtatctgtttatttaaacattttttagtgtttgccctaaaatatgcagtatacatttgcaagaatccaatccttcaaataacactatactgcttcatgggtagtgtttttagtaacaaagtaacccaattctttcctcctatcccttgtgtcaatgctgttattcattttacttatatgtaagcatacataagcatatagatacacataagatatatacataagcatatataacctaatacgttattgctattactattttgaaaactgttacatcttagatcagttaagaataagaaaaatagaagtttttaatttttccttcactttcttctccttctgtattcatattatgcatatgtttatattttgtagttgtttcacagttcttgaatatgctgtcctgctttttctagtctttattctctttgcttttcagttttggaggtttctactgatagatccccagtctcagaaattctttcctcagccacgttcactctactaataagccatcaaagccattcttcatgtctattacatggttcaaaaaaattgtttatatagatgtatggggtacaggtgcaattttgttacacgcatactggtcaagtcagggcttttatggtatttatcaccagaataacatacattgtacctattaagtaatttctcctcacctgccctctcacctcttcccctttctgagtcttcattgtctataattccactctttagctccatgtgtccaccttttttctcagcatccacttacagtgtttacagtgttctcatgtttctttgtttcttttctttttaaatttcgagacaggctacaacagaatccaaatccataggtaaagcaaactactcatgtaatttcaaagctgaagttgatagtatatttgtacccaatatgaatggttcacctgcatgagttttgagttctcaaaggccagtagcctcctttcccttttatgcatcttgagtacacttgagttagcctatgatacatgaatacctacaaagttgaggcctataaaacttacatggcaagcaatttgaaatgtgccaacaatgtgatactggagcaaccatagtgctgagaacagctttgactactgcaggaaatccacaaacctcaaatttagatgaaaacatttttgaacttaattcatactgagggacaaattatggtaatagtggagggaaagtctttttatgtgagatacaggaggctcctttagctctttcacctcctagagtcaccatagtggtaccttcatttattccttctcaaatattcctcccatcttcatttagatctgagtttcaggcctatattattttccctctttctgaagaactcttgacatttctttcaaggcatgtttactgacaacaaagtccctcaattttcatttgagaaaatctttgtttcccttttgaatgaaaattttgctggatacagaattctaaattggtgatttatttctttcaacactttattttactctaccttattcttgtttgagtcgtttttgaagagaattccaacgtaatacttatccttgttcctccagtaggtaaggggtttttgttttgtttttgtttttttgccttcctatagcttctttaaggattttcttttgtctttgattttctgcagtttatgtatgatattcctgggtgtagatatttcttggtatttttcctgcttggcattgtgtgagcttcctgaatctttggtttggtgtctgctattaattttggaaaattctcagccaatgtttctttattttttctgttcctttttttctcctccttttgttagtcccattatacctttattatccttctgtaagtgttccacagttcttggatatttgcaccatttcttttcagtctttcttctctttgctttgcaatttggcagtttctattaacatatttgcaaactcaacaattcttatctcagccatatccagtctactgctgagtccatcaaaggcactcttcatttctgtgagacagacataatctataggtgaaaggaactgatgtaaatacacctttagtgtgagattttatgcttatctggctaagagctctgcatgtattcctgtctgtctcccaaagtgtagaaagattttttttgttgttcagtttctcttaggacaacaggtcgttgtccacagtatgtgactcagcacccttggatgatgaagttggctaagatgttggcaggcagagaatcacccatggtgttgccagtggtagttaccgagaagccagctggggtgctactgaattctctggggagctgacctctgagagttgcccttcagggtgctggaaagactagctgggaagtgtacctgtgaggacaatcctgaaactcacttggaagctgccctatggtatgctggccaaactcactagaaagccacccttaggagtgccagcaaagctcactggggaggcatcttctacctatctcacatgccactggcagctatgtgcagcaagaacaaaccaaaaaagcactcaaatcaggaagtggagctccttcttccctcagcatctttctaatgccctctactggcaaagcttaccattgtccaactaacaaagggaaatgttcacaggatccagctctgccatcccaacccaggacaaagaagcgtgaatttataactcaaatgtaataaattaataactggcagaactgcccattacacataggatatattccaattctttgccagcacctataatgatttactctctacctatttcttcaacattattggaggtccaccctgcctactttccaccattttagccattctctgttatttgcacactccaagctcatcttacctcagaacctttgcccttgctatactccatgcttggaacaagtttcccctatatctttatataactagctctctattaatatttgggtctttgttaaatgtgacctcatttgaataatctaaaatgagcccacatgcctataataccttctgttgttttgctgtttagttttcttcacggtacttatcactaaattatccttttttttttttttactatgttcttatccacatagtaataagccaagtaagagccagaccataatctatattacatatcagcaataagaagagtacccggcaagtagtaagtgctcataaaaaatactatatagttgttgaatgaatgagtgatctctgttttatagctgaggactgaagctcagagagagaaagtaactttcccaaagaacacagctagcaagtgccagagtcaggagtcacctcaggtcctcctgatcacagtgctctgattgtcatggctctgtaccaccacctccctgagtgctggaaagagtgtagctgaggtacatgttacagtggagtctctaaaataattgagcttttgttatctcattacccatttttttctttctatggatctggctctctactgtgtgtgcatagatacagatccatgtactcgtgccccctactcagaataataatgtgttaaatatctttcaaagaaagaattattagacaaagtcatggaactcttcaccaaaaagatgaccttcaagaggggccatgcgcgatggctcacgcttggaatcctggcagtttgggaggccgttcgagaccagcctggccaacatggtgaaaccccgtctctactaaaaatacaaaaattagccgggcttggtggtgtgcacctgtagtcccaactacaggagaatcgctttcacccgggagactgaggttgcagtgagccaagactgtgccactgcactctggtctgggtgacagagtgacactctgtctcaaaacaaaaacaaaaacagaaacaaaaacaaaacctttgaaatactttgtaaaattagaaattgggtattgagaaaaataaaaatacatcaaatggaagacaggaacctagatcccatttttttcttttctttcttttctttttttttttttttgatggagtctaactctgttgcccaggccagagtgcaatggtggaatcttggctcactgcaacctccgtctcctgggttcaagcaattctcctgtctcagcctcccgagtaagtgggattacaggcgcccgccaccatgcctgccaaattttgtatttttagtaaagatggggttttaccatgttggccaggccagtctccaactcctggcctcaagatatccgcctgcctcggcctcccaaagtgctgggattacaggcgtgagccaccatgcctggccccagatccagttgtctaataccattcttcagtaaaataaaccagggctcttaggagaagtggtcaattctagcactggggcaggaaatacaaacataggcctaaggtaccagggcataaggaagtgttcagaaaacaaaaaaatcacacaacgatggggatatgttaaaaggaactgtagccagagaagggttcctaatggctgaagacagaaaaacttgagcaacaaagtcaacaaaatagtattggattataaagtataaataaatatccacgagtctgtccatactgatacaaataaatgattgaataaataaacaagtagtggagaataggtggatctcccatacagaagaatcccaaaaaatttatgtagatactctgtcctcaaggaggtagagcataattccacattcaagtgtgggttgcgcatactgacttccttcaaaataatacagttatggagagaggaaaaactaacttcatagtggaaaaatctgacaaaccccacctcagccaggggatcaaggtcagcatcaatggtatatatttttgatatgatgtgataagaaaggcatattatttccatagtcttcctcagcaaaccccaaacatcagcctaatcgtgaaaaaatcatcaggcatctcccagttgaagggccttctataaaatacctggccaatactccccaaatctgttaaggtcttagaaactgttttttaaaattattattatacattaagttctagggtacacgtgcacaatgtgcaggtttgttacgtaggtatacatgtgccatgttgttttgctgcacccatcaactcgtcatttacattaggcattactaattagggttactaatgctatccctctcccatccccccacccgccaacaggccccaatgtgtgatgttccctgccctgtgtccatgtgttcttgttcaactcccacctatgagtgagaacatgcggtgtttggttttctgtccttgtggtggtttgcttaaaatgatggtttccagcttcatccatgtccctgcaaacgacacgaactcatcctttttatggctgcatagtattctatgatgtgtatatgtgctacattttcttaatccgttctatcattgatagacatttgggttggttccaagtctttgctattgtgaatagtgctgcaataaacatacatgtgcatgtgtctttgtagtagcaagatttataatcctttgggtatatacccagtaatgggaccactgggtcaaatggtatttctagttctagatccttgaggaatcgccacactgtcttccacaatggttgaactaatttacactcccaccaacagtgtaaaagcattcctatttctccacatccttccagcatctgttgcttcctgactttttaatgatcaccattctaactggcatgagatgttatctcattgtggttttgatttgcatttctctgatgaccagtgatgatgagcattttttcatatgtctgttggctgcataaatgtcttcttttgagaaatgtctgtttatatcctttgcccactttttgatggggttgtttgtttttttcttataaatttaagttctttgtagattccagatattagccttttgtcagatgggtagattgcaaagattttctcccattctatatgttgcctgttcactctgatgatagtttcttttgctgtacagaagctctttagtttaattagataccatttgtcaattttggcttttgttgctattgcttttggtgttttagtcatgaaatctttgcccatgcctatgtcctgaatggtagtacctaggttttcttctagggtttttatggtgttaggtcttacatttaagtctttaatccatcttgagttaatttttgtatatggtgtaaggaaggaatccagtttcagctttctacatatggctagccagttttcccagcaccatttattaaatagggaatcctttccctatttggttgtttgtgtcaggtttccccattgcttgtttgtgtcaggtttgtcaaagatcagatggttgtagatgtgtggtattatttctgaggcctctgttctgttccattgatctatatctctgttttggtaccagtaccatgctgttttggttagtgtagccttgtagtatagtttgaagtcagatagcatgatgcctccagctttgttctttttgcttaggattgtcttggctatgtgggctcttttttggttccatacgaactttacagtagttttttccaattctgtgaagaaagtcagtggtagcttgatggggatggcactgaatccataaattaccttgggcagtatagccattttcatgatattgattcttcctttccatgaacatggaatgttcttccatttgtttgtgtcctcttttatttcattgagcagtgatttgtagttctccttgaagaggtccttcacatcccttgtaagttggattcctaggtattttatcctctttgtattaattgtgaatgggagttcattcatgatttggctctctgtgtgtctattattggtgtgtaggagttcttgtgattttttgcacattgattttatatcctgagactttgttgaagttgcttatcagcttaaggagattttgggctgagatgatggggttttctaaatatacaatcatgtcatctgcaaacagagacaatttgacttcctcttttcctaattcaataccttttatttctttctctcgcttgattgccctagccagaacttccaatactatgttgaataggagtggtgagagagggcatccttgtcttgtgctggttttcaaagggaatgcttccagtttttgcccattcagtatgatactggctgtgggtttgtcataaatggctcttattatttttagatacgttccatcaatacctagtttattgcgagtttttagcatgaagggcggttgaattttatcaaaggccttttctgcatctattgagataatcatgtggattttgtctttggtcctgttgatgtgatggattacgtttattgatttgcatatgttgaaccagccttgcatcccagggatgaagccaacttgattgtggtggataagctttttgatgtgctgctggattcagtttgccagtattttattgaggatttttgcgttgatgttcatgagggatattggcctaaaattctctttttttattgtgtctctaccaggctttgctatcaggataatgctagcctcataaaatgagttagggaggatatcctctttttctattgattgaaatagtttcagaaggaatagtaccagctcctttttgcacctctggtagaatttggctgtgaatccatctggtcctggactttttttggttgataggctattaattattgcctcaatttcagaacctgttattggtctattcagagattcaacttcttccactggtttagtcttgggagggtgtatgtgtccaggaattaatccatttcttctagattttctagtttatttgcatatagatgtttatcatattctctgatggtagtttgtatttctgtgggattggtggtgatatcccttttatcattttttattgcgtcaatttgattcttctctcttttcttctttattagtcttgctagcggtctattttgttgatcatttcaaaaatccaactcctggattcattgatttttttgaagggttttttgtgtctctatctccttcagttctgctctgatcttagttatttcttgccttctgctagcttttgaatatgtttgctcttgcttctctacttcttttaactgtgatgatagggtgtcgattttagatatttcctcctttctcttgtgggcagttagtgctataaatttccctctacacactgctttaaaagtgtcccagagattctggtacattgtgtctatgttctcactggtttcaaagaacatcttcatttctgcctttattttgtaatttaccctgtagtcattcaggagcaagttgttcagtttccatgtagttgtgtggttttgagtgagtttcttaatcctgagttctaattttattgcactgtggtctgagagacagtttgttgtgatttctgttcttttacatttgctgaggagtgttttactaccaattatgtgatcaattttagaataagtgtgatgtggtgctgggaggaatgtatattctgttgatttggggtggagaattctgtagatgtctattaggtccacttggtccagagctgagttcaagttctggttatccttggtaaccttctttctcgttgatctgtctaatattgacagtgaggtgttaaagtctcccattattattgtgtgggagtctaagtctctttgtaggtctctaaggacttgctttatgaatctgggtgctcctgtgttgggtacatacatatttaggatagttaggtcttcttgttgaattgatccctttaccattacgtagtggccttctttgcctcttttgttctttgttggtttaaagtctgttttatcggagactaggattgcaatccctgcttttttttgctttccatttgcttggtagatcttcctccatccctttattttgagcctatgtgtgtctttgcacatgagataggtctcctgaatacagcacactgatgggtcttgactctttatccaatttgccagcctgtgtcttttaattggggcatttagcccatttacatttaaggttaatattgttatatttgaatttgatcctatcattatgatgttagctggttattttgcccattaattgatgcagtttcttcatagtgtccttggtctttaccatttggcatgttttcatagtggctggtaccggttgttccattccatgtttagtgcttccttcaagagctcttgtaaggcaggcctagagtgacaaaatctctcagcatttgcttgtctgtaaaggattttatttctccttcacttaggaagcttagtttggctgcatatgagattctgggttgaaaatgcttttctttaagaaggttgaatattggcccccactctcttttggcttgtagggtttctgccgagagatccgctgttagtctgatgggcttctctttgtgggtagcctgacctttctgtctggctgcccttaacattttttccttcatttcgaccttggtgaatctgacaattaatgtgtcttggggttgctcttgttgaggagtatctttatggtgtcctctgtatttcctgaatttgaatattggcctgccttgctaggttggggaagttctcctagataatatcctgaagagtgttttccaacttggttccattctccccgtcacttttggtacaccaatcagatgtagatttggtcttttcacatagtcccatatttcttggaggctttgttcatttctttttactcttttttctctaatcttgtcttctttctttatttcattaatttgatcttcaatcactgacatcctttcttccacttgattgaattggctattgaaccttgtgcatgcatcacgaagttcttgtgccatggttttcagctccatcaggtcatttaaggtcttctctacattgtttattctagttagccattcattcttctcaccttttttcaaggtttttagcttccttgggatgagttagaacatgctgctttagctcggggaagtttgttattaccgaccttctgaagcctacttctgtcaactggtcaaactcattctcgtccagttcgtttccttgctggcaaggagttatgttcctttggaggagaagaggcgctctattttttggaattttcagcttttctgctctcatttctccccatctttgtggttttatctacctttggtctttgatgttattgacctactgatgggattttggtgtagctgtcctttttgttgatgttgatgctattcctttctgtttgttagttttgcttctaacagtcagacccctcagctgcaggtctgttggagtttgctggaggtccactccagaccctgtttgcctgggtatcaccagtggaggctgcagaacagcaaatattgttgcttaatacttcctctggaagctttgtcccagaggggcacctgcctgtttgaggtgtctgttggcccctactggaaggtgtttcccagtaaggctacacgggggtcagggacccacttgaggaggcagtctgtccattctcagagcttgaacacaatgctgacagaaccactgctcgcttcagagctgtcagatagggacgtttaagtctgcagaagccgtctgctaccttttgttctactataccctgcccccagaggtggaatctatagaggcagtgagccttgccgtgctgcggtgggctccacccagttcgtgcttcttggcctctttgtttacactgtgagctactcaaggctcagcaatggcagatgctcctcccccagtcaagctgcagtgtcacaggtcagactgctgcactagcagtgagcaaggctccatgggtgtgggacctgctgagccaggcacaggagggaatctcctggtctactggttgctaagactgtgggaaaagcacagtatttggtcaggagtgtactttttctccaggtacagtctgtcatggtttcccttggctaggaaagggaaatcccctgaccccttgcgcttcccgggtgaggtgatgccctgccctgcttcagctcaccctctgtgggctgcacccactgtccaaccagtcccaatgagatgaaccaggtacctcagttggaaatgcagaaatcacctgtcttctgcattgatctcgctggagctgcggactggagctgttcctatttggccatcttggaagcaactgcccatcttagaaactcttacagccaagaggagactaaggagacatgctgactcaatgtaatgtggtgtcctggatggatctgaggaagggaaagaggatatttggttaggaaactctgaacaactaaagaaatctgagtaaagtatggatgttagttaatattcatgtattagaattggtttacagtggttacaaattatagaggacactgggtatgtggtatagttatacgagaacaatctgtactctcttagcaactcttctgtgattctaaaaccattctaaaataaaaagcttccttaaaaaaaattgatggcagagcaggagtaagtatttttgttttgtaaccttggaaaaaagagagttgaggcaaaatccacagaggactagaacctgtattcctatctggtgtgggaggagagagatgacatttggttgggagaaggctggagccaagttatggtgttcagtttgtttctgctctgctgtcatagggctcttccttggaggagctatagctctatggaaccgtatgaatgggagagtaaggttcaacagttcgttggtgtgacctgggtgtatgtgcacatgcggatgcattgtgtacatgcaaactcaaatccccatagcatccagctaggaagtctaaatgagcaaagcaagttgggtataagaaataagaaagtgctgggagctatgcttaataggagacacaagcctcaaatagcagaacagctgctgctctgttcagtgccgggtgatttttgctgtgcgggaaggtgaactgagatgcattttctggtatttcaaaagaagctgaaaatctagatttactttttgaatgtggaaaattctgctttttaaatgttggcaactatttcagaaagtttttattaatcatcatgtatgcccaatctgtgttgaaggaaatgtgtctgtggactgcacacagtccataccaccaggttgcaattatttctgtcaacctgagctatgctgagtccggtgggctaatacagatgaggcagggctgtgtctgtgtggtgtagagcatggagtcagtctgtgtcctgagctgtgatgagatcattctgtgagagtaaataactgagcttgtacttgaaagttgaggacaatgtggagaacaaagagctaagagcacaagcaaaggtccagaactagaacatcacagggtgtgttttggagactggatgatttgagtaaagaatcatgaagagcagaagtagttatcaggctagaaagttaggctggagccagataaggatgggcctgagtatttggaatatatactgttggcaacagatgactaaatactcgggttctcttgaaggagtacagggcagaaatcaggagatagaatgagaaatttgacatttacaccagaactttccagccacaaagagcaaggtagagtcaattaatgcactgagtctagttagaatgattgggttaaggtgagagtggccattcctaacacttagcaaaacagtgtgtatgcatatgcctgtgtgcagttatttgattatacatacactttccagctgggctaggctggcctatctgggcccagtcaactgctgtggacactgagctttaacaccaataagtgcgtgccgtattcatcctcattctcatttctttctcagtgcctcttgaccctccaaggattattgcactgatccagaactgctaaaatggagaaagccaggcctgacctgtgcgcacagcacacagcattgatatttgatgtgagattaggtcagagtcagccgggaagccttctaaagcgtggcatacagccaacaaaatgaaaaggctttattctggggggaaatgtttccctctctgcctggcttgctttccttatcctcccttagacatcctttcccctaaattctagttcattattttcatttgaaactctcaaattccactgggccactagctgaccacattcctccctaaacaatagcattctattttaaacacttattgtgccaatgttgacattttaatagcccaagaggggctgaaataactactcctacctcaccaccatcaccaaggagatcaagtatcatttctaggatttatggtaagcccctcacggtgaaagcacaaaaatcagaggccaggaaattggcagctacgtattttaaataggatttcggtaatctttggctggtctttcctaacaatgttgaagttgatattttgtaacttaacattggttctagttctgcctggtgagtagctctaatctcattttcattatgtgagaaaacacttattaattagtagaaactattggcaaacttgatatagttgtgaatgaataatgtaaatccctagtggggcccttcccaaacccttgctccccttcctaaataagcaaacagagggaaatttctgattttagtgggatgatgtaccactgattacccaacattgcttatgactttaccattaagatttataatgaaaactcttttatctatatgtaacaggaattaaactttatgcaacaagttaaataacaaactttctcgatatccaaatgagtgctttctttatccaagttcatcagtgtaggggaaagtcctaaccttatttcaaaaatgtgcaaaatattttgtaataactaggtaattctaaaaacatataaggaattatctgaagttaagtgtggtgagtgaagtggatgattgatagtcatttgggagcagtaaagtgggtaagagtaaaaattaatgagacagtcttcttcacgtggttcaaaaaacagcttctgaaggcagtttccctggaagagctccagaagtgttcttgtatgtggcagtaaagaaagacaatactcctgatgactggtaaccaagtaatgctggcttaaacagttacttatgtgataatcaaacttcccttgctgatataaaagtttttatgtattcttggtttgatcactcctaatttgtctgcatgcaaggagaaccagacttaaggtaggatccactcatttactgactgattgcttattgaatgccttctctgtgctggacagtaggagtaagatgaggagcactgtggactttgtccctgccctcatacatttatgataaggggttgtggggtcagggcatggaaaaaacaaaaggcaaatctttaagacaaactgattggaaacgactgctattggttaaatacacccacatgttgagataatttgtactttcccaaaacattatcttgataacattatagtcccagaaagcgttagggaatgtagtaatgaaactttggcaggtcttgtgcctctacaatgtttgtgttgctcatgacctttgtacatgaatgcttttgcccatgtggccagtcaaaaaatgacctggttgacctgtttttccaaaagacctttgaccaaatctttgatggacaaacagagaatcatgttttcaagaaggatctacttgcaagcaaagttctatagtgtagtcagggaaggctctatgaagtaatgaactcttctggcaaagatctgaaggatgagtagaaaatagtctggtcatgagctaggggaagtgatttacaggcaggagtaacatgtggaatacagaataatttgactttaataaatttcaaatggtaaaaattttccaaagttcaaaatagaaacataacatcccgtgatattagaaaatctcattactttactttagtctggccagaaatgtgtcaagaggaagacttcaaagaggtagatttcatctctctggcctgtaaacaaaatgcccaaaacacttccccaaggcttaaagtcagtttgtaattactcttttcatcacctcagaagaatttccaaactttagtaacgtagtaaaattttttttggcctttgtgaataaatactatgaaatttggttcaaaagataaagcaaagagcaactgaggtcttcaaaacatcatgtatctagaaggtattaccaaacatccgttttttttaaaaaagcataaggcataaaatcaattcactaatgtcatgctagagtgaggtagtaaaatgaggcaactcagaccagatggtgtaattcataaacagggctgtcatttgggaaaacgggtggagtggatggagaaattaacttgcagtctttccccttccatttcttcccaatccaactaaccttattcctctgggtcatttagctgtggctaaaacacacacacacacacacacacacacacacacacgtgtgtatatatataatatatatataatatactttttacttatagccataggtaaatggtgaatgaagtagatgattgacctgtgtgcatagcacacagcattgctatttgatgtttgatgaaatatcaatgctctcagaataaataattaaatgagtgtatatatatagacacacacacacacacacacacacacacacacatatatttcttttttaaaagagtgtaattgatgccaaagccactttctcttcagagctgcttaactacatgaagagtgtgcaccaacctggggttgcaaagagttctctaccttgtccggcttctggaaaggatgtgcgctttgctcaatggggaatggataagatgaggatgtcccactgctggttggttagtacatttttgtagatgaagcaaagcacatctgttcttatacagaatctcatctttaaaagggacctcagatagcatctaattcaaaaactcatctaatgcagtgcagtattcctctaagatacatacataaatgctggctaaatgcccccagggatggaagtttactgcctcacaaggcagccaattatctttctgacaggtgccattcttcctaatactgaggtaaagtccattgttctttagcttccacaaaaagcagtgataatactcttgacggcttgccctgtgccagggtctgtgccaaggagcttcatatgcattgtttgtaacacttgcaacattagtggcaggcagggatcatcctgcacattttacaggtgagggaactggcacaaggtcacacagctaagagagaaggatctagtctggctaaatccaatgcctaggccaatttcttgacaccatgcataattcctgtttcaaatttctatatgtgaaggcaccttttagactcttctgttttctcattgatttctcatatggcatgccttccaatgctttcagaatatgctatgacagtatctctataaaaatataaatcaatacaaaagttattgacccctagaaaatgacaatcacatacttcaattaaaatgagtagtacaaagagacttccttgaatcttttaataatggcatttatttttacataataacagcagcatattggttaagacatggatttaggtagatttgacacctggtttcaacattcattagctgtcagattcggggcattttatctaacttctcaaattatcagtttctcacttacaatgtggggatgatgatgatgcctatgttttagaattgtgagacttgacatagtacatataaagcacttagtatgatgctggcactatcttcaataaatggtattattatttctttatttgcagcaaaccaaaacccgtatgattgttgtcaagtaagacttcccctacatcatgtttgtaaattagaatgttagctataattataagaaattgaaaaattcatgttgtctaatcaatattacattttagccagtagtttcagccaggatcttggttctctcattaaatatactggtaatctttttcaattttgtgtcacctgcaattgttaaacatattttcagtatctttatccaagttgttgctaaaagtgattgaacagggaaatcaatgtttgttcccatctgtgggtgctgttaacagcttcgtatgtgtgttttacagtcacatatgtaattttccctgtgcttttctgtctatatcatacacttgttgtatcccctagtgatctctgaagttttaagctgtctttgacctatgattctgtacatctcctgatattgacatagctgaatctattaactaacttctaaaatggaaaccaggacacctggggctcagcactagcctttccccagtgtacttaagccctctgtggctccatttttcatacttttaaaactgagcaaatatttgccctctccttcctttcaatgatatggtgaaaatgaatttaaagcaattataaaaaggacatgtgttcttataattggtagcatatcatttacagagaaattcctcatctggtcactatctaagtagctaaacaactaaacattagcaagagaagtctttgagcagtcaatgtaaatgacaccaagtctatgcatttatcatgtgctttactcatagactcatacttattcacagtcccattacatacacacatctaacaagcttgtttatttcatttcccagtccacagccaaatagaggaagaaagtggatggagactgcccaaagtgggtaaattgaaagtagcaagaaaaggccaggtgcggtggctcatgcctgtaatcccagcactttgggaggccgaggcgggcagatcacgaggtcaggagtttgagaccagcctgaccaacatagtgaaaccctgtctctattaaaaatacaaaaaattagacaggcgtagtggcgtgcacctgtaatcccagctacttgggaggctgaggcaggagaattgcttgaacctgggaggtggaggttgaactgagccgagatcgcaccattgtactccagtctgggcgacagtgcgagactccatctcaaaaaaaaaaaaaaaaaaaaaaagtagcaagaaaataatcattttgaaaggtgaaaaaaaaaaagacaagagaattataaaaattagaaactcaaaaagtaaagaagcctgagaccactaattaaaggggaaagatagccttaaacatcagttttcaagaacattactgaattacaagttaatactataattgatgttcaaaatgattattcattattgtgttggacttccgtgttttcacatgctcagcattcattctgctctcctctggaggcagcactatgatttttcttcagaaaattacccttcccaatttgtattctgttccaaaggaaccatcatgtaaggagctttcccatctcctgaacaaggctgagcttatggtccaagacaagtcagtcacctttttgcaggaatttggatgttgagcagagccaacacaaagctactgggctggctcatccttatggtggtatcctgaattcttcccttccacgtagaaccctggagctgcatggtccctgaccttttcaagactggttgtccaattttcttttaatttggaagactactttaaaacattctaataaaatatgttagtcaaaggtggtctttggctgctcacagcttgtgtttcataactgacacagattcattaaagggatcaattttgttctatatgcagtgttcaaaaagccacagatatttgtaataaaaattaaaaataggccaggcatggtggctaacacctgtaatcccagcactttgggaggcagaggcaggaggatcacttgagcccaccattacgaaaccagcttagacaacatagtgaaaccccatctgtacaaaaatacaaacatttagctgggcatggtggtgtgtgcctgtaatccctgctgctcgggaggcttgaggtgggaggattgcctgagcccaggaggttgagtctgcagtgagccatgatcacgccactgcactccagcctgggtgacagaacgagaccctgtgttaaaacaaacaaaacaaaaaaccccccaaattaaaaatatttccatccaacttggttaaaatagaattgaaaacctttagcattaaagggatgtttccattataaataagttactaatttcctaaccatactagatgaatgagttgttattgcatacaaatccaaaaattattacattttattgtagcttgaatatatcttggtgaactcattttcttagagtggctctggttagctctttattaaaatgacaactgatgtcacagaagctgcctgaggacacatctaaaatgaacatgcttttagtggtggttaaaatactttgaacagtcaacaaatatttacagctctttttgtgtaacgtgctgtactaagtgctgggataaagcagtgaacggggtggacatagcctcagaactcccggagcttgtggtccaatagctcagtaaaggtctactgaatgaaagggagacttccctttgctcacaatgaggtcattcctcatgtttttgccaatgtatttttcctgcctggataatccaccctctgacctttatccacatcctttacccatttctttttcaaggtccagatcaaacagcaagttctccactaagcctctaacaataataacactgatggcagctaaacatttattgagcctgatgctaacctctttacatggattacataactcatttctcacaatgcactatgagatatttacatataattcttcagtaacccaattgaggggaattgcagggcaattaaaaaatacgtataacttaaaatgttgaactcagcatgcccagaactactagaatctttttgagcatagaacttaaaatgtaaggtgcgaagaaaacaattttatattttactgtgcctcagaattgcttggtggggtcttttaagaaataaagatgccagagtacattgtcaaaatttccaactaattaaaaacacacaagcacacatatgcagaacacagtacagaaaattgccgcaaatatcttctaaagataaccacaaattgcactttatgtgtttccattcagtttttcttctttttttgtagctataatcttttagacataattttaggataggtatcaccttatcagtgagatctttccttacccacctccattccctgtcctcattactgcttaagttttctccaaagaatttcttaccttctatttattaattactttttaatttactttgcttcctcagagtaacttatctccccacctccccgtggccccacttccacatacatactagaatgtcagctccataagggcagagatttttgtctactttgctcacttcagtatctacagtcgttaacagagtgcctggcatggagaggtagcttagtatctctttgtccaatgatggatacctgaatgaatacaactgtcaaagtgcccttcagaaatgctgtactatttccacttctacacgaagggtaaggcagtgccatgtggaaggtatatttttaatgggtgggaccttgagtcatcccttgaatgccacctgggatctctgtggcaggcacttgcaacaccaaaggagtgtacactgtgcctggggccaagggcaggtgccatacacaagtgcaaggccatactgaagaggccacctgccctcaaatgggttcaacaggaatgctttttaaagcaatgccccaaaattggttttagcacttgattgtataacctgaccacattatgagttctggaatttgttcagggctgtgtcctgtttcctttagatcacatctttctctcacccagattgcctaatttttgaacttttaaagagcagagtactgctttcagtgctatttagtcatttcccacagctcttcatccctttagagtagcttttatagttacttgggccattttgggtagtggacattggattactatttttgttcaaccaaataaatggaaggcttcttagtattattaatgctcaaaacatgcaacccacactcctattatgcaattgaatattgttttgaagtcatcctgtaattacaagatttccttccaaatcagacaataggtctgaaagtagtaattttgacctaaatatgtgcaagagcttgaagggcttcttataaaaactaagaggaagaccaagtttagtggaaaaacacccaggctaggatttgggagacctgggtcccactgacatctctgccaattattggctctccaagtccccctttggttgggtaatggggccgtccatcctaactcactctattatgtggaatataaatatgggaatcacaatgaaaactgtaaaattatattacatctaaaaggctgccatgttttcttaaacactggttaattatggtaggtagaaagaggtcttttgaaggcttttagagctcattttcccaaattgttttgtgtggacctctgcttcagggagatgtatttagtcagcttttgctgcatgccaacttcaatatcaaagtggctcatattccatacacattcctatgcttgctcgtctgcagttcagttagagttcagtcctgaagtttaagttgaaaggaagaaacttgatcttagtgggtacttaatctgttcagctcactaaaaacaaaaacaaaaacagctcagttgtatggaaggagcatgttaaccacaaaaagtaggggtagaccagaaagaagtaagctagaaggtgggttttggaatgagatcagcgccagtgaatctacccttcagttctagatttgagaaaagtagtcaaccaccataccaatgggcaacaagtaggaccaatggaaactgtactcaccccacctgttgaaaacctggagtttgagtaggtcttgccttgtgtaagaaggagtggagaagaaaaaaatcacaccctacatttggtcagggccaaacaagattgaggacaaatagaactttgtgttaaaatacttgtcccaggtccagtttcgttttgcaggattcagaaagagttgtgtttgtttaatacagtcttataaagaatttccaatcccagaggattcatgaagcaaagtgatgctacagcttccacggtgtgtatgtcagagcaggcaggattttggagattgtatatcccaacactgtaattttacaaatggaaaaaggcacagggaggaaaataaagctcaggattattcagttggaggagatagaaatgcacctaagtcccatagctcttagtacaggacatatttttttttacaatagcagcagcagcagcattattaaataatgatcatggaacatttatgaatctaggcatagttctaagtattctatatggattatgacttttatgccttataatagcccatagaggtacacttcccctttgtacaggtgaggaaaccgagagaggcagagaggttaataaacttgtccccagagtaacatgtaagaaaatgatagagataggacatatcatgaagcaatttccaaagcgtatctggcatataccagcttcgcttccagagacatctacctgaccagaggtagagcagtagtttacacttcttcacttgttcagacaataaagaaaatgggttttgaggaagccctgtatgcctttctaaaagtgctttctaagacagagtacatatttcctgatcttctgtatatccgtcatcaaactcaactgtcatcttcttaatgccaggtagatactaaaccacaaatcctccaaaacaactgggcagaaagtagaagacaatcagcagcattcactgctttctaagaaggcaattcccaggaatacagtcctgaaggtttaagttgaaaaagaaacttgatcttagtaggtatgtaatcagtttagctcactaaaaacaaaacaaaacaagacaaaaaacaaacaaacaaacaaacaaaaaaacaactctgtcaggtggaaggaacgtgaaacgtgttaacccatgaaaaacagaagcaggccagaaggaagccagctagaatctagggtttagaatgcgagcagtgcctgtcaatctacccttcagttctagatttgagaaaagtagtcaaccaccacaccaatggacaatgagcaggaccaacagaaactccatccacctacctattgaaaacctggagctttaataggtcttgccttgttcaagaagtagagaagaaaaataaaacaattcctatggtagaaaaaaaaaagatactgtgcaacaaagaaaaaccgtatcgagatggtttttgaggaagaatacacatgtgaaaaccagctagtctgggatccagaaaaatatttaagaaatagtctggcatcctcagaaaagtacaagaagatatggtgtctatgaaccaggagctgcatggagacagatgtatccagtaaggactagagtgaagctaagatataatggaagggagacaaaacactccctatctctggaaacaaaataaaatggaatacagggtgccagttaacccttgcagtaaatgataatttaaaaggaaaatacaaaatacccacaggtgaatgataacgaaagtatctcatatcaaaatttactggaagtcgctaaggcagaggaaatttataggtttgagtagattttctgtttttcctatttatttatatattaaagatatatacatgaggatatttatccccattttacaaaagaggaaaaagaagctaagagaagttgagtagcttgtcaaagttcacactaccagtaatagcagagccaggatctgaaccaggaggtctggttcactcttaataagacagaaaaatctctagcaaggttaagaaaaaaagaaaagatatgaataagcaaaatacatgataaagagagaaagaaaaaaatgttttgaacaactagcttacactccaataaatacgtatatattagtttcctagagctcttataacaaaataccatagactgagtggcttaagcaacagaaatgcattttctcacagctttggaggctagaagtctaagatcaaggtgttggtaggtttggtttcccctgaggcctctctccttggcttgcagatgactgactgccttcctactgtatcctcacgtggtctttcttctgtgtgcaggcatgcctgctgtcacatgtatctccttataacaacagcaggcaggttagatttgggcccaccctaacagcctcattttaacataatcacctctctgaaggccctatctctaaatacagtcacaattcgaggaattgaggattaagactttatatgaattttctaggaatatgattcagcccataacagtctagaaaagtgggtttcggggaaaaaaaacccacaacttcccagcataaatgtgaaatagaaaattaaatacaccaataatataacatgattattaatcctttccttttactaccacattcctagtagatagagactgtggttgttttacaggtgagtccaaacacactttccaaggaacagaaaatccctatattactttagttgtatcagaaaataaaagataagaaaaagttgcccaactcatttcattctaaaagtggattgaataggtataataaataaaagtaaattatagaccaatgtttaagacataggtacaaaaatcccagactttatattatttaaaagtaattacagcaatatgtataggaattaatacatcattatcaagttcaatttattccaggtatgtaaatatacttcaactttggtacaagtttggtacaacttcagacacattatctttcaggtaatttgctaatgttactaaaaaaaaaaaaacaccccagaagaaaagttaaaaccctaaacaaaaacaagaaaaagaagagtataagaattagaagaaaaaagaggaaattagcattttagaaattttatatgatgatttaatatggaacacctacaacaagctacagatacattactaaaattgattaaaaagtttagataagttgttggataaaaatcaatatacaaatacattgtatttctatacaacagcaacaaagctctaaaagagctgaaattaaaagttacaatttaatttacaatggcaattttacacatacacacacacacacacacacaccagggaatgagctgaaaaaataaagaccttaatggagacaattattaaatttattaaaagatattaaaaataccagaattaatagaagatatatcatatgtatgaatttgtagacaaaatattttgagatgctgtatctactcaaatggaacaatatattcaatgggattaaaatatgtatctgaaggcaatctgtgttgtactaaaaagcttgaaatgacaaagcttgaaagctggttctaaaatttatatagatgacttgagggtctgagaatgacccaaattgtcctgaaaaagatgaagcaaattttattattaagcttattaaataagaagtgagtgagtgactggtatgaggactaagggaccaagggagcaatggaacataacaaacttggtatgtgacagaggtggcattgctgaaaaccagtgaaatgagggaattggtcaacatatggggttgaaataattggttacttacatggaagaagtggaattggatgttcactttaccatgaacatagatatcaattccatgtctattaaaaatgtaaatgtgaggctgggtgcgatggctcaagcctgtaatcccagcactttgggaggccaaggcaggcgtatcacaaggtcaggagttcgagaccagcttggccaatatggtgaaaccctgtctctactaaagatacaaaaaaattagccaggcgtggtggcacacacctgtaatcccaactacttgggaggctgaggcaggagaattacttgaacctgggaggtggaggttgcagtgagccgagattgtgccactacactccagcctgggtgacagagtgagactctgtctcaaaaaaaaaaaaaaaaagtaaatgtggaaggtaaaagtctacaaagggagtatctgtgacttggggcagggaaatattgcttagacaaaacacaaagcgcacaaaccataaagagaaagattggtaaatttgagcacattaagaacctctgttcatcaggagacactgtaaggacagcagaaagcagacttggagaatgttgtgtgtgtgtgcgtgtgtgtatctagcaaataattagtattcagatatacaaatcaatattgatttttctacaaatcaataagaaaaagacaataccatggacatgttctcaaactccttagtaatcttggaaatgaaaattaaaacgacaatgtatcaccatttcctacctatcagattggaaaaatacaacctgatattacaaaaaactgttgatgtaggacaatgagaaccttagacaatgatagattcagcatggaattaacctaaaggaataaggcctgtctcctaagtttttgagggagttacgatatcacaacaaccttaggcttgtgtggcatcagcctgtgaatattaacttatatcaaggccaccgctataaaatcaaagtccttaaaatgccctaccaggacttggtatgtatgatctggttctcccttgcttctctaatctcacttgttactactttcccatcactcttgccatcctcagtccttggaagtatttctcgattattcttttatatttgccattccctcttaccggaatatccatcctccagatatccacatggctctgtctcttcattcattctagtgcctgctgaaaggtcatctttttaagatgatttctctgataattttatctgaaaagtgaccacccatcctacttgtcactatcttcttccttgtttttttttctttataaccttcatcatgactttacattttaaatttttaattttttcccttctctccttttttttttgagataaagtcttgctctgttgtctaggctggagtgcagtggcacagtcatagatcactgcagggtaattttaaattttttgtagaggtagggtcttgttacattgcccaggctggtctcgaacccctagcttcaagagatcctcttgcctcggccttccaaagtgctgggattaaaagcaccagtcactgtgcctggcctttacacttttttattgtgtgtttgtatccgtccactaggctactattgcgatacccctagttcccagattacttggcccatagtaggagcttaatatttgtgtaatcaggggacatgaaattccttataagctcttatttaatagaattaacaaaatattttacttctagattttaaaatctaatttactaacatcatttgggaattttgttacatatacatgcctcccacacttttttttttaaaaaagagttcgtttatcacacacttgttttttaaactaatgatttgctttcaagtcagtgttgtcacacgtccaaggttttcctacattctggtcaatatttattctattgtggactgtacaaagagagcgtcatcagttgttcttttaacactgagacttgtcaatatgaactaggaaagaatgatgataaagaacaccgaaggtacaggaggactctgggtgaggcatagtgccatcagatcagaatcctgagtatttcatgcaactgaaaagcctctggcttcaataataactcatggggaaggaaagttgttccacacccaaagagatcatattttgtaacaagccaatgagatcaagatttgtttaggtcaatttcagagcaaacataggttatcagatgcatccttcaatatggtttactagaatctgaaaattgcatgcttcttttgaagaaaaggatggttaaaggatactgctatgatttttattctgaaattcatcacaatactgtatatgtttataaggaaatctgctatctggtcagtgaaaggaactatctttcagacaactaaattcatgtttgtttcatatgaccaaaaatgcagacagaagccggatagtaaagatgccaggcagagagaatacacttgaagtagttggaaactacttgggtttaaattattggttgaaatctactggggttcaaattccatccatgccactcactgtttgacattgatcaatttagctaactcctctaagtctcaatcttttcatccataaagcatttcttcatctataaaacagggaagagtaatgagaaaattcagataaagcagtcaacacacgttcataattatgttaatttacaactaacgtatcttgaatgcttaccatgggccaggcactgactgggctaagtgccttatgtatatttttttcttttttaatcattatgtgcagtaggtgttgtgattatatcctttttacaaatgaaataaaaggcaaagatgagggagccaggacccaaaccctctgccctgtggtgggccccaaagtctgcatttgaaattcttggctttcttgcatctttctgttgccatagagagcatcaccatcaccttttagataggaggtggggttcagatgatcttcaaggttgcttacataaatcttttcttgttgtcacatgcagacacacaaactctctctctctctctttctgagaggtcagcccattttcctgtctgctacaagttgtgccattttcagtattgttctaaaatcagattagtcacaatagatcctatagtgcttccattaccaatttgtacagtcagtctacaatattgcttataaaaatgttcttttggagccattgtgggtctctttgaacatttctgcaatgttgtctgtacagacagtacatccaagaagaatgaggatggggaatgacgtaattaagcctgttgggaagctctctctctaaggtgaactggagtgtcagatggagttacggtgcttctgaacaccattccccaaagctccattttggaatcttagatttaaaaggcactttagcaaatactgtaaaccttttctctcatgctgaattactttggtaatattcttcatagttatctccacttgctgtagttggagagggaagcacaatcttctgggaattttaactttatttctggaatctactaacagatagttcattcagccgtttttctttatgcaactttcattctctgatgtgagttctgcctttgaaagcagaacagaatagatatatattttattcatgaaaaactttaaaatttgaaggtaacagtcaaatttcactcatgaggcagggattgggtctcattttgtgctccattataaccatagcacctagcgctgtgtaggaaatatagttggtactcattaaatttcttgatgaatgactaaatgagttctctcttttctccactagagtgactgaaagaaagtattatatttctttgacatgtgaagcataaaatgtgaccattaactcttctcaaatgtgagctccatgtggtgaaggaccacatatcatatgtaagcaggtaaattcatgattgagtgaataaatcctgaatgctgctctagtagtggttgtaacgttttaccctgccacacttggccatgacttgttggagaaaaggtaaatatctgatttaatctgggccaatcaaattcctctcctgggtatttggaattaagacctatctctggggagatgagctgaaagttccaacactaaggctgaaagtgaggactagttaaagcctcatggaggctaacatttctaggagaaccaagagtaacaaagatgagagacacgtgacctcagggagaacatgaggtgggccatatggctgtccagatacctgatggctttccagcccgtggctccagtttccatgatggtcagctgttcttcatttctttgagatctctgaatccttacaataatcaccgtcccaccctgacagaaaaacagagaaacacacacatgtgctgttattgaaggttgcctatgttagttctgttcctaccactctataaaacagtttattcaatctaatataacactaattcttgactcatattctgcacacagataactaaaacacccagatcttttcacacaaactgcagtttaaccaattgtataatagaatttttggaaagtttgctcattcacccattcattcaacaacaatatattaagcaactactgtatgtgaatggactttttatagtttttactatttgtctgtcagttgtcactttttgctgctgcgaaggatgttgtcttttctttccatttacttattagcagtggaattgagtaatgatgagtaaaataaaagctcgtaagctctgaatgtgggcactacatgatgtttgtcatatctattttgagtgtggaaagaacattttgcctactgtctgtttccctcttagattctgggttgttgtaggtatagtaagtaaatattggatacttgaattgttatgtgtggttttatatatacatttatatgcatatatcttatataaatttaaatctaaatatatatacatagctaggaaaaaacaaagtaaggttgtaccagagtaaagaaaagttgaccatatttaaataaataaatgtgattacatttacagaccagcagatgtacttgggactgtcacctctgtgtatcttgaataaaactgaaggttaaacttgtcccttcattgggctttaaattaaaaaatttttttttaaaattatcttaggtacataataggtatatatatatttatgggcacatgtgatattttgatacaggctacaatgtgtaacacctcagggtaattggggtatgcatcacttcaagcatgtattatttctttgtgttaggaacattccaattccactctttttctttctttctttctttccttttctttctttcttttttcgtctttcttttctgtttttcttttgctctccttccttcctttctttctctctttctttccttctctctttctttcatctttctttcttctccttccttccttcctttctctttctttctttgtttctttctttcctctttctttccctccctctctccctccctctctcttcctttctttccttctttctttctctttctttctttctttctttccctccctccctctccttccttccttccttcctttctttctttctttctttctttctttctttctttctttctttctttctttctctctctctctctctctttctttctttctttctttctttctttcttttctttctctttcctctttctttccctccctctctctctctctctttctctttctctttttttctttcttcttcttcttcttttttttaacaggatctcattccatcaccctggctggagtacagtggcatgattatggctcactacagcattgaatcaacctcctgggctggagcaatcctcccatctcagcctcccaagtagctgggactacaggtgcacaccactgtacctggctaatttttgtattttttgagacagggttttcttatgttgcccaggttggtgtcaaactcctgagctcaagcggtctgcttgcctcagcctcccaaagtgctaggattacaggtgtgagccaccatgcccagcctagttattaaaaaatatacaattaattattgttgactatagtcaccctgttgtgctaccaaatactagatcttattcattctatctaagtttatttttgcacctattactcatttccccaccccctaccactcccaccctgctatccttcccagcctctgctaatcatccttctactctctatctcaatgggttcaattgctttaacttttagctcccacatgtgagtgagaacatgagaagtttgtctttctgtgcctggcttatttcaccgaatataatgtcttccagtttcatctatgttgttgcaaatgacaggattttgttcttttttattgctgaataatacttcattatgtatatgtaccacattttctttatttgttcatctgttgatggacacttaggttgataccaaatcttggctactatgaatagtgctgcaataagcatgtgagtgcagatatctcttcaacatactgatttcctttcttttggatatttacctagcagtaggattgctagatcatgtagtagttctatagttttccaaggaactttcatattgtttgccatagtggctgtactaattgacattcccatcaacagtgtatagggactccccttttgccacatcctcaccagcatttgttactgtctgtcttttggataaaaacctttttaactacagtggaatggtatctcattgcacttttgatttgcattactctgatgatcaatgttgttgagtatttttttatatacctgttggccatctgtatgtcttcatttgggaaatttttattacagatgttttgcccatttgtaaattggattatttgattttcctcctatagagttgtttgagttacttatatatttgggtattaatcccttgtcagatggatagtttgcaaatattttctcccattctgtgggttgtcacttcactttgttgtttctcttgccacatagaagctttttagcttgatgtgatctcatttttccattttcactttggttgcctgatcttttgaggtattactcaagaaatagttgccaagaccaatgtcctggagaatttccccacattcattgggcttttagttaatctcctccatcccactctttacttcaaccaaatcaaccaacatttaaacactcattttcaagctgcttttctgtaattccaatttgttgggatttccctggcccctatcacttgtgagttcagttttatgggtgagaggggacttgataaagaaggcacaatttttttttcataccccaaatgccagggcaataagccaagtttatacttgatgcgtcctccattttcattagcaatagaaacagtatagtgctactaaggtcaggggtttgaaccctggctctgctacctttcaggtatgcaatctttcggaaattctcttaatttctttgagcttcagtttcttatttctaaaagataattaatactaccagattatagtgattactgtgagggctaaaagacttaatgactacaaaatactcagcacagtccctggcacctagtaaatatccaataggtcatcgcttccagtgttgtttttattactgggggatgctgctgtccacgtaccaaaagagaactgtaaaaaacagcttgcaaagtaagagaaggaagggaagtgttttaatgtgtaatggcacattacattttctggtaatcccaatgttactttaaaaaatcttaaaaatttgacagtggtagcacagtttatttagagccttgtcttggggataatatgaatttttctgggaggattatacataccaggcttcttttcctgtgagagcaaattcccttggacttcttaaatttctgttttcttggtgtagagactgttttctctaattcactgtgggttttctgaacttttccccgttcaatcctagtggtttcaatctgggctgttgtaagaatggcttttagaggaaagagatattagaaatgacagcttttcaagatgaaaaaggtgccttaagactccaaataattctgttataatttttcatttcttcttaagcattttacggaaaatggcccatcttgagtatttttatccttgggcctaaaaacaagttcttgttagccagcggctaggcctttgaagctgcagtgcttgtattttggtctccaccctcttggatgacttgtggaagtatcttccaagctccttcctgattgcgtttccccagtttcaactgagaaggagaaagaactgtgactatatcgatgatttcagaagtgtaaacaacttatcatgtttgtggaacactggataaccctcacaggggatgctgaggaatctggatgcccatggatttttaataatgggagagaatgctatttggaaatcagaggattgaatggatcttggattggatcttgaacacaagactccaactccaaaataaaaactgtgggctgaacaatatgcaattatatatgtggttgtataatgtgcttccatttccttactacaccctaacaaagtctttgttgctggcagggagatcagcctggccttaagaatctgcttctgctagttcagatgggaagtgattagtgtttgtcatatgcttaaaatcctttatgataaatggcacaggcagttattttcgtatgtacacagaatacatcacgaagatcaaagaactctaaccagaggccccatttccagctaacaggtctgagtctatttgggtttagattgtaaaacttcaggaaaatctaacgagcttatgttaccctgaacaagaaatgagatttcttagtaatacccactattgctaagtgactattaaggtagccaaatatcattctttacctatgctttagtttaaaatttcaaagagaggtatggtcagatttatccatgtgttcaatatctaagattttgtcttttaagggaaagcgctttctcctctgattttctgcctaggggaacctcaaggtatctatggcgtaaaagccaaacgtctgttttagcaaatagccagacattacagtggggagtatgtagatcatcttgattattttaccaaccatcagggcagagatggaaacattgtgagctgggaacattgagtttcatttttaccagtatccttgccttttagaaggtatctgttaggagtacttaaagtaaaatggattgtttctaaaattgtgagatgagctatagggcagcttttctacttaattagcttttgtcgttttgtgtttctgttgagaaaagctgagtgggacccaagctatccattcactgcagcatccaagttgcttagaatccttttagaatttagctaagaatactgtttctacccattccaaaaagtatagctagataatttgtaaattcaatttcatgttaattataaacaatttcttgtgctcctttctgtactgtgggtatttaccgagttcaaccatagcttatacctcatatgagaaagattaacaataaaaaatcttttctgtgcacaagtgggggtaaaagactcattatcttctctactttacccccagtgcacccaggctccaaactccagaatcatatattctttctccacttccaatctaatattaaatcatgttgatttttgtctcaacaatattttttgtttgtttttaatttttcattaccgttgtcattatcttagcttaggctctcttctttcatgaattaagcttttccttattatgcgtgaagttattaattgaacaaacacttattattcacctactaggtactaggtattagtaggtgggaataacagcaataatcaagataaaaccttatgttgggtacaatcttcttactcaagtcactgaaaagcctttaaataggtcctttatgtattttctctctctactccaaaacattaaaaacataattgcaaaactagttttatgtaatgcttcattatggcctgagatatcctaatagtgtggccatagtcttctttctagggttacttcatattattttcttaattttcccacattttagataaatgcatgtgttaggtatacgttaccatgattcctggcctttcgtatagcttcagtggttatgttattcttgttgtatgggaatgctttcctctccatctcatatgttaaaattcatccatcttttttttttttccaaaaaagtgaatatttatttatttattttaaatttaatttaattttaagttctgggatacatgtgcaggacgtgcagttttgttatataggtaaatctgtgccgcggtggtttgctgcccctatcaacccatcagctaggtattaatcgtccatcttttaaagctcactttaacttccacttttccatgaagcttttcctgatcttcctcctccttccatcctggaaaatccttgcagtttgttctgcagcatcacacctagtgtctagccatccctactttgtccctacactttttgaattgcttaccaacaacttagagagggagctagagattgttgctggccattgctccttgttttttctcttatttcaggtacttttttgtattttgtcgattcttcccggacgctgccagttttttgcccatctctgttctatttttactgcaactccacaccagttctggttctttggttttcctacttgttctcttagcatttgataattgattctccacaatagattttgaaataacttcttggatttttttctaaattaggtattacagggtaaggtcttgcttttgctccatattccagaatccaatcttgcctggggccaaacccatgccaggctttccctcttttttctcccaaggggatggggtggtcagtcaattatctttatagatatttttttcattaaaattaaaaaattcttaattgtggcaaaagacccataacataaaatttaccatcttaaccatatagttcaatagtgttaagtatattcacattgttgtacaaccaatctgcagaacttttttcatcttgagatctttctttacatttttaagcagtcatttatttacttgttttctcttgtatatcggaccaaaattttcttgaggacaaggctgtgttactgacttgtgtatcttttagtcaaactacctggtataatcaattaataattgtttcatgaatttgaattgaccctggcttccctgatgttctaatctaatgtgcactccacaggaaccctattctgtcaacagacctggattctgatatcaatgaaatagtgcacatcttgaaaacatttccactaatgtaaacaagaaagatgaaagtcaacagagtaagaagttggcacaaggagttgattccgtctgctttggaggttttgctttttggcttaactgttacatggtgctattgtttttgttctgggaggtgggacagtgctgctttatttattttaagaaggcagcaagccaggaacacataattgaaaggaaatttctgtactggcgtattattttttcaactaagatggcaataaataacttgcaacttccttttgtttgaagtggttgatatgaactagagtttaatcttatacactcataaaattgcacatggcaaatactttcacaattgctatttaaaaataggcctatatacttacacactactaataatgtgtccctttacatcatagccttacagcattaggggaaagtcattatctcccctcctcctatatctccaaatgttctctgagggcttacgtctcttatagtcacctcttgttctgacttctggattctcaaagttattttcctcacctgcattttgcttcttttggctgttctctctcctccactagcatgtaccccaaagcatcaatttttctttggtttctcaaaatatcacttaaggcagttgtctgtatgagatatttaacagagaaaaagctatcacaaaggtttactttatatcataatgctacagaaaaatttaaattggacttaggcacaagttcttaaactttcttagccactgtaaatattttatagactgacttctctcttcaatttctagggtctcctgccatatcactgatttctttccattcccttattgctaatctttggcgcctaatctcctgctaggtggttctggaaatatcacaacccttccaaacttaatatttctctagtctctatctatcatgacctggggctatgattccatagtcataatggcatttttttcactaaaaagataattatctcaaaatgagtcaaagacttaaatgtaagatctgaaactatgaagctatgagaagaaaacataagggaaatgctttaggatgttggtctgggcaaagattttatcaataagaccttaaaaaaacaagtagtaaaagcaaaaacagacaaattggagggttatatcaagtgaaaaagtttctgtacagcaaaggaaacaatcaacacagtgaagagacaatctacagaataggagaaaatgtttgcaacctatacatccgataaggggtcaatatccaaaatatacaaggagctgaaacaactcaatagcaaaaaaagccaataacccaaaagacctaaatagacatttctgaaaagaagatgtacagatggccaacagatggaagaaaaatgctaatatctctaatcatcagggaaatgcaaatcaaaaccatgataacatattacctcactcctgttagaatgactgttgtcaaaaagacaaaaggcaacaaggtttggtaactatgtgaagaaatgggaacccttaacacactgttggcaggaatttaaattagtgcagccattatagaaaacagtagggaggtgtcctaaaatattaaaactggaactatcatatgatccagcaatctcactactggatatttatccaaaggaaaggaaattagtatgttgaaaatatatctgcactcccatgtttattgcagtgctattcacaatagacaagatatggaatcaacctaagtgtccatcaacagatgaattgataaagaaaatgtggtatatgtatacatgagggactattattcaaccataaaaaagaaagaaatcctgtcatttgtggcaacatgaatgagcttggaggatatatgttaagtggaataagccaagcacagaacgacacacaccacaagatctcactcatatatggtagctaaaaaagttgatctcatagaattagagagtagaatagtggttatcagagcttgggatgggtaggggagtggaggatagggagacattggttaacaagtacagaattatggttaattaggaagaataagttcaagtgttctatagcacagtatgaagactatagttaacaacaatttattgtgtatttcaaaacagttagaagagagaattttgaatgttccaaatataaagaaatgataaatgagatgatggatatcacaattaccctgatatgatcattacacattgtatatacttgtatcaaaatatcagatgtatctcataaatatatacaattattatgtgtcaatcaattttttttaaaaagccacaataaagaaaatactttaccccaaagataattatctccttaagagaaaatttgttttaataaaaacttttattttagggccaggtatggtggcacatgcttataatcccaggactttgggaggccaaggcggtgggatggcttgagctgaggagttcgagaccagcctgggcaagttggcgaaaccctgtctctacaaaagaaaaccaaaaacaatagccaggtgtggttgcacgtgcctgtagtccctgccagttgggaggctgaggttggaggatggcttgagcttgggaggttgaggctgtagtgatcaaaccactgcattccagccttggccacagagtaagaccctctctcagaaaacaaaaacaaaaacaaaaaacacttttactttagaattgttttagatctaaagaaaaattacaaagattacaagaaagttcatgtgtactgtacactcagttttccctattattaacaatcttatatcctttctatcacattcctgacaaatagtaacatctgcttaaatacttccagtgactggcaacccagtatgtcttaatgagccccattgccagataactctagagcagtgtgacttgagatgtagtcctaggaccagcagcagcatccatacaacctgggagctgcttagaaatgaagagtctcagatctcattccagacctgaattagaatctacattcaacaggatctccaggtgattcatgtgcacatccaaatttgaaaagtattgctctagtgttcatatacatatatatatatatacacacacacacatatatgtatttttcccaaaagatggcaaccaaggtcttgcaatcacattgccccattcattaatttatctgtgtattcacaaaacatttcttaagagcatattatgtgatttaatttgaattttttttagaaaaaattatccctaccctaaaaattttcacattccagtcctgtcatgcaaaaggtagttgaatgaacagggtaatttttattcagaaaagagaggactaagtttgaagagctgaccctgaaagaaaagcaaattcagaaaaattcaggaaaagcttattctttataatatccattctttggtctcaactgggtttcttttaactttgtgtgcatctagtctgtttcttattccacatgacagctgttcagataatcgaaggcagaatccaagtttttacttggctggactcttcctagattgttcaaggctagacacccttcctgtcttgagctgtccaatagtaactttgtcctgcaggattgcttttacatgaatgtcagggtctgcaactgaaagattgatgaaagggaaggcaggctacctcatccctttgccctaatcgtaggtggaatgggaatgagagagaaagaacattatgagtgggttgtttatacactcaagcctcaggacatataaacaggatgaaaccacttatctcacccttactgactgttttctacagattgtggcattttcctgtatttgctcttctctcaggcacagctcttcaaacttagtcttctcttttctgaacaaaaattaccctgttcattcaactgccttttgcatggcaggactggaatgtgaaatttttgagagtagggataaggtcttatttaaaaaaaattcaagttaaatcagtgcttagcaatcatatgttcttaagaaatgttttgtgaatacacagatgaataaatgaatggggcaatgtgattgcaagaccttgcttgacatcttttgaaaacatcttagtgcgttactgtcccctgtccctgataaaatgtggcatcatgaattgagcagaatactccatatggtgtatgaatattgtaggatagtggtataattaatttccctaatttagaatttactttttgatgagttcagcctaataaagatgaaagagaatatgacccccatcattatggcggtctgtgtttagaaggccaaaatagacccctacaacgttgacttagcttatcagtaaggtagaatttgctttaaatggcaattttgagatttttcttgaggagctgaaaggctttacaagattaggaaggtcccccactggctaaataactgctgagggctttcccccttttctttccatcattctttgcttccttctttctctaactgcattgcaagccacttccctcacctgaaattactttttttttctgtaaatactattacaaaaaaaactgtaaaagagagtggtaaatgcagagtagatggataaacataatgacccaagaatgacgatggcgaaatatgacattttctggtgttgggtataataatgggtagagacggaggaatggaaaaaatagactagctcttttgccatggcaacaataagtgcatttattatataaacagaagaaggaaaggcatttatttggtccttgttccttttccctcctaattctcagtttctcctgttttttgtttagtttagattctcaaaagctggaagccagttaccttgcaaagacattgatcatttctttaaatacccaggtatatgcttgactccataatattttactgtttaaaaataaataaatgaatgttttctttaaaagctgattgaagaatagctcaagtcctcttttatcaaacatagaagaatgctctctttaaaagtttgcatctttatcttgagtcaataaccttacaagcaggaatcaaggcacagttttctttccaattgagtatcattagaacattgtctggttcattcatgtatgtctcaagggtaaatggccatcagcgagtctctgacagagaaatactaagtgatcctagtctaaaaggaaagccaatgtgcacttgagtagcagcattcactttacagagagttcaaagggcactttactatgtctaaatgccctttatgttctctggtgccagcaggaaaaggaaagctattaaatgcttataagagtgagacactgtattttaggacataggaaagatggggggaaatagatggcaaactaattgtaagtcaagaatatagcgagtttcccaaagagaattcctgcattttcaaaatattcttcttttttaagggtgtgtggggtgggtggcgtaaaatggaaaaatatgtaaagcctcatttaatatgttttctgaataatccaaaattttcaacatgagctgtaggttgggttgggttggggcaaatcgatgaggcaggagcctaaaattataccaaatttctggatataaatatcagccccaccattattagatatgtgaattccgggaagatacttaatgtctttgagtcccagccttcacgagtatacaattaggaggataaattccaccacggagaaatgttgtcaggtttagtgtagtaacatatataatgcagtcagtagggggcctggcatgtgttagggcttcaaaaataagaaccacatttccattcccactgtcccttaggatcaaatctgcagacatcttctttaggcatttaatacctcccagtattccttgtctacagctcatcgatgtttgtttaccccaagtatttgtataaaattttacacacaaccttcctaacttacatttaagactgtgccatttctgattttctagaaaagagttcagattccttatcacagcatttaaggacatccatgttctgaccctgacctagttgggctgtgtccccctccaactctcatgttaaattgtaatccccacatgtcaggggagggagcttgtgggaagtgattgggtcatggggttggatttcctgcatgctgctctcataatagtgaatgagttctcatgagatctgatggcttaaaaatatggcacttcctccattgctctccctttcctggtgccatgtaagatgcgccttgcttccccttcaccttctgccatgattgtaagtttcctgaggcctcctcagccatgtggaactgtgagtccattacacctcttttctttataaataacccagtctcaggtagttatttataacagtgtgaaaacagactaatacagacccccccaacaaataacatctcctttataaagaccctatgttatattggccagttcctcaatatgttctgaaatatttttcctccataatttcattcacttttcccctgactataatacagttgacccttaaacaacatgagtttgaacagtgcagtttcacttatacacagattttcctctgcatctgtcaccctgagagggtaagattaagcctaccttttcctcttccccctcagcctactcaacatgaagacagtgaggataagacctttatgatgatccatttccacttaatgaatagtaaatatattttgtctaacttacgattttctgaataacattttcttttctctagtttaacttactgtaagaatatagtatataatacatgtagcatacaaaatatgtgttaattgacaacattatttgtaaggcttttggttaacagtgggtaattagtaattaagtgcttggggagtcaaaagttatatgcaagtttctactgcacgaggtgttggcacccttaacccccacgttgttcaactataccttccatttctgcactttgaaaggttattctttaaattccagcatcaatgtcatgccctctatgaagtcttcctgaatactttggacagaagtgatttctgttcttctggaattgcctagtaattcctcataatattaataataaagttctatacattcgtataatgctcaaatcagtggacacttcctgatttagatatgatttaacctgcatagagtagttgacaatacaagtgactttccatccattttcctcctctgacttctgaaacattctggttttcttactacctatatggcttctctttctcagtcttctcagtgaatttattcatttcctaggactgcctttaaaacatactacaaactgggtggcttaaaacaacatgaatttattatctcagaattctggaggctagaagttcaaaatcaaggtgttgggagggccatactccctctgaagcctttaggggagaatatcccttgcctcttttagcttttggtagcctcaggcattccttgttctgtggcagcataactctaatctctgcctccattttcatgtggctgtcttccctctgtcactggtgtccttaaaagaagagaaacagacacaaggaggaaaaccttgtgtctgtttctcttcttataaggacactggtcatattggattaggtctcatcctaatcaacaatgacctctcatcctaatttgattacatctgcatagagcctattttcaaataaggtcacattcacaggtactaggggttaggacttgaacacatcttttggggggatacaattcaacccaaaacagtagcgttcccatttcttgcctctcccttaaatattaggtttcttcagagtgatttcttaggctcccttctctcagcaattatttaaataatgaggaaaactaaaatttggcagtgtcaaatatgtgaatcataaaacaggtgtaacacaagggtccaaggaggatattcgagatacagtgttctgatgcgtcctccttgaatgtgactatattcccttagcttttcctttagaaccacacttgaggtggtggagcctttaaaaatatttaacaaatgttacttttgaagaagagagtaagagtatttaataaggtaacattggcaatgtgaaagttatatgagatacataatcagtggtcctcatctttgtctccttcttaaagaaaacaagaggaaatgattgaccactggaagggtaatttttgtgggctgaattgtacattccccaaatttctatgttgaaaccccaacgcccagtacatcagaaggtaactgtatttggaggtagggccttgaaagagacaattaaattgaaatgaggctattaaggtgaaccctaatgtaatatgtcttatgaagtcatcataagacagggaaatttggacataccaagagactccaggtatgtgtgcacccagaggaaagaccatttgagaaaatgaccatctgtaaaccaaggagagaggttttaggagaaaccaagcctgctggcaccttgatcttggactttcagcccagaactgtaaaaaaacacatttctgatgtttaagccacccagactggcattttttttttatggcagcttagcaaacgaatacagcaatttttagttactgatttagtgactagtgtggtccagatgctattctgggtgctgacgatatagcttccctgtggagctgatgttctagcggatggagaaagggaataacaataaataagtaaaatatatgtcagatcagactaagtgctacagagaaaagaagtcagagaaatcatcatatagaaagttgcaattttatagttatgaagccttcattgtgaggctgaaattttaacaaatatctgaataagatgaggaagaggcagaggatcccaggtttaggaagtagcaagttcaaagaccctgatttgggattgtgtctgacatgttcaagagacaacatcaagaagccagtggggctgaaatgtatagagcctggggggagagtaacatgtcagagagaatgggggtgggggagctatggagctactggggactaacttgtagagaaaaccagtccccagaatgaagttaatacaaaaagaagggtgagcaggcaaaatgggggagggtatggatgagggagggagagagaaagagagagaaagagacagagagacaaagagaaagatgccagtctgaaaaggctacacactgtatgatttcattatttataggacattctggaaaggcaaaactatggaggcaacaaataaatcagacattactggggtttggggagagaggaaggttgaacaggtgaagcacaaaggatactctttgtaagtgatgaaaccattctgcatgataccataatggtgggtactcaacgccatgcatttatcaaaacccatagaactttacagtacagagtgaaacttaatgtatgaaaattgtaaaaaaaattatttctgaggtcagagggtcacagggtggaatatagaacatgactaaacaattaacaatgctacaaacatatgataaaacctcactgaagggactggcagaaaaagttgctagcctgaataactttagaaatgagcagagattgtaagactaaagggaaaaataattgtatgtaagcacggtaatctagttgataaagtctcccatgggggaacaggttaacaattctgaaaccatcatacatctaatctggaactgaagaattaagtaaatggaatgtggatagcaggaagcacgagccaggtttctcactgttgaagtgggagcttacaggaaagcatggggagaaggcaagaatgattcatatggttatggattagagttagagacatcagtatgaactcatgcttacattattataggtacagacgtttacatatagaaatatttatagatacgtatatatactgaagttagctacacacacacacacacacacacacacacacacacacattttgctctgtcagctgaagaggtcaagatacaaggatacacctaacaagtcagatctttgtttctaatactatttgttccaataaaaggaaccagggatccttagagagacggctgattctcaggaagcatacaatataagtctggagcatgttgtagtttcttaaaagaaagaagtacttaatacccacaatgatggagcacatcaaagggagactagagccaatgtaagcagttcctaatggcctacgctgggacgatttgagcaataagataaataaggtagcaatggattatgattcaggtatatatacaataaatattcctgtctacactgacataaataaacagtcgagtaagtaaacaaatagggaacaagatacatctcctgtgcaggagaatttcaaatagtttgtgaagctcttccatcctcaaggaggtagaacataactcctactctgtaagcatggatcgtgcatagtgatttccttccaaagagtaccatatggaaagcttagaaaagagtaactttaaagggtgaaacctgataaacactacctcagccaggtgatcaaggtcaatattaaagtggtaggtcatgttgatagtatgtactcttgtatgatgcaatggaaatgacacttaacttctgtggtcttcctctgcatgtaacaaacatcacactgcaatcctgagaaaagcattaagcaaatcacaattgaggggcattgtacaaaatatcagtacttcttaaaactgtcaaggccatcaaaaacaagaaaagtctgagaagttgtcatagccaagagcagtctacggtggcatgcgactgcaagtaatgcagcaccctggttgggatactggaacagaaaaatagtgtgaggttaataactactaaaatatgaataaagtatggacattaattaaaaattatgtaccaatattggttcattggttatgaccaatgcacctcacttatataggatagaaataataggggagattgggtgtgaagtatatgggaattctactatctttatcacttttctgagcatctaaatcttttaaaataaataaaaagtttattttaaaaaatctcattccaagttttaccccattccaattaaatcagaatttctagggtgtgagaagggatcagtattttttaaacatctcaagtgctgtcaacgtgcagcactggaaacctctgtagtagaagtccctgagctgtggtagctgttatattttggtactccttaattcatacaaaatgtcctgagctaaatgaaaatgttgtgtgttgcctccattttgtacctatgtgaagtcaaaattttaattatgagtatgataaaaataaagtactggaacatgttgcccatttgagcaccacttgatgttacactattggatattgagctcctaactgacaaatgtatcaagcatataattacaagcaatattacatcttaaaatgtctcgtaattttcctccaattgaaatgaaaaaaagaaaaaaggatatgacatgcatactctttcctctgtctgatccctatgctgtctgatcccacattaatatgctttggtggattccaccacgattccatttttctgccgttttttgaccttgtttgtactccaggaggctgactctatggactgcaatcctcaggcctccttgctctctgatttccagttaggtttaggcaagatggaggagacaggtatcatcgttttaacccaagtctttcccttcttcatcatggttctggcagtggctgcgtttgttgcaactccagctcccaccccctctggctcacacttggctctggaaacacagttgccttttctcaccccttcaaactaagagggagtaatggtttcctgctgttgctagtctctaggtaactcaccatcccttttttttttttttaactttactaatatctctgtaaattgtctctttactgaaatattttaactttttgagggtgtcatctgtttcctgataggctttctgactgatgcaattagtctatcattgtcaattctctggaaatgatgactctttctcccccacctctttttaagccaagataacgtcttgcctacttttctggccttaaaaatgttctttgttttgtgaaacaatgttgataatagcgaacattattttccctaaggccttatttggcaaaagtaagagctggcaaacatgctggttccccacatatttttgaaatttcattttcaaaactggagtctgggaaccattgacctaagtgagaattcaactttgaaacattaaggggattcagctatcattcactttaccacaagaatcttacaaatctgatgaaagttgccaatggctgtcacagtagacactcaagttaccgggattcagttgtttgcataacatattgtcccactcctggtaaagagggaagtagtatctgggaaaagtaggaggatcgataaaaattgaagtggttatttttgtatccactgacacagaaggagattttacagcacactatgttttgagtctcaaaaacacacgtattgcatttcactggagatctgatgggggaagggatggagaagaggaaaagagtgcatctgaaagttttagcaagaagttgcaaggactcttcaattaagtatggatgcagtgtgacagtgacttagaacttccatgttcacagatccagcgctgttaactttatactagtctaagtcttttttcttataaataattacaaaagctcattaagcaatacagactgggaactttttttttcctccaaattctagtttatttttaattgacaaatagtaattttataaatttatgggggtacaatatgatattctgatacatgtatactctgtgggatgatcaaatcaggctaattagcattatcagtcatttcaaatatttatcatttctttgtggtgagaacacttaaaatcctctcttagagattttgaaatatgcaatacattattattgcagtcagtatgctgtccaatagaacaccagaacttattcctaactgaaacttcgtatcagctgaacaatatctctcctttccctgtccacactctcacccactgccagcctttggttaccacctttttactctctgtttctatgagtttgactttttaagattccacataaaagtggggtatttgtctagccacgcctggcttatttcattttttttgagaccaagtcttgctctatcgcccaggctggagtgcagtggcgcaatcttggctcactgcaacctctgcctcctgggttcaaacgatcctcctgcttcagcctcccaagtagctgggattacaggcacccgccaccacgcctggttaatttttgtacttttagtagagacgggatttcaccatcttggccagggtagtctcgaactgctgaagtcaagtgatctgtctgcctcagcctcccaaagtgctgggatgataggtgtgagccaccatgcccaactgcttatttcacttaacataatgccctctaggttcattcatattgtcccaaatgacagagttttttaaaatgctgaatagtattccattgtgtgtgtgtgtgtgtgtgtgtatatatatatatacacatatatatgtatatatgtgtgtgtatatatatatacatatatatgtgtatatatatgtgtgtatatatatatatacacacacacacaacattaaaaaaaatccattcatttgttgatgaacacttaggttgtttccatatcttggctactgtgaataatgctgcaatgagcataggagtgcagacatctctttgacatatgatttcaattcttttgcatatacccagaggtagaatttctagatcataaggtaaatctatttttagttttcatatttttaaaacttcatactgtttttcaaaattgttttcaaaattgctgcacttaattgtaataccaccaacagtgtacaagggttccttctccacatacttgctaatacttatctttcgaaatagctgatctaacaggcatgaggtgatatcccattgtagttttaatatgcatttctctgataattagaaatgttgagcattttggtaaatgtatgtcttggccatttgtatgtcttctcctgagaaatgtctatggaaattctttgccagttttttcattgggttatttgttttcttgttattgagtagtttgagtttcttgtgtattttagatattagcctcttatccaatgtataacttaaaatactttttcccagtttatgggttgtttctttactcttttgagattttcctttattgtgcagagtttttagtttgacgcaatcccatctgtctatttttgcttttattgcctgtggttttggcattatagccaagaaatcattccccagaccaatgtcgtgaaacttttccctaggttttcttctagtagttttatagtttcaggtcctatgtttaagtctttaatccattttgagttgaatcttctataagggataaggtaatggtacattttgattattcttcatgtggatatccagttttcacaatatgatttattgaagagatgtcctttccccattgtgtgtgcttggtatctttgtcaaaaatcaattgactgtagatgtataggtttattcctgagctctctgtgctattctgttggtctatgtgtctgtttttatgccagtaccatgttgttttgattactataatttagtaatatattttgacatctgatagtgtgatgaccctggctttgacttttctttctggtcaagattgctttggctatttggggtcttttggacttcatacaaattttagaattttaaaaaatttctgtgaagaatgacattagcattttggtagggattgcaatgactctgtagattgctttgagtaatatggatgtttaaaaaatataaattcttccactccatgagcgcacaatatctttccatttatttgtataattttcaatttatttcatcaatgttttatagtttttggtatacagatcttccacttcctcggttaaattactcctaagtattttattttttttgatactaatgtaaatgggattgttttcctcgtttctttttcagttagtttatggtttgtctataggaatgctactgatttttgtaggttaattttgtatcctgcaactttactgagttagtttatgagttttattaatttttttggttaggtcttcaggattttccatctataagagcatgtcatcagcaaaaagagataattttacttctttctttccaatttggatgccttttacttcttttctcttgcctaattgctctggctaggacttcccgtactatgttgcataggagcggtgagagtggatatccttgccctgtttctgatcttagagaaaaatcttcagcgttcacaattgattgtgacattagctatgggtttggtgtgtatggcctttattgtgttgaggaacattctttctactctgaatttgttgagcgtttttatcatgaaaggatgtttaattctgtcaaacccttttctgcatctattatgatgatcatatgttttttgtccttcattctgtgggcatttttgtttattgatgttttcaattgaatgtgttttataatgtcaagtacatcaaatttagaacagaaagaaaaattttacagtatcttatgcttggatagggtacaagaaacagggcgtatgtttatcacagtttagtctccttgactttaaaattcttctgtgttgggaatatgaggtccttctttgttatgttatgttatatttaatattgagtgaaaaggaattaacacacaattgttttttaaatttttatctgtttaaaaacttcctttgtttttattctcattactttctgttttctgactttaccttaagaaaaacacagagcaatcttttccaattcatttttttcctttgtatacatttaaaagggagttttaaaagggctggatagcttggtcataaagaggagtttttctttaccattacaatccaaacacaagctgtcgtccacatggcatggaataattagagaactcaagaattttctttctcttgacatttctactacttaaacaaaataatggaaactgatttatttcttcctttatctggtgatggaaaccaccctatggaaaacctgggaatggtcagcactatgttttccactatgtggagagagttggtcagtaacaggaaatgaaactgactcatatggagaagcagagacaagagataggattactggtgattttagggttcccgaagaccatctacatatctcccattcctgttgcctgactgttgaaatttttctgattccatgaaataaaaattctcctttttggctaagctattattttgggtgggattctatagggtgcaagtggcaaaaatgtagctacaattagcttaagtaaaaagagggaattgaggagagatccttaggtaactcacagaattaaaggaagactggatcaattgagctttagcaaggcagaagcaagcactttagaagggactcagaacctagggccaagacttaggtaatgcagcagcacacttccctcacgtggcctttgctccttctttctggacactgtgctctctgtggaggaatactttgattaccttatgtgtttccaccagtactttatttaccccataaccctcatctattcattggcatttttatgtgcattgccacagaaggagacgttacagcacactgtgtttttgaatctcaaaagcgcagactaggattgaattcaggctctgaagattaagagagctatcccacgttagcgggaaaaggaaagccaaaagggaaagaaagacagctgagttggtaccactgggaaaggggccctgcacctagtagatgatactgtcactaggcaacacacagggggcatttgtgtttattgttttaaattgaatatgttttataatgtcaagtacagccaatctgtaattgaaacaaaaactttgaagtactctgtgaaattcatctctgaggactgaaccctctgggggaggagcaatagacactcccactgcaccccaccctgggtgacagagtgagaccctgtctcacaaaaaaaacaaaacaaaacacttattttagaattgttttagagctaaagaaaaattgcaaagatagtacagaaagttctcgtgtactgtacacccagtttcccctattattaacaatcttacattctttctgtcacatttctgacaaacagtaacatctgcttaaatacttccagtgactggcaacccagtgtgtcctaaagagccccattgtcagatgattctagagcagtgtgactagagatgtggttctaggaccaccaacatccacacaacctggaatctggttagaaatgaagagtctcagaccccaatccagacctgaatcagaatctacattcaataggatctccaggtaattcatgtggacatccaaatttgaaaagtattgctctagtgttcatatatatatgtatacacacacacacacacacacacacacacacacacacacacacgtgtatttttcccaaaagatggcaaccaaggtcttgcaatcacattgccccattcattaattcatctgtgtattcacaaaacattttttaagagcatatgtgctaagaactgatttaacttgaaactttttttagaagtaagatcttattcctacactaaaaaatttcacattccaattctgccatgcaagaggtagttgaatgaacagggtaatttttgttcagaaaagagaggactaagtttgaagagttgtccctgagagactagcaaatgcaggaaaatgccacaatctgtagaaaactatcacaacagctgagagaataacagagtagaaagagctactcccctttattccagatagagctaggggtggagagaaaacccctctgcaactcgggttagtgtattagtctgctctctaattgctgtaaagaaatacctgagactgggtaatttatagagaaaagaggttaaattgactcatggttctgcagactgtacaggaagcgtagtgacttctgcttctggggacgcctcaggaagcttccaatcatggcagaaggcaaacggggagcaagctgtttcacatggtgggagcaggaacaagagggtgaagggggagatgctacacacttttaaaccagcagatgttgtgagaactcactcattacagcgaggacagcaaagacccatgagagatttgcccccatgacccagacacctcccactcactaccacaagaacagcaccaaggggatggtgctaaactattcaatagaaactgcccccatgatccaatcacctccctccaggccccacctccaacactggggattacaactggacatgagatttgggcggggacacaaatctaaaccctatcaggtagcatggggcagtatgtaggaatagctgcgtgatgaaggtcctcagatctgaagcagcctcatggagttccaacttgcctcagcaaggtgtaggagcagtagactaattcctgagcctagcatagtcatgttgctgcgccttcacccaggtgcccagatcccagaatggtgctggagaacacttttcaatgcacttcagcagggcatcaggggccaggaaggagagtcattgatcctgaagtgacctttggcatggatccatgtagatcaacacttgaaaaacagacaggatgaggagggagatgccaaattcaacaaatgaccaaatatcagaacgtttgcttattctggccctgccttccttctgtcccgtgtcccttgcttaaaattagatgtgaactgaaggaaaagaaatgggagcctgaattcattgaggctgagtttctatcatctagtaaaacaggatctcattgaagaaattaagttcagttgcatgaaaaaattaagccacgctttctgatcatctgcttatgtgacctgaaatttaaattttgtcttctacttcagactgtgttcttatatgcggcagagaacctggctactagcagctgcagcttgcaactgcatatattcaccatctggaaggaaaaagctcttcacctccttgactcttacagcatggtgccctcatccaagctcctgtttgaaaagcttcagagaacaatcttgactggcctttttctagtcatgttctcatcctatttaccaattacagagttaggaatgtgagatactatgatggttccagcttggagctcttgctatgtggcctctgaagccagcatgctgtaactggtagctctgcctagatccatgtgcttggtgttagggaaggaacagtttctctgccaaaagggaataaatactttgatcagaggtagaggaggaggggaacaggctgataaaaacactgaactgcattatctaccttgtgtgcctatactaataaaggtttccttaatgtcacattgatatgatcaaagcaagaaactaaaattatgaacaagatactgactatgtcttttatgactcattagttcagaattagaacctgggctctggaaaaaaaataacacagccatttcattgtaaatttgtaaactttgcagcagtttaaccatgagagttggcatataggtcagggaataggcctggtgggttttgctgtcaaatcccattatactcctgcagagaataaagtgctttgtgcttcgtgaaaattggtttgtagtatgtgtgtaccaattatcaggattgtcagaaatgttggccaatttcctttcaggttcatagggacttaaatctgaaatacttctctacaaaaactttacttagctgcataattctgaaatagctttattctggccaactgcttatttataacagccttttcaggtaatattctaggagttatttctcaagatttattccctttatttttcttgatattctttcaggtgcaaggaaataaaaaataatttggcttatgtatacaatttggataattttgtagtttttcttacactgtgttgctcatttatgagaaataggcaaatagataaagaaaattcggttactgcatgaagtactgaaaaaatgtaaaaaaaattccttggggaagtcatattttagtccacgttctgttgttaattttaatcttggggttaagtaatttttgctcttggtatgagattataaacaaacaatccaattgacttgcctttcaactctgaacagtttcttgatcacagtgtaaatagctgcttgaatttcactgctgttacatagcttttcagatagtcaaggaaatatgattctgccatattcatgccagcagattccaaagggcaaggaaagatgtttcaacagatcaggagtctaaatgagttacacgttgagcaattggccagtgaagagccaccaacagtaactgggcagccccaggcctgtaggagcatctgaatggttctagttcccaggaagagcttccaaagaacacatggtcttacatagatattttcaaatagctgttttcctcccaattattttagtaaacctatgattgttgtagataaattagaaaagtaaatataaacaggaaaataaacttatgcattattccataatctgaagatgcctttgataacattttggtgtatagctcatcattttttcttatgcatatatattttaaaatccatttagattatgctgaatatataattcctataatatatgttctgtggtaatttagaataaaaatcccttcggtatgtgaatttaaaacaaattataggcatataatcattgtgaagtatctattcttcaaatcacttttttgttctttttagttatacaaatgggaaacagtaaaatttgccttttatacttgagtccaatatatattatttgagcaatttctaaatctaagatactgtcataaatactttaggaaatagcgaaacaacattaataagacataacatttgccctcagggcatttatatagggatacgcataagcaatcattagatgaatcagataatgtttcatgataaaatggaaaccaaataaatttataaacgatcatagaccttagatagcatggtcccaatctgggagattacaaggaatattttgttggatcttgacgtattggccaggatctcagccagcagatgatggtggtgggtgatggttgagggagggatgctgtggaatgaaggaataacattcaggatggcatagcatgaacaaaaccaggaagtgaaaataaatgcaaagatgctcttaagtcactgtgagttctctgctgaagcggaagaaaacactggtaaattaagttgacaatactctgagaacgaatttcagttccagacttagtttaaactttatcctgtaggcagtgcagagacacagatgcttttgagcaagtccgtaaaatggtcaaggctgtaccttaagaatatctcatggaaacttaaattcctagaaggaatgacaaaaccattttttgtgtaggtaagtgttcatataactgttctctaaacatctcatatttattttttaatataagttatagatacagttttatttttacttttgtaccccaagaataccttcttagaacttcttagaaaagcataaggatatcctgaagtattttaatgtctaaactttcttgttattagtatttgtttttctcaatttatggcttgacaatagagtgttcgtttgttctgtatgtatttgttcctcttgtctttctttcatagaatgcccctttcattcaaaaagcattaatggagcaactatatgagtagactatcgtattgtataatgagcactataaaaactgtgtgtcctggagaatttgggttaaattatctggctgggcctggagatagcactttagtaagatacattttgaatatcatgaaatttaaagaaaaaattgctagcacttaagatagtcaacttggttagttgatatcaattatcctgttaattaaggattttgaaactcagattctcctgatttgttgttcaatttcctttctaaaattttaaagtacttttcttttattgcttattagctatttggtttaactttaaattgctaaaactttttgaagaatgaaatgtattttacagttaccatttgcatttaatgtgtaaaattgattttaggctttcattaagtcaacttttatactcaaggtttagaattttccttgattacaggtggctcacacctgtaatctcagcactttgggaggctgaggcaggcggatcacaaggtcaggagattgagaccatcctggctaacatggtgaaaccctgtctctactaaaaatacaaaaaaattagccggattagcccggcgtggtggcacacacctgtaatcccagctacttgggaggctgaggcaggagaatcacttgaacccaggaggtggaggttgcagtgagccgagatcactccactgcactccagcctgggcgaaagagcgagactccgtctcaaaaaaaaacaaaccaaaccaaaccaaaccaaaaaaaactactttccattgctaaatgtgtttccggctcaagcagagatactggttgccatttactcaaataagcaagcctactaattatctgcaaatggcatgtcaagtgacccccaaaattaaacatctttatgtaaaaggttttctcttctaatgtttactttggtctcagaatccattatttaattaaacagttatattgtttatccagctaatgcaactcagtgcgtaagaaggcatttacttaaatctaagaatatacttgaatttttattgctattaattgtattggtgaattcttttgtaccatagcacctttcaagtttgaaaatgcagctcttttgctgttagatgtaagtgcctctgtacccatttcataaagactcatcacctattctgagaccttgattttgccaccccatcacccttttcccttccaaaggcaaggacaaaccagagcaattgtagcaacacgaaatcgcaaaagaaagacaaagcttcatggttctctttacaccataataaccgagcagtctcaaatctctcattaaattttagtgtttcgagtaatctcccatggtttttagatggtaatagtaatgtccttttacctctaccagtttgttccagacttctttgatattacaaatgggatacggtgtataaagctggtcaaagtcaagaaaactttggtaaatactcctgtaactatagatactggtggttcctgcagggtattggtattccagacctgaaagattcatacacaatcaatctgaaagtcagagcagagcaaatgcaccataagctgtgaagttacttagtggttctttgactgcttaactgagctggtgaaagtcagggcctgtgtatatatgtttaagtgataatctgcatcagttaattttcctgtttcagatttgccagttcaccctgaccatcttgaaaataagttatctctgatctctgtctgtatgttacttctctcccctcaccaacggagaacaaatgtgggcaaagtaagtaaagcaatcaccacctttggagggaagaattggtcatgttctatggatggtggatcaactctattgcggatactcagtaacatttttactctctaactcatcatttacacctcaaatcttttttatttaaatgctctgaagttgtagctttgaataatagtcttcgatgtggtaggggccttaatcaccatcattctagtctaactcgtctcccatcaaatcccatcctatgacattcctgatgaacataatttagcctctatttaaaaatatctatgatgaagagtgcattgtcttaccagaaagcccattccacttccaattgttgtgagagttagaaagttattcctcagttttggtttaaacctggctccctcttcattccacacattgacattagttcagtttacaggagctacatagaatagtctaccatattttcctcatgactgtctttccaatatgtgaagtgaactataattcttgccttcctcctaaatgtagttttctccaatttcatttggtatgcctattaaaatgcagagtcctgtttctccagaggtttttgttgattaggtttctggtaggcctaggatttctgtctgttttgtagtgtgatctgtgtttacatccgagtagttttatcaggctgtttcttgtctgtggaattttggaggtccaatagctttcttttgtcttgtactctatcctttaaatttcaaagtggcagtgtttccactggtttaaaattctcaagaatcttgtagttttcctgtgtatattagagaaattcactcctgaagaaaagaagcttgtttatagatttttcttagataatcttgtctctattttgggggtctgctgagaaggccgagggggtccatgagtcacctgtttaatctctttaaagagccttttgtgtgactgaatactgatttttatctttctgaggtaatagcaaaagtgttaccagccacacttctggctttttctctacaatgcacttttctggcagcgaatccttaatttttgctgataacattttaagtcatcaagtcctggccacttttggtttcaccgttctttccctaatttttatctttccttttacatcttactataagcagcgagaaaccaaaatgtgccttcaacactgcttgaaaatctcctcagctatatgcccaacttcattgtttacaaattctgctttccacataactgcaggacacaattctgccaagctttctatcactatgtaacaagtatcacccttcctccagtttccaataacacctttctcatttccacctgagtcctcactagcagccagcttttttcttttttctttttctcttttctttctttctttctttttctttctttctttctttctttctttctttctttctttctttctctctttctctgtttctttctttctctttcttctttcttctttttcttttctttttctctctctctttccttccttccttctttcttctttctttctctttctttctctttcttcttttcttttctttctttctctctctccttccttccttccttccttctctccttccttccatcctctgtgtctctctctccttccttccttccttccttccttccttccttccttccttcctttccttccttccttccttccgggtctcattttgtcacccagcctggagtgcagtggtgtgatctcagcctactgcaacctccacctcccaggctcaagaaattcccccacctcagtctcccaagtagctgggactacaggtgcacaccaccacaccctgctaatttttgtattttcagtagagactgggttttgccatgttgcccatgctggtctcaaacccctgggctcaagtgatccacctgcctgagcttcctaaaatgctgggatcacaggtgtgagccactgtgcctggtctccagcagccactttcatgtccgtatttctatcaatagcctgttaataatgatttaggtattctctagggtaatatatatttttctctaccttgcttctcacttccttctgaagaagcagagttgttaacatccatatttctactaaaagtctgtttaagatagccttctaactttctaacttagcagacttttagtagaaatatggattctaacaactctacttcctcagaaggaagtgagaaggtcttgatctgtcgcccaggctagaagtacagtggtgtgatcacagctcactgcagccttgacttttgagtttgagcaatcctcacacctcagcctcccaaatagctaaaattacaggtctgccccaccaagcctggctaatttacaaaaaaaaatgttttttttgttttgttttgtttttgttttttgagatggagtctcgctctgttgcccaggctggagtgagtggcatgatctcagctcactgcaacctccacctcctgggttcatgccattctcctgcctcagcctcccaagtagctgggactacaggggcctgccaccacgcccggctaattttttgtattttaagtagagacggggtttcaccgtgttagccagaatggtctcgatctcctgacctcgtgatctgccagccttggcctcccaaagtgctgagattacaggcatgagccacagcacctggccaaaaaaatgttttttaaatatagggtcttgctatgatgcccaggctggtcttgaactcctaggccttaagtgatgctcctgccttggactcccaaagtgttgggattacaggagtgagccaccatgcctggacttaaccggtttgcccagagaatacccaccagtggcgtctgtagctgtagcatttaccccaagataactttgccaagaaatatgcttttattattattttcgcatccctctggtatattgacttcagaaacaaaagacatcactctattgatcacattctgtttttagtagtgatatttccatttacaaaatatagtaattctcaatccctgaaaatgtcaaatcctagaaaatgtggcattcctatgaatgatgttaacatcattattgaagagttgtttgccaagaccagctcggctggggagaccctaacccagcggcgctagaagaattaaagacacacacacagaaatattgcatgtggagtggaaaatcaggggtctcagccttcagagctgagaacctcgaacagagatttacccacatacttattgacagcaagccagtgataagcattgtttctatagattatagattaactaaaagcatttcttatgggaaataaagggattggctgaagtaaagggatgggttgggctagttatctgcagcatgaatatgtccttaaggcacagatcgctcatgctattgcttgtggtttaagaacgcctttaagtggtttttggccctgggtgggccaggtgttccttgctctcattccggtaaacccacaaccttcagcatgggtgtcatggctatcacaaacatgtcacagtgctgcagagattttgcttatggccagttttggggccagtttatggccagatttgggggcctgttcccaacagttgttggccaaagattcatttgattaacctgatttttccgtaacagacgattccgatgattctggtgttagctctgtttagaaataactccaagaacagtttttatattttattttcacattgaaaatcagtcagatttgcttcagcctcaaagaatgtgtctaatgaaaattaaatgagcgctggcagtgagctgcacttttctttttctaaatggaaaaagggttaaggccttttgtctgatcgaaaacccttaaaacagccatctgactcaaaggcctgacagaaccaggcccaccatgattatctaggataatctcttgcatgtacagtcaactgattatggactttaatgacatctagcgactcctggattagtgtttgattatgtaattggggactgcagcctagccatactgatacatcaaaaagactgtcacggtgtcttctatcacttattccattaaccaaagctgccacctcacataacacaataatttattttcacttgaacatttaggttttaaagggacttattctcagagacatgttaggaatcaaaatagaaatagttccatatcattggctcattgaacacaatagttcttgaattagcagttacaacttacaagttgtaaattgtttttccatgaggacttaaaagtttcatgtacattaaatataaatttcttttggctggaaatggcattggtactatttaaatagtctattgctggctgggcacggtggctcacacctgtaatcccagcactttgggaggttgaggcgggcggatcaattgacgtcaggagtttgagaccagcctggtcaacattgtgaaaccccgtctctactaaaaatacaaaaattacgtgggtgtagtggtggacacctgtaatcccagctactcggaaggcttttatatgcatttttgaatgcaaatttttaagatctgtgtggtaattagacatataatcatagttataattattattttatactgaaaaactttccaaaagacatttagggtatcatggccaaagcgagtcactgttttatttaaaactacagtcagttcaaccacaagcttttctgagtgtctattgtagtggatatatgtgcttttctttgtcaacttccccatcagtaaaagcaccctaattttattttggggttccactttctccctgccctcagtaatttggttaggttaagactcaccctcctcatatcccccattttccaggtttacttggaaaatagtttccaggtttaccattttcccatttacttgggcagtcatcatattccaactctctggccacacgactggtgcggggatgggcctgtaacccatgtaagtcaatgaataagacccagcttggtagttattaagatataggttgattgcttaaaattgtaagagtggaagagtaagaaggaaagtcaaagagaaaacagttgagccggaaagaaaacggagtcattcaaatcattattcgtaaagagtttcaagaagtggcgtatcaatattctcaacttaatagttgggcaatatttatgtttttgaaactaacaactaaaatacttggataaaatatttctcctgatttaagtaactataatttcagtcatgattcattgttcccagcaggatctgtatctgtgtaagtgggcatagtattgattttttttcaaaagagaagataggtgatctcattaatttccttttcacatcaaagctttccttttagggttttttttttttccttctctcaaaaaaaatactgaatgagtcagggtgctaatctgctttgctctagtaaattctatcttctcattgtagagatgtttttcaccgtagtaataatttgcttagctgcttggtatttactcatgtattcattcacagttctttatcaggcttcaggtatgtacccaatattgtgccaggtgaaatgagattcaaaggtgtctcctagcctagaatgtaaattctataaggaccttctcactcggagcacagtattggcacattatcagaaatctatacagatgcatttaggatgcatttctgtaacaatggtcacttgtgaggtgccatgcttgaccttcaagtattgcctgaaactcaaacacaagttgagggtttgagcctttgtacttgtttcctacagggcagttattcttcaaaatgcccaggtttaatgatacttatttttattttttattatttatttacttttttgagacggagtctcactgtcaccaaggctggagtgcagtggtgtgatctcggttcaatgcaacctctgcctcctggattcaaccgattctcttgcctcaggcccccaagtagctgagattacaggtgtgcaccaccacacccagctaatttttgtatttttaatggagatggggtttcaccatgttggtcaggctggtcttgaactcctgggctcaagtagtctgcccacttcagtctcccaaagtgctgggattacaggcatgagccaccatgcccggcgatacttatttttagtagttcacaatgaaataattaattatatttagtgccaatacaatttcaaataatgatgctggaatgacacccgataccacagtaggcaatgattttgatctctattagtttactagttatagtgggttaaatagtgacttcccaccaaaaatgcccacatcctaattcctgtaacctgtgaatgtgaccttatttggaaaaagggtctttgcagatgtaactacgttaagaatctcgagatgagaccatcctgaattatctggttggtccctaaatccaaagacaaatgtcctttacaacaaaaagaagagaagagggcacagacacagaggagaaggcaagtgaagatgaaggcagagactggagttacgtggccacaagccaaagaattcctgaagccaccagaggcaaggaaggattttctcatagagccttgggagccagtacacacctgctgacaccttgattttggaattttagtctccagagcagtgagagaatacatctctgtttgagcattaagtttgtggtaatttgttacagcagacctaggaaactaatatgttagttcgtactgattatttaattaaaggctctttttgtattgttttgttttctaaatagtctgcagaaacctacctcaatttttgtctccatccaatagagacacctgtctgtctgttgagatttggtggaaatccaagggttagtgtttctgggttatttttcgcctaccacagatagtgctgaaagcccatttagtacacaaatatgacacttctgaataaagtggcttcaacaactggtctggagatccaagtgctattcaaaaaagtgacactcgttctgagaggcgattcctatgaaggagaagctccatttgcgaagttatagcaaggttccttccataatgcacagcagctgggccagggagccgggagtcgtcgcttctggcctacccatctctgggctacttcccgcaactcactttccctgtgtgcctggaatgcttcttcctatgaggccgttagtcaaattaagtagaggcctttaaaaattagccatccatccaatctagagaatgtccactacgcttcattctttctcccttaccctgttgatttcttccatatcacccagcgctgatggtaattgtatgaatacatgcttatctgtctgtcctcccacccctaactctaaattcaaggaactctataactgcacctagcatattgtctgacactcctcaataaagacgcatttaatacatagacaaataatgagtgaacattttgagtggagggccggaaaatgtctatttactttggagttggaatcagactgttcaagagtactttcaaaaaaaattttgctacgtcaaacatcattgaatttcaggattgaaagagtggtggtcatatagctcaatcccctccaaacacccccacccaccagatgcgcgaatgccctcttcagccttcctgataagcatgacgaagatgctggcggaagcatccctggtatcaggaaactcatgacctcactagttttgatcttttccatttagctttcttttcccactcctcccagttattgcaaccttaattgtagcattttacacaactgctgctgcagagttctggaagtctgggggtgggagggacgggggaaccccagtgcctatctcaagcctgcggtcaccgacgcgggtccggggtgggggggtactgccagggaactcgcggcaccgcgtgcttgctgagttcgcctgggctctcggcctccctgcgggcaggggtcctccctccccagcgccgggtctctcctcccgcaggcccgcggccacccgcagcggcattccccgccgccgcccccgccacctgcgcgaccgccctagccgctcgagtccgctcctcccgctcaggggcggctgcggagggcgcggggcgcacgcgggcggccacccgactcttccctcccttctccccaccccagcctgctcctgctcagccccacctccccacgcactcggctgccctcctcctctcctgagagttgccccgcaccttgggcgaggagttcggagcggccccatcgcagagcccacggccagccgagcgcgcgcgacgcaggtgcccgagccccggcgccgccgccatctctgccttcggtcgagttggacccccggatcaaggtgggacctgcttccctctccgacaccccctattgccacctcttcccgctctgggtaactcgagaatggggctttgggacgcgcgtggcagacgcggagccccgcgggccgcttagggactgggagtccggggcagcttagcgggaccaccagaggggccagcgcccggcgggcggcgggggtggggtgggtgcgacgccgggcgactctcggctcccgtggggcgaggaagatctggacacacggctgacagcagccggcagcgcctggagcgaacctgctcgggaccaccgagagagcatgccacccggccaacttcttttccaggcttcgtgcctactttggaaactgaagggactgccacctaaaacagtaaaccctggggtcctgaagagaatttgctggttcgaatgacaagagaaaaaataattgttctgtagggatggtttagacctcagcttttgtttcccacctccccccttccctgcaagcaaattaaacaacaacagtagcagcatcagcagcaaaaccccaaacccaatcctaaccaaaccacttactgaaagagatttgtagtggtgagaaaaagagacccaactgaggaatcatttgggaaccgcaggtatggtgccatttaaaaactggttctttctggtgttatttctagaacttgtgtttgcaaacagattagaattctgggctcttgtcagcctaatggagttctttatactgaagggtggcctggggtgtcctctgttaacatttatttctgtaagtattaaagtatattgaaacaaataccctttcacggctctggaattggaatcagaaaatctgagttttggtgtgatttccattttattacctatgacactgtggttcgtttaacctcagtgggcctcagtttcctcattttttcaagttggagggttggattaagataatttctgagggccttttgagaatatctaaggtatgccccagaataaaaaagtataattccttaactctctttaacttgttacaaacattgctagtttcataatttcatgaaataaaaacaatctgtattaatcttggcactagtttatatgcatttatgacttaggcttttaggattttcccaccaaaaggtatagagaaaaacatgtataaagagctcagaaacatatagatttatatgaatatttacacctctcatactaccttaaataatctttaagccagtatttgcaacactgcaacaaaaatacatggctttagcatagcacgtattctctttaagtattgtacatctggaggaaataaaaatgtgtttgaaggaaaacaaacattgcacctttcctatcaattattgttcttgaacagtgctggctactttttagcataaagttgtgggcagaatgttaaaaaattggtttcaggtcacttctgagccgctgtgaaattaagcacaatagcagagatgccaattttagtaatgcagttagttgccttggaatgaatcccagaaaatagcagagattaactaaacagataaaccagaaattaggaatggacacacgcacacacaaaagtgtctacagtgagtatgtactgtgaagggttagtgtacttcatactttctttttgattagaagaaaatgtcgggttgttttagcagacagagaatgttacagtagcttttgttgctacttctaatgttttatcagtagcattttcaagattatttgaaacttagttatcactagtaaggacaggtttaagaatatttctgcctcttttcggtggcttggattcaaaataataaaacaatcttttctcacccacatgtactttgtatgcagtttgggagagtgaaatggatttgaagtactcttttatgagtacattttaacttattttcagtgactttttgcctttgggctggaaatgtcgtaagttactcaggcatttatcttccctcatattctctggtgaagtagagatagtcatctccgttgaaacagatgctcagagatgtaagtaaattgcttgttgagtgaacagggaatcgtagaactcaaatataccctggttgctaagtcatttggaaaacaactgaaactggatggatccaacagctcacggtccacagccaactcattcatggcttgggagtgtcatcatgggtggcagaggctctgttcctcctttgtaatgtggggacttactctctcagcaatttactgagaaaaaagtaatctcttcacacttagatcactattataggaacaaatggtgtgtatttgtgaagtgcaatatttctgggaggtcttggaaataaatactaaaagtatccagaaaaaaaaaaaaaagaactctcttggcagatattgtactgcatttttcatactgagagccaaacacacccacttaaagagtatgtcctgtggagttaaaaatgaagaaaaaggcttatagtctgctctaattcttaagactttatgtgatttacaaattccagttttaattaaattagaaagttgcaaatgttcacctactggccacactcagtatgtacaaccttttggagttgctcttcaaatacgatctgcttatagtttggaatattccttctcaaacatgttttttggagtcttgctatgttgcccaggctgatttaatactttttgtgacttaatagtgatattacctgttatcatcacacataatcttattaatatttaaaatattttaaaactacaaatcttatataaatataaataaaatctttaaaacatttgaactgtaatgaatatagagagaagcatataaaacaaatttaatggttgacagataatatgataaatcattataataattgtaaggcaaatttctcattattcaccacccccaaaaaaagaacattgcaaatatcccaaaacttcttgtttgttccttcttcatcacaaatctaatttacctttttttaaaaaaagaaagttatttacttatttattttgagacggtgtcttgctctgtcgcccaggttggagtgcaatggctcgatcccagctcactgcaacctccgcctcccaggttcaagcgattctcctgcctcagcctcccaagtatctgggattacaggcgtgtgcctccacacctggctattttttttttttttttgtatttttagtagagatggggtttcaccgtgttagccaggatggtctcaatctcctgacctcatgatctgcccacttcggcctcccaaagtgctgggattacaggtgtgagccatcatgcctggcccaaaaaaagttttatatgattatggtaggcattaaatcatagattattttgcttaacattatgtttatgagattaagggatttcttctctctcctttaaaacaatattttttgaaagagttatctcggctgggcatggtgcctcacgcctgtaatcctagcattttcggaggctgagacgggtggatcacaaggtcaggagttcaagaccagcttggccaagatggtgaaatcccatctctactaaaaatataaaaaaatttatccagacctggtggcaggcgcctgtaatcccagctactccggaggctgaggcagagaattgcttgaacctgggagacggaggttgcagtgagccaagatcgcaccactgcactccagcctgggagacgagtgagactctgtctcaaaaagaaaaagaaaggaaggaagggaggaagggagggagggagggagggagggaggattgtctctattccctgtctccaattattctcttcacactgttaaaaaaaactcattcctattaatcttgttttcaatattctgctaaaactacgtcaaggtctactactgtcaagttcaccaatgatactacctttgctcatccagtagtcagttgtcagtgttcattttacttcactactggtagcattgtcacggttattactctgctccttgaaacagtcccttactgacttccaggacaccatgcattcttgattttcctccttcttcactggctgctcctttctgtctcctgtgctagcctctcctcttttcttagaggttttaaccttggaataccttaaggtttagctcttttttctccatgctttttgatgatttcatgcaatctctctatgtgtgtgtgttgatgattccgaaagtgatagctcaagccttgactgctccctctggacttcagatctttatattccagctgtctactgagcatttccatttggatgtctagtaggcatctccagttcaaattctccacatggaatcttcatctttcccaaacctgcactatctgcagtcttcctcatctccatctttcaagttagttaggccccaaaccttggagtcatcttcgattcctcctattctctcatacctcgtttgtaatgtgttggggaattctctgtgctctatcttcaaaacaaatccagaatataatgacttctcattacttccatggctctgttacaggaaaggggtcccaatccagaccccaagagagggttcttggatctcatgcaagaaagaattcagggcaattaggtagagtaaagtgaaaacaagtttatttggaaagtgaaggaataaaagaatggctactccatagagcagccccaaggtctgctggttgcccatttttatggctatttcttgatgatatgctgaacacggggtggattattcatgcctcccctttttagaccatattgggtaacttcctgacattgccatggcatttgtaaactttcatggcgctggtgggagtgtagtagtggggacaaccagacgtcactctcgtcatcatcttgattttggtgggttttggccatcttttttactgcaacctgttttatcagcaagatctttatgacctgtatcttgtcctgacctcctatctcatcctgtgacttagaatgtcttaactgtttgggaatgcagcccagtaggtctcagcctcattttacccagcccctactcaagatggagttgctctggttcagacgcctctgacagctcccaccctagtacaaggtgccatcaactctcacgtgagttattgcaaggacctccaaactggtctccctgcttttattttttgccctcttcaatacattctcaaaatagcaatcagagcactccttttataatgcatgtcggatcatgtcacttttctcctccaaactctccatggatttctggttcacacagagtaaaaaccaaagtccttaggataacctccaaggccctacctgatcattctgcttgccactttacctgtctggtctcatttcctactgttcttcctttcactttactcagttccagccacactgggctccttgctatttcttgactatattagaaaccatcttttcattttagcttttcctgccttgaatgcttgtcctccagatttccacatggttcgctttgttactgtcacttcttttaagtcttcgttcaaatgtctccttttcaatgaggcctactctgattacagtatttaaaattccatatcttcttaccttgtaatatattctttttcctttcctttcctttcctttcctcctttcctttcctttcctctcttctcctctcctctcctttgtgtctccctatagcattattttaccttataaaatactgtgtgactttctaattatcttttttttttctgtcccatttccactagaatgtgaactccacaagggcagaattttgtcctgttttgctcactgttgtgtccctagtgtgtgaaatagggcctaacatgtaagaggtgctcaatgctttttttggtgattgaatgctattgtttgttcatttttattcctggatatattcaattctataaatataacacgttaatttaaaacatgaattctgattatgcacatttagtttccttcctttcttcttccctcacccatcacttcttccttcctgccttcctcccttccttcttttttgccactataaataaagcagctatgatccatctacaagtgtgctagtatacgaagtttctttagagcgtaaaaccaatagacaaattacgggctagcaggacttgcagacttcaactttattagataatgaatgccacacatttttagtgtggattcaccaatttgcattcctgtttttattgctctacaccagatggacaaacttcgtattgccagaacatttaatttttcgccatctgatgggtattatctcattaatagttactactttaattactggtgagattaagcctggtgtctgtgaggataggttaggttatgctgcagtaacagataatcttcaaatctcatgggcttaatgcagttcttcactgatgcaaagtctcctatggactaagacaactctctggggcaacttctccatgtaataacttggaggtctaagttcagggaaactccatcattctgtaactgtaacaatctggaacatggaactttcccatttggtgtggtaggggaaaagacagcagggatggatactcgtgagccatcttcaaatgcttccatctgaaagtgacatgaattattttcaaatgctaaacgtaagtgtttaagatagtcatatggtaatatgacccagtaattctattcctaggcatatacctaagatggatgaaaatatacatccacacaaaaagttgtacagaagtgtcagtggcaacattcttcataataaccaaaaaacagaaactgcccaaatgtccatacactgatgaatggataaacaaactgaggtatatccatacaatggaatattattaggcaataaaagggaatgaagtgctgataaatgcttcaacacgatgatccttgaaaacatgatgctaacagaaggaagccagttactaaagaccccaggattttatttatatgaactgtccagaataggcaagtccataaacacagaaagcagatcagtggttgccggggatggaggaagctggtgaaaggggagcgactgctaatgaggaagaggtgcattgtggggtgatgataatattttgaaattagacagtggtgatgattgctctgttagatacattcactcaatgtactaaacctagtgaattgtatgctataaaagagtgaactttatgatatatgaataatagaccaataaaactgatattttaaaaaatactttaaaaataaagtatatttctatatgccatcaagaaacagaaaatgaaatattttagaaatgcatcatttaaaatgattccaaaaacatgaagttcctgtgaaaaacatctaacaagatgttcagggacttttatggaaaaaattagatgagatttacatctcatattagggaagaactcagtatatggagacagatagtcatacattttaggactgaatgattaaaggatatcaatttccttttcattgttatagactcaaaacagtctcaataggatctctattaaattcctaacaatttttttagaacttgacaagctgattctaagatgtatatggaaagtcaaaacccaaagaatgctaaagcactcttgaaaaagatgcaaaatgggagaatttgtgctatcggatagcaagactcgttttaaatctgtagtaatcaagacaatgtttctttattatttctttttcccttctactttctttgattttttctgttctaactgcttaagtgaatgttcgattaaatgttttattctaacagattataaaggaatgatagcacattaattttcagcctttcttctttttgaaaagtattatttatggctttgagctgccttctacatacttctttatctgtgtgaaataaattttgagatactgttttcactaagatcagtttaaaataggttctgattttcatatttctttttgcccagttattaacttaaaagtatttttctggttaattgaaactttagtcaatttggagtaagcttcttgatttctaatgtttctttttgcattaaagcctattttgtatgatattgatataactccaccagctttcttttgttccgtatgtgcatgttaaatcttttttccatcctttgctttcagatttctacatacttattttaaatgtgtctctgtatcctatatcatttttctgtcattctgcattcaacctttctatattcttatgttttagatgtgtctgtagtaaacagcatttatttcttaaggtattttaaattcaatgtctttccactggagaattttgtcagtttacatttaatacaattactgatatattgaggcttgtatttactttctgctttctttatttgcccataattctggttattttcttttttattgccacattttaggttgattatttttatcacttcaaattttctttcattactttaagagttatacactctatttctattgttcagtaactactgtggaagttaccatatgaatccttaagttatcgaagttgaaaatgaatacactttgagcactaatgagtacaggaaaatacagaggccttagcttactttaacttcatttaatactctcttgccatatattgtgagcatcttgaattccatttatttattcaaatatttattgagagcttactcggggctaagcattattctagatactgaacaaaatagatgagcatccctgtgcttgtaagacataacagagtgcaaacaataaacttaatagagtaaattataccatatactagaaggtagtaagtatatggaaaaaaaactagagcaaggcgaaagagattaggagtgccgagagagggagaaagagaatgaatgagagtgagtgcacataagtacaagtgaaagtgagtgagtgtgccctagctttggaccaatactgtctataaagtttgtggggacatataaatgttttatctattttcactagataacagctgaaaggtttgagccaaatagagagtctcaggtgcttctataatggtattataataggctttaaaaacgtgaaaaactcatgtttaagaacagctgttaccaactatctgttttgtgagggtggaggacaacttagtttttctcagaattaattatactttcttattgtaactttagccgctgttatttgggtctctaaacctatacaaattaagaagctatgaacatgagagaatcaaacaattagatttctgtgcacaccaacagaatttctgaaccaaagtggtttgtgtttaggagatgaaagagatgataaatcatacacacacacatagataaacacacatattatatgcatgtgtgtgcatgtgtgtgtgtgtataaacacagagagaaaacatactggcatacacataagcacctgttaattgtagttgctgttatagtagtaagatgttatctcttagaattatggtatacttatcatattagacctatccaggaggtagctgggtatctagtgtggtgatactatctagtgtggtgtcttgcaacaacactgctagtcataggtctgatttgggggagaaaatatttttttaagacagtgtctcgctctatcacccaggctgaagtgcagtggcatgatcatagctcattgcagcctcagtctctgggttcaagctaccctcctgcctcagtgtccccactgcatgctaccacacctggctaattttttcaaatttttagtagggacgaagtcttgctatgttacacagggtggtctcaaactcctgaactcaagtgatcctcccgctttggcctcccaaagcgcagggattacaggtgtggaccatcgtgccaggctgggagaaaagttttgttgacacaacaaacaggatgcaaagaaacaatctataaaaacagtaatttaggtaagtggcttcttggtcttttgattaataggattctaaacttgcaaatcaattcttatgcaggagttcttattggcatttaccgatgctctttggctgatgtttgtttttactgaccagaggttctgtgggaatctcatttattaatacttacaatgtgcttcatattcctctgcatctttgagggacaattaaatgtccactctatggaatcttttataatttcccaatcataagtaattactctgatttctcctaattacccttttttctaggtagttgtgattctttaagtctaagacagcatggatttttaagctacaccactgatatagtttggataatagtcccctccaaatctcatgttgaaacttgattcccagtgttagaggtgagtcctgaagtgggaggtgtttaggtcatggagcagatccccaaagagtggcttggtgacatcatcacagtaatgagcatgttcttactctattagttcctgtgagcactgatttttaaaaagagcttggcttgtccctcctctctcttgcttccatgctgtcactatgtgatctctgcatgctggcttcctttcccctctcctttgcctgcactatgagtggaagcaactcgaggccctcaccagatgcagtacaggtgccggtgccatgcttcttgtatcgcctgtggaaccatgagccaagaaaccttttttcttcataaattacccagtctcaggttttcctttgttacaacatgaatgaattaagataaccatcatttttgtatcagtaaaaagaaaaagctctgcgtatttaactattatacagtattttttatcatttaaaaatttatacttattcagatagctcactaagaattatatatataaacatttttatttaaatcatgccattctcataaggaaagtataaatcaaagatttcggttaagggattcttattcatattcaaagtctgtttttttcaagttgcttttcatctcagaactgttgatgtaaatattttcccaaacagtatcatactctgggctatcaagaatatttgtgatacagcaattcaaaaaagaatgcctcactattgtttctgggattttcttccaagctggttcattttgctaattttgatgcggcttttaactgatcttgtaagatgtcaatatcgggttttttggagttcatattctttcctcaaatggtctttaaatagtttgttgaccaaaatattgataggttaaaattgtccagttggtcattaagaaagtgtccagttttgatgtatgcaatcaataacaaccagatcacagctgctaccaggccatcgggaattgtaagatgctataaatttaaacaatgatgctgatgccagaggtgttaaaatgttgtgaatcttaaaacagaagacatacaatactactctcttcctttgtatttcctgtagttcaactaaaaatctcacctttcgttggcccctaggactttgtgagtagctattttctctgaaatcccatagtactttatttaatgaaaggaactaagtaataatttggggtgaaaataatccatgtacatggttaaaaaaaacttacttatgtataaaccagtagccctctgctctactacctacactaaagggtataacctgaccctaggaacaactagtttgaaccatttctggttttagtccttcttcctctagggctaaattgtatgtttatactgtctgcttttctttttttttcatttatcatttaagcagataccatagtagaagataatttagcctactcatttcacctccttttcttttttgctcctccacatatattaattttatgagctcctttattggttacatttgtcatttccaccacgatatttgttccattaactacagacagtttctcttgaacccctgcttcatgagtttgggatatttcaccctttctcctctcaccatctctccttgtatattataacacctaaatctgacaactgtgtggtgagagtattgataatattttaggtttagtatttgttattaaattttgtatttttgtctattggttgaccctaaaagttgaaaaattaataaatagcattaaagttattatgaccctgtaaatgttgtttactgcagaatcaagaagtattctacagttacatttcattcagtatggctcctgagccacccaaagaatgttcctagaatcaaagttaaggagattctttctttcaaatggattatttaattctagcatttgctaaaaatttgccatattttcttttcattcatatttacattgtgaatttctgtgacgctttttcaaattacctttattttttcttattgggaaagcatatgtgggccttcctggtttcatccttaataattttcagctttttactttctttatttttttgaatgcattttcttccttttttttttgaagtccactgactcatattctagtggcttcaattttgaattatgacttcctttttccctggtgtttattctgtttttattttattttcaagtttttttctggcttcaggattatattatgtgtcaggttgccttccatctccaccttcctccttgccatctccttttgggggccatctatactacagctgctatctggactagtcatttgaaagtttgcagagccagcaaacttgtttgtaaccacgatttcctgaatgtgtatgtttttgtcgtttttggttttctcctcattttgctggaatactttataaaattacttctggcaaataaatttatactatataaattttgtaagccattacattactaaaagtatatttgtttctctcggatacttctttgactggatgtaaaattctaaactgaaaagaattttctataagtcagttgctggattattttctagtattcggtgttttgggatgaaacatttgttttccattctctttcttactcctttagtgatttttttcttctctggaatcttttcttatattctttttttctttgttgtttggtaatttcttaattatatgtttaggaatgaatctgtttccattcttctttcttggagcctggtagccatatttttcactttgaacacttgtgccttttatctctgggaaatgtgccttttatctcttgtgccttttatctctggaaacacttgtgccttttatcgctgggaaattttcttgtattttttttgtgtgattattttctcctttctattctttttttctggaagtactgttggttggatttgggtctcttggatttatttttaagtgacttctttttcttaaacatttatttcctggttttttttttttgcctttggggggaaatgttaattatgcattttttttaaaaccattgaaattttttttttgtactatgcatgtaattttcaaaagctctttcttgctctcattattcctttgttattttatggatccaaaactttctgaaatgtctctgccaatactcattaaagatttgttaaagcttttttttttttctttaatttatccctgtgtccctggtggttagtttcctttttactttctttttataaaagaaaaatttaacacaatgctaaagactttcttcatgtctttgtgtctccattcagcatggctgttaaatgaagaaacaggaagaatgtgacttctgtgcatatgggcagtgttttatcaactgataggcttcatgttaggcactcaatcaaagagctgccatttatgctaaaggcctgttgcctaaatgtcagggctttaccataccggtgccaagtttacatgaaaagctcaagttctcaaacaacttgtactttttcctcctttaacacataggagtgtatactataatttttaaattgtctttggccatttgacacctttgaatactttgctcgtgtttgaggaatttccacttaataagcccctgttttcccaagcttcctggcagtctgcctgtagagtgtgaagtaggctccatcagttagaggcatttgtgccagattttagatcagaagtgtgggacatgaaagggcagatgagctccccggagctcagaggtagtaggcattgaggtttcagtcataacatgcagtatcctggtatggtgcagggctgtcttctctagagcaattctgcatgggattttgggtgtggtcttggctgtgtgcttttctagcttggttctctggcactcactgaggttcggagagctacccagtaaactttaataaatttctttcctgcttagactagtcaaagttcatttcagttgtttgttagtcactctcctgacagttacatggagctagtttagctgctgtgcaatgtttgtgaggaggtgaattacatacgcagatattacatgtgcagaccaaaatggcctctccttttagccccacctcaccctcctgcccttatcatttagaacatctgcaggtttgttttctcattgttgacagcctattctccaaatatcctatgtagttactacctttgttatacctcattagtctttgctaattgatatggtttggatatttgtcccctccaaatctcacgttgaaatgtaatctccagtgttggtggtggggcctggtgggagatatttgggtcatggggtgggtccctcacgaatggcttggtgccctccctgtggtaatgagtgagttcttgctctgagttcatgcaagatctggttgttaaaggagcctggcatcttcttccaccctctcttgctcccccttgccatgtgatgcacctgctccccattcactttccaccatgactgtaagcttcttgaggccctcaccagaagcagatgctggcctcatgcttcctttatagtctacaggaccatgaaccaaaataaaacacttttctttataaattacccagtctcagatattcctttttaacaatgcaagaatggactaacacactaatgttttagaaatttgtttttctcttttgctgctgatcgctctctcattcactcttgtagtgggttgatattatttactttactataattttcaaggtatctcaggagggaaagatcagtttgttcagtttaccatttttttttgagacagcatctcactctgtcacccaggctagagtacaatggtgcaattttggctcactgtaatctctgcctttcaggctcaagcgattctcatgcctcagcctcttgagtagctgggattacaggcatacgccaccatgcatggctaatttttatatttttagtagagatggggtttttccaggctggtctcgaactcctggcctcaagtgatccgcctgccttggggttccagagtgctgggattacaagcatgagccaccgtgcctagtcccagtttaccatcttgaacctgaagtcccactggtattatcgtgctttgacatgtaaaaaaattaataaaatgttatttcttaaagtaaataaattttaattattttctacatttctagcatcacatgtggtagcttgcattttattgaatatctggttaatatttaaatgagtcaatttatgtagagcttttagattacaccgtaggtaagatgcctactctgactcaactttgttgactttatggtacccacatctgtgaatcatagcttatccttatgcattttttaggaattaatatgtgacaagttcacacagagtaatatcaggaattaaagtacttgaaattatgttttccaagtgacaaatatttatgccaggatgttggaaggttttttttttaattaaaaaataatttaagtctttaacagctacttgatgggaataacatgaccaatttatattccaagtgaataaataaaagttaacatacttaaaatgacaaggctactggaaatagatcaggctatatttattttgttaaatttttgatacttgaagaaatagtgtttttcagttgcatttaaattaaatgtttaaatgcttatttaagtgagagatagacagatgcttctctaacaaaaagtaaaagcaaaaattagtggcatttggagctcattgagttaactcatcaaagcaacattattgtcagaattgcttttcttactcataaactttcctacacactcagagattttttgagatcaatggagcaagttgtaaataattttatttctgctcaaacactgattgagactgttctgttttatatttaagtagaatttgataggtaaaaataacacaaataatcctttacaatagaaattaaacagtctgatcttcctttgaaagcccaaattatgcttattcagtagaatatagatttggattttttcttcatagtaataactgaagagtaagcatgattaatatgcttactgtgctgggcatattatgcaaattaaattactgcttgcatacccatacatcatggatgtatcatttagatcagactgtggatttgtctttgtatactttatacagatttcttcaaatatttgtatatttcaacataggcttttttttcttttcatttctttctaaattcctaagggctgtttttctttttaaacgtgagaataaatatctacattaattatttattatatactttaattgattcaacaactatttatgagtacttacgatgttccagagaatatattaaaatacttgtttttcagaagtctaatatggatgagaaacattgtgcctattctttttttttttttaaattgtactttaagttctgtgatacatgtgcagaatgtgcaggtttgttacataggtatacacatgccacggtggtttgctgcacccatcaacccgtcacctacattagatatttctcctggtgctatccctcccctagccagccaccccccgacaggccctggtgtgtgatgtttctctccctgtgtccatgtgttctcattgttcaactcccacttgtgagtgagaacatgcagtgtttggttttctgttcctgtgttagtttgctgagaatgatggtttccagcttcattcatgtccctgcaaaggatatgaactcatccttttttatggctgcatagtattccatggtgtatatgtgccacattttctttatccagtctatcattgatggccatttgggttggttccaagtctttgctgttgtgaatagtgctgcaataaacatgtgtgcatgtgtctttatagtagaatgatttataatcctttgggtatatacccagtaatgggattgctgggtcaaatggtatttctggttctagatccctgaagaattgtcatactgtcttccacaatggttgaactaatttacactcccaccaacagtgtaaaagcgttcctatttctccgcatcctctccagcatcttttgtttcctgaatttttaatgatcgccattctaactgacatcagatggtatctcattgttgttttgatttgcatttctcaaatgaccagtgatgatgagcttttttttcatatgtttgttggacacataaatgtcttcttctgagtagtgtctgttcatatcctttgcccaccttttgatggggttgtttgtttttttcttataaatttgtttaagttctttgtagattctggatattagccctttgtcagatggttagattgcaaaaattttctcctattccgtaggttgcctgttcactgtgatgatagtttcttttgctgtgcagaagctgagctgtttagtttaattatatcccatttgtcaattttggcttttgttgccattgcttttgatgttttagtcatgaagactttgctcatgcctatgccctgaatggtgttgcctaggttttcttctagggcttttatgggtttaggtcttacatttaagtctttaatccatcttgagttaatttttgtataagttgtaaagaaggggtccagtctcagttttctgcatatggctagccagctttcccaacaccatttattaaatagggaatcctttccccattgcttgtttttgtcaggattgtcaaagatcagatggttgtagatgtgtggcattatttctgaggcctcttttggttccattggcctatatatctgttttggtacagtaccatgctgtcttggttactgtagccttgtagtatagtttgaagtcagttagtgtgatgcctccagttttgttctttttgcttaggattgtcttggctgtgcaggctctcttttggttccatatgaaatttaaagtagtttttaaaattctttaaagaaagtcaatggtggcttgatggggatagcactgaatctataaattactttgggcagtatagctgttttcacaatattgattcttcctatccatgtgcatggaatgtttttccatttgtttgtgtcctctcttatttccttgagaagtggtttgtagttttccttgaagaggtcattaggtattttattctctttgtagcaattgtgaatgggagttcactcatgatttggtgctctgtttgcctattattggtgtataggaatgcttgtgattttcacacattgattttgtatcctgagactttgctgaagttgcttatcagcttaaggagattttgggctgagacgatggggttttctaaatacacaatcatgtcctctgcaaacagagacaatttgatttcctctcttcctatttgaatacccttaatttctttctcttgcctgatttccctggctagaacttccaatactatgttgaacaggagtggtgagagagggcattcttgtcttgtgccagttttcaaagggaatgcttccagcttttgcccattcagtatgatattggctatgggtcataaatagctcttattatttttagatatgttccatcaatacctagtttattgagcgtttttagcatgaagcagtgttgaatattatcgaaggccttttctgcatctattgagacaatcatgcggtttttttttgcatataaatataatagaatattattcagccttaaaacggggtgaaattttgatacgtggtacaacattgataaactttattttattttattttatttattattattattatactttaagttttagggtacatgtgcacaatgtgcaggttagttacatatgtatacatgtgccatgctggtgtgctgcacccattaactcgtcatttagcattaggtatatctcctaatgctatccctccccactccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatacacccagtaatgggatggcggggtcaaatggtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctacataaatgtcttcttttgagaagtgtctgttcatatcctttgcccactttttgatggggttgtctgtcttcttcttgtaaattagtttgagttcattgtagattctggatattagccctttgtcagatgagtagtttgtgaaaattttctcccattttgtaggttgcctgttcactctgatggtagtttctttggctgtgcagaagctctttagtttaatgagatctcatttgtcaattttggcttttgttgccattgcttttggtgttttagacatgaagtccttgcccatgcctatgtcctgagtggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcagtgttatttctgagggctctgttctattccattgatctatatctctgttttggtaccagtaccgtgctgttttggttactgtagccttgtagtatagtttgaagtcaggtagagtgatgcctccagctttgttcttttggcttaggattgacttggcgatgcgggctcttttttggttccatgtgaactttaaagtagttttttccaattctgtgaagaaagtcattggcagcttgatgcggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagctggattcctaagtattttattctctttgaagcaattttgaatgggagttcactcatgatttggctctctgtttgtctgttattggtgtataagaatgcttgcgatttttgtacattgattttgtatcctgagactttgccgaagttgcttatcagcttaaggagattttgggctgagacaatggggttttctagatatacaatcatgtcatctgcaaacagggacaatttgacttcctgttttcctagttgaataccctttatttccttctcctgcctaattgtcctggccagaacttccaacactatgttgaataggagtggtgagagagggcatccctgtcttgtgccagttttcaaagggaatgcttccagtttttgcccattcagtatgatattggctgtggatttgtcatagatagctcattattttgagatatgtcccatgaatacctaatttattgagagtttttagcatgaagggttgttgaattttgtcaaaggccttttctgcatctattgagataatcatgtggtttttgtctttggttctgtttatatgctggattacatttattgatttgtgtatattgaaccagccttgcatcccagggatgaagcccacttgatcatggcggataagctttttgatgtgctgctggattcggtttgccagtattttattgaggatttttgcagcaatgttcttcaaggatattggtctaaaattctcttttttggttgtgtctctgcctggctttggtatcaggatgatgctggcctcataaaatgagttagggaggattccctctttttctattgattggagttgtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctgatttagtcttgggagagtgtatgtgtcgaggaatttatccatttcttctagattttctagtttatttgcatagaggtgtttgtagtattctctgatggtagtttgtatttctgtgagatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttacatatttcttgccttctgctggcttttgaatgtgtttgctcttgcttttctagttcttttaattgtgatgttagggtgtcaattttggatctttcctgctttctcctgtgggcatttagtgctataaatttctctctacacactgctttgaatgtgtcccagagattctggtatgttgtgtctttgttctcgttggtttcaaagaacatctttatttctgccttcatttcgttatgtacccagtagtcattcaggagcaggttgttcagttaccatgtagttgagtgtctttgagagagtttctgaatcctcagttctagtttgactgcactgtggtctgagagacagtttgttataatttctgttcttttacatttgctgaggagagctttacttccaaccatgtggtcaattttggaataggtgtggtgtggtgctgaaaaaaatgtatattctgttgatttggggtggagagttctgtagatgtctattaggtctgcttggtgcagaggtgagttcaattcctgggtatccttgttaactttctctgtcgttgatctgtctaatgttgacagtggggtgttaaagtctcccattattattgtgtgggagtctaagtctctttgtaggtcactcaggacttgctttatgaatctgggtgctcctgtattgggtgcatatatatttaagatagttagctcttcttgttgaattgatccctttaccattatgtaatggccttctttgtctcttttgatctttgttggtttaaagtctgttttatcagagactaggattgcaaccccggtctttttttgttttccatttgcttggtagatcctcctccgtccttttattttgagcctatgtgtgtctctgcatgtgagatgggtttcctgaatacagcacactgatgggtcttgactctttatccaattttccagtctgtgtcttttaattggagcatttagtccatttacatttaaagttaatatcgttatgtgtgaatttggtcctgtcattatgatgttagctggttattttgttcattagttgatgcagtttcttcctagcctcgaaggtctttacaatttggcatgattttgcagtggctggtaccagttgttcctttccatgtttagtgcttccttcaggagctctttcagggcaggcctggtggtgacaaaatctctcagcatttgcttgtctgtaaagtattttatttctccttcacttatgaagcttagtttggctggatatgaaattctgggttgaaaattcttttctttaagaatgttgaatattggtccccactctcttctggcttgtagagtttctgccgtgagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccaagttggtcactttcaggtacaccaatcagacgcagatttggtcttttcacatagtcccatatttcttggaggctttgttcgtttctttttattcttttttctctaaacttcccttctcgcttcatttcattcatttcatcttccatcactgataccctttcttccagttgatcgcattggctcctgaggcttctgcattcttcacgtagttctcgagccttggctttcagctctatcagctcctttaagcacttctctgtattggttattctagttatacatttgtctaaatttttttcaaagttttcaacttctttgcctttggtttgaatttcctcctgtagctcggagtagtttgatcgtctgaagctttcttctctcacctcgtcaaagtcattctccatccagctttgttctgttgctggtgaggaactgcgttcctttggaggaggagaggcgctctgctttttagagtttccagtttttctgctctgttttttccccatctttgtggttttatctacttttggtctttgctgatggtgatgtacagattggtttttggtgtggatgtcctttctgtttgttagttttccttttaacagacaggaccctcagctgcaggtctgttggagtttgctagaggtccactccagaccctgtttgcctgggtatcagcagcagtgtctgcagaaccgcggattttcgtgaaccgcgaatgctgctgtctgatccttcctctggaagttttgtctcagaggagtacccggccgtgggaggtgtcggtctgcccctactggggggtgcctcccagttaggctgctcgggggtcaggggtcagggacccacttgaggaggcagtctgcccgttctcaggtctccagctgcgtgctgggagaaccactgctctcttcaacgctgtcagacaggaacatttaagtctgcagaggttactgctgtctttttgtttgtctgtgccctgcccccagaggtggagcctacagaggcaggcaggcctccttgagctgtggtgggctccacccagttcgagcttcctggctgttttgtttacctaagggagcctgggccatggcgggtgcccctgccccagcctcgctgccgccttgaagtttgatctcagactgctgtgctagcaatcagcgagactccgtgggcgtaggaccctccgaaccaagtgcgggctataattctcctggtgcgccctttcctaagcctgtcggaaaagctcagtattcaggtgggagtgacccgattttccaggtgccgtctgtcacctctttccttgaccgggaaagggaactccctgaccccttgcgcttcctgagtgaggcaatgccttgccctgctttggctcgcgcacagcgcgctgcacccactgtcctgcacccactgtctggcactccctagtgagatgaacccggtacctcagatggaaatgcagaaatcacccgtcttctgcgtggctcacactgggagctgtagaccagagctgttcctattcggccaccttggctcctccccccatcatgtggtttttgtcattggttctgtttatgtgatagattatgtttattgatttgtgtatgttgaagcagccttgcatcctagagatgaagccgacttcatcgtggtggatgagctttttgatgtgctgctggattctttttgccagtattttattgaggatctttgcaccaatgttcatcagggatattggcctgaaattttctttttttgttttgtctatgccaggttttagtatcaggatgatgcgggcctcataaacgagttatggaggaatccctcttttcctgttgtttagaataatttcagaaggaatggtaccagctcctctttgtacctctggtagaattcggctgtgaatctgtctggtcctgggccttttttggttggtaggctattaattactggctcaatttcagaccctgtttttggtctattcagggatttgacttcttcctagtcttgggaggtgtatgggtctaggaatttatccatttcttctagattttctagtttatttgcatagaggtgtttatagtattttctggtggtagtttgtatttctgtgggatcagtggtgatataccctttatcattttttattgtgtctatttgattcttctctcttttcttctttattagtctggctagtggtctattttgttgatcttttcaaaaatccagctcctggattcactgagtttttgaagggtttttcgtgtctctatctccttcagttctgccctgatcttagttatttcttgtcttctgctagcttttgaatttgtctgctcttgcttctctagttcttttaattgtgatgatagggtgtcaattttagatctttcctgctttctcttgtgggcatttagtgctataaatttccctctaaacaccgctttatatatgtcccagagattctggtacgttgtgtctttgttctcactggtttcaaagaacatctttatttctgcattaatttcattatttacccagtagtcattcaggagcaggttgttcagtttccatgcagttgtgcagttctgagtgagtttcttaatcctcagttataatttgattacactgtggtctgagagacagtttgttatgatttctgttcttttgcatttgctgaggagtgttttacttccaattatgtggtcaattttagaataagcgcgatgtggtgctgagaagaatgtatattctgttgatttggggtggagagttctgtagatgcctattaggtcttcttggtccagagctgagttcaagtcctgaatatgcttgttaattttctttcttgttgatctgtctaacattgacagtggggtgctaaagtttcccactattatcatgtggcagtttaagtctctttgtaggtcattaagaacttgctttatgagtctgggtgctcctgtattgggtgcatatatttaggatagttagctcttcttgttgcattgatccctttaccattatgtcatgctcttttttgtcttttttggtctttgttggtttaaagtctgttttatcggagactaggattgcaacccctgctttttcttttttgctttccatttgcttgataaatattcctccatccctttattttgagcctatgtgtctcacatgcaaaggcatgtgagactggtctcctgaatacagcacactgatgggtcgtgactgtttttccaatttggcagtctgtgtcttttaattggggcatttagcccatttacatttaaagttaatattgttatgtgtgaatttgatcctgtcattatgatgctagctggttgttttgcccattagttgatgcagtttcttcatagtgttgatggtctttactatttggtatgtttttacagtggctggtactggtttttcctttccatgtttagtgcttccttcaggagctcttttaaggcaggcctggtggtgacagaatctctcagcatttgcttgtctgtaaaggattttatttctccttcacttatgaagcttaatttggctggatatgaaatcctgggttgaaagttcttttctttaagaatgttgaatattggcccccactctcttctggcttgtagagtttctgcagacatatccactgttagtctgatgggcttccctttgtgggtaacttgacctttctctctggctgcccttgacgttttttccttcatttcaaccttggtgaatttgacgattatatgtcttcaggttgctcttctcgaggagtatctttgtggtgttctcgtatttcttgaatttgaatgttggcctgtcttactaggttggggaagttctcctggataatatcctgcagagtgttttccaacttggttctgttctccccatcactttcaggtacaccaatcaaacataggtttggtcttttcacatagtcccatatttcttggaggcttagttcatttctttgcattctttttttttaatcttgtcttcatgctttatttcattaagttgatcttcaatctctgacatcctttcttccgcttgttcaatttggctattgatacctgtgtatgctttacaaagttctcatgctgtgtttttcagctccatcaggtcatttatgttcttctatatactggtttttctagttcgcaattcctctaaccttttttcaacattcttagcttccttgcattgggttagaacatgcttctttagctcaaaggagtttgttattacccaccttctgaagcctacttctgtcaattcatcaaactcattctgttcccttcctggtgaggagttgtgatcctttaaatgagaagcggcattctggtttttggaattttaagcctctttgtgctcgtttttcctcatcttcatggatttatctaactttggtctttgatgttggtgacctttgaatggcgtttttctgtggaatcctttttgctgatgttgatgctattcctttctgtgtgttagttttccttctaccagtcaggcccttctgctgcaggtctgatggagtttgcttgaggttcactccagaccctgtttgcctgggtatcaccagcggaggctgcagaccagcaaagattcctgcctgttcctttctctggcagcttcgtcccagaggggtacccaccagatgccagctggagctctcctgtatgaggtgtctgttgacccctgctgggaggtgtctctcagtcaagaggcagggtggttaggaacccatttgaggaggcagcctgtcctttagtaaagctgaagcgctgtgctgggggatccactgctctcttcagagccatcaggcaggaatgtttaagtctgctgaagctgtgtccacagccacattcttcccccagggagaatgctgtgtcccagggagatgggagttttatctataagcccctgactggggctgctgcctttctttcagagatgccctgcccagagaggaggaatctagagaggcagtctggctacagaggctttgtgtgcagcagtgggctccacccagttcaaacttcccagagaccttgtttacactgtgaggggaaaactgcctattcaagcctcagtaatgacggacattccttcccccaccaagcttgagtgtcccaggtcgatttctgctgtgctggcagggagaatttcaagccagtggatcttagcttgctgggctccatgggggtggtatccgctgagctagaccatttgactccctggcttcagcctttccggggaagtgaacggttctgtctgtcttgctggcattccaggcactgctggggtatgaaaaaaaaaactcctgcaactagtttggtgtctgcccaaatggctgaccacttttgtgcttgaaacccagggccctggtggtgtaggcacccgagggaatctcctggtctgtgggttgggaaggccatgggaaaagcataatatctgggccagagtgcactgtccctcacggcacagtccttcatggcttcccttggctaggggagggagtttcttgatcccttgcacttcctggatgagccaacgccccatcctgcttcagctcaccctccgtgggcggcacccactgtctaaccagtaggaatgagatgagccgggtacctcagttggaaatgcagaaatcacctgcctcctgcgttgatctccctgggagctacagaccagagctgttcctattcagccatcttgccagccacccccgcctgttctttttttgtgttcttcttgctaaatttatttagcatgagaacagcaatagcatgttctcacataagaagctgactaacagaatgcacagcatataaaaaatgtgctatttgtatagaaataatttgtcaacttcagcaatcagtttgagacccacatatcacctggatgaatggttctcctgcagaatctgattcagaggaaagagtcatgtggtgcggtgacttgaaagagctgtggtgaataattgaattctaagaatggccacagtagactccctgttaatatttctgaaaagtagggttatggagcacatattattaaactgttatttttaatagacatcttatacttgtatctggtctgtaagaccagtcatattagtgtacatttttcaattagtttactttggaagtgggcacaggggtctacactgctcaaatctgtaattataattaccttatgataatttattatggcaataatgggaatttgcttatttttctttgaaaaatgttttcaagctatacttgtttctgccatgatagagaacttttgcaacattcatttttgttgtgagagtagagccacaatgattttctaatgagaattgattaagccctttccttaccctagcccagttctaagtattgtcagtggtgattgggatagagggtagtctgtttggcatgtttccatgtcatgtgaggatgtcaaccctccgtctttttgaatgactgctaaggcacattactccttttaactgtcaacagagaatgactactactgtggtctgaatgtttgtgccaccacagaattcatatgttgaaacctaattaccaatgcaatagcattaagaggtggggcctttaggaggttattaggtcatgagggtggagccctcatgaatgggattagtgcccttataaaagaggctgcagcggagcttgttcaccccttctgccatgtgaagacatggcaagaaggcaccatctatgagaagtagtccttcaccagagattgaatctgctggcatgttgatcttggactttccagcctccagaattgtgagcaatacatttcctttctttataagccactgagttcgtggtattttgttatagcagcccaaatgaatgaagaaaactgcattccaggggaatgttaggcagtattatctcacctcttcatagtgtgatgtctgtgactggctcagttcatgcagctctacttgtggaatgtgcattacatttatttatctatatcaggaattcttaatcctggagaaatttcaagggattgttaaccccttgaaattatagccctaattttagttgtatgtgcttcctcatggcgttgatacacttctttcaccaaattctcagtcaggtccatgttccaaaaaatggttaagaatcaccattttgaaatccttcttgctattatgccagattctcaaacagctgtatctggatgataggagaatgcctctttgaaggttgcttttgtgcatgttggcatgggggaggtgctaaaatttcagatgggatggccagggcaggctcctttagaaggtgagttgagtggtggggagagcagtggatgacgagtgggatctgggaccttgtagtcctgttcaggacttggacttttactacaagtgacaggagagggctgtagtgctttgagaaagagagacatgatctggtcaatgtgttaataagatcactgtgactactgtgttagagagacatgatctgatctgtgttaagaagatcactttaactgctatgttgataactgactgaactggggagcaaggacagaagtagagagcctcttctgatagttccgggaagaaataattgtggcatagaacagggtattggtagtggagagggtgacaaattattaaattttgaaattgctttgaaactctggtattattaggatgttcatgaggatgttagctgttattttataaaattaatcaataattttcttagtgttaggattatttgtactcttctcctaaactgttcatttcattttaactactcagaatttataattgaacaatacaaccataagaaaagttagaacaaattaatggttcatccttaggaagtgtcttcatattaatggtgtttggtgtattaggcttattttggtcatcctatctttaattttccctttgcttcattcttttttcaccaatttaaaaaatttctgtcactttttctgtcttttatttagacagagtctcactttgtcatccaggctggagtgcagtggtgtgatctcagctcactgcaaccttcacctcccgggttcaagtgattctcttgcttcagcctcccaagtagctgggattacaggaacacgccaccacacccagctactttttgtatttttagtagagacagtgtttcactatgttggccaggctggtcttgaactcccgacctcaagtgatccacccgccttggcctcccaaagtgctgggattgcaggtttgagccactgcacccagcctctttttctgtattatttgtgttttaaaaaacttctttatattcctttttgtacagtttagggtgcatgtttctctcattgaatctatgtcagataccacctttcactgtctcttcaaggttgtgtctatgtcctttttacacttgtgattgtttctctgttatttaagaatgaaacctgattccacgaatccaaaccatcagaatagtttgtgttttgcatggaacattaaataaagaagtggttgttttatgtaaggaaaactgctgatctatttgatcacttaactgaggagaccaggtgagttaaaaacaagccaaatcatttgttgaactgaattactatagtcactagtaagtttcatcaaagcaatccagtgatatgttgtatctgtgacacatcttgactataaaacttgcccttgagtttattttatgagaacatcttatatcaagaacaggtagcataaaaagcagggaggaatttgtactcatttaatataattaaatcatgagggttccaaacagtgtactgatttctagaaatcctaaagaaccattgtgatatcagtgtataaagaacaaaaattctgatgacaaacttgtagtgtgaaaaacaaatttactggactacccactgtttatactcatttattttcttcctgatagtaagttgtaaaataaacaaacacttttttccatttacttatcatgtggtgccaattctcacttatcatatggtgccaattctcagatatgagtcatgagacatgtttcttaatgtttttttttttttttgaatcagaagtttttttttttgttttttttttgtttttttttttttttatactttaagttttagggtacatgtgcacattgtgcaggttagttacatatgtatacatgtgccatgctggtgcgctgcacccactaacttgtcatctagcattaggtatatctcccaatgctatccctcccccctccccccaccccacaacagtccccagagtgtgatattccccttcctgtgtccatgtgatctcattgttcagttcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattatggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtgtaaggtgtaaggaagggatccagtttcagcttcctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtaccagtaccatgctgttttggttactgtagccttgtagtacagtttgaagtcaggtagtgtaatgcctccagctttgttcttttggcttaggattgacttggtgatgcgggctcttttttggttccatatgaacttgaaagtagttttttccaattctgtgaagaaagtcattggtagcttgatggggatggcattgaatctgtaaatgaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatagaatcatgtcatctgcaaacagggacaatttgacttcctcttttcctaattggataccctttatttccttctcttgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagggttgttgaattttgtcaaaggctttttctgcatctattgagataatcatgtggtttttgtctttggctctgtttatatgctggattacatttattgatttgtgtatattgaaccagccttgcatcacagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcctccttgtacctctggtagaattcagctgtgaatccatctggtcctggactctttttggttggtaaactatcgattattgccacaatttcagctcctgttactggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcctttcaaaaaaccagctcctggattcattgattttttgaagggttttttgtgtctctatttccttcagttctgctctgattttacatatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttgggttggagagttctgtagatgtctattaggtccgcttggtgcagagctgagttcaattcctgggtatccttgttgactttctatctcgttgatctgtctaatgttgacagtggggtgttaaagtctcccattattaatgcgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttcattggagcatttagtccatttacatttaaagttaatattgttatgtgtgcatttgatcctgtcattatgatgttagctggtgattttgctcgttagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctgtaaaggattttatttctccttcacctatgaagcttagtttggctggatatgaaattctgggttgaaaattcttttctttaagaatgttgaatattggcccccactctcttctggcttgtagggtttctgatgagagatccgctgttagtctgatgggcttccctttgagggtaacccgacctttctctctggctgcctttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagttttttccaacttggttccattctccccatcactttcaggtacaccaatcagacgtagatttggtcttttcacatagtcccatatttcttggaggctttgctcatttctttttattcgtttttctctaaacttcccttctcgcttcatttcattcatttcatcttccatcgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagagacgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccgtgtgaggtgtcagggtgctcctgctggggggtgcctcccagttaggctgctcgggggtcaggggtcaggaacccacttgaggaggcagtctgccggttctcagatctccagctgcgtgctgggagagccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttggagcttcccgctgctttgtttacctgatcaagcctgggcaatggtgggcgcccctcccccagcctcgctgccgccttgcagtttgatctcagactgctgtgctagcaatcagcgagattccgtgggcgtaggaccctccgagccaggtgtgggatataatctcgtggtgcgccgttttttaagtcagtcagaaaagcgcagtattcgggtgggagtgacccgattttccaggtgcgtccgtcacccctttctttgactcggaaagggaactccctgaccccttgcgcttcccaggtgaggcaatgcctcgccctgcttcggctcgcacacggtgcgtgcacccactggcctgcgcccactgtctggcactccctagtgagatgaacccggtacctcagatggaaatgcagaaatcacccgtcttctgcgttgctcatgctgggagctgtagaccggagctgttcctattcggccatcttggctcctccgtgaatccgtttcttaatgttttacactattctttgtggtaaagtgtggtttccattttaaattacatctctcagaataataggcagctctgaaaggggttgtagagaccatctaacagtctgatttgtagatgaggaacctgaggtctagagtgttgaaaacccaagtcccacagctgattaccggaagagcttagcctggcacccaacactcctgatgcctaattcaggtaggttttcatccaaagtccaagccacatatattaaaattatactactatttggatttatgacatagtagtacaaataatcatatttgtgatactccaacttgagtagaactcataggaaatcttgtctctgaagtcggacttcatgtgggtatattaagccaccagacttttaattattctaactctccaatattacctcatctgcaaataaacaataggtttccaaaggtctactggtaaaatttctcctctttattggaaataaataggcagttgttacctatgcaataattatttggccttacaatatcatagtaaagataaagactttagaaaacagggaaattttaagacctgagcatgaaagaaattgaagacggtgatattaatgatgttaaattagctgttacatattttatcaacattgtgagcacttgcatttagttaaaatttcagtcttatcccgtgatacctgtcctggtttgttatggcataaaggaacattcagtttaaattttttcgacttgtatttttaatgatgtaagataggatgcgtacaggaataaatctgtagcctaattttacgtgagatatttctcagatattgatctagagtatcacatgtaaatttagagacttatctataatccctttccttttatgttttccacagacaacttatatatatgtgtttttgtttttgtgtgtgttctgattttagatttaccttttccaggtgtacttctctgaagtaagatgatttgtcaaaaattctgtgtggttttgttacattggggtaagttatttgctcatttgctgttttaatgcccttaaacatggtagagattttgcctttagagatgctgttttatttattagctaacagaatttcctatttctagttaggaattctcatacatgcttatgattaaaaatgcaaaccatagtataggtgtatcagtgtgaaaacgaaaacccttcccaacctcctaaagacaacctgatggtgtatccttccagaatcctctctctctctcacacacacacacacacagactcacacacacagactcacacacacacatacacagacacactcatatctatagctgcaaaaatagcactggtctgtacatgttgttctggatgtttatttttccatttaacaggtttccaatttatcatgatggctttttacctttatcagtatttaccgggatacttattagtttaatggttgcatgacaatgcactgtatgaatatatataaaattattagtctatttgaccaattcctgattgatagacatttctttttctgtaacaaataatactgcattgaaacttcatgtgtctttgtatatttggaaaaatatttctgtagattaattcttttttttttttttttttttgagacgcagtcttgctctgccgccagactggagtgcagtggcatgatctcagcccactgcaacctctgcctcctggattcaagcaattctcctgcctcagcctctcgagtagctgggactacaggcacgcgccaccatgcccagataatttttgtatttttagtagagacggggtttcactgcgttggccagatggtctcaatctcttgacctcgtgatctgcccgcctcggcctcccaaagtgctgggattacaggcgtgagccaccgtgcccagccgatacattgccaataacttttgagcatactgttctcacgtgtttcttaccacattctggtgacattctgatttccttaaaccaaatcatctaagttagattgtgttccaagtttttgaaattaaagttagagtatctttaacaaaacttatgtgatttggcaattgtttatctagctttctttaacaaaacttatgttgtggcaactttatctggcagctgttacctgtgtgtcaactgattctgagcatctccttggctaccccaatctaaaggggctcttctaagcttccctataggtcttccttgtggtacatacttctctttcattgcagccatctgtatatttccagaaaataacctagatagctccaccattacagatttccaaaaaattatgccacaagggactatcaaagagaaataactcattctctttttatattctctaattttattagatatatttaagggaactgttcattctcttttataattctctattaattttcgttagactctagtgttttacattgactttctggaaggtttctggtttgatcaagtttttgaatcaaaagaattcctgggatattgttacctgataagatatgccttcagatgaaaattctagaccatctttagagtttaggattcatttggagggaaagaaatatcatttgcaaagttgcatgtggataaaatagactcatcttttaatttaactgcatcaatagttgctatgtttttaaagttcatcattacattttacatttaaatacttctgtgaggattttaggctaattcatttcaagcaactgaatcctctatgtagacctagaatatataatgctgtaaattagtaatattacatattcttggttttgtaaacctcctccctcaaaaaactattctgttttctttgaggtgttctgattttagaaacatgttagaaggagtgaagtccaaaggaacataattgtaatatggatttacttttggtaatgttgtgatacctaattgttatcagtatggccatagtcacatttgtcacattaatcactttggcctcaatttttgcatctatacctatttatattaatttatatctatagaaatctttagaaaccaaactattaacagtcattacctatgtattgtttgaatattttcactgataattgcttttgtaatgaaaaaatacatttgtgaattgattaaaaattttattttcttacatttttaaaaagcctttattttttagagcagttttaggttcacagcaaaattgagaggaaggtacagagattttccgtagactccctgccccacacatttataaccccccattatcaactatcccccctcagagtggtacatttgtcacaattgatgaacccatactgacatatcattgtcactcaaagtccatagtttacattatggttcactcttggtgttgtatattgtatgaatgttgactgatgtatgtatagtgacctttatctgcagctttagaaacatacagaagaatttcactgccctacccatcctttgtggccttcctattcctccctccttcttacctaactcctgggaactgccgatctttttactgtttccatagttgtgcgttttatagaatgtcataatgtcatatagttggaataacatagtatatagtcttttcatactggtttctttcccttagtaatatgcatttatgtttcctccatgtcttttttttcctctttaaatttttatttttttagattcagaggttacaagtatggttttgttacatggatatgttgcgtagtatgtacatcacctgaatagtgaactttgtgtacaatactacttataagtgagaacatgtggtattggattttctgtttctgagttatttcacttagaataatggcctttagctccatccacgttgttgcaaagtacatgcttttattcttttttatggctgcatagtattccatggtgtgtgagtgtgtgtgtgtgtgtgtgtgtgtgcatgtgcatgtgtgtgaatatgccactttttttaatgcagtcattcattgagggacacttaggttgattccatgactttgctattgtgaatagtgctgtgacaaacatatgaccgcaggtgtctttttgttacaatgatttcttttcctttgagtagatacttagtagtgggattgctggattgaatgatagttctacttttagttctttgagaaatctacacattgttttccatagaggttgtacaaatttacattgccaccaacagtgaataagcatttccttttctctgcatcctcaccaacatctattattttttgactttttaataatggccattcttactggtataagatggtatctcattgtagttttaatttgcatttttctaatgattagtgatattgggcatttttttcatgttcattggctgcttgtatgtcttcttttgagaaatgtcttcatttcttttgccttctttttaatgggattatttgtttttttcttgttgagttgtttgagttccttctaaattctggatattagtcctttgttggatgcatagttctggaagagtgctggaacctctgtatcttttcgtgacttgatgtctcatttctttttagccctgaataatatttaattgtctggatgtaccacaatttacccattcacctactgatgaacatcatgtttacttctatttccttacattattacatttgccaaactcttcaaaattctcatttcatacaaatccatacaagattctcagaattcgtattctgcattagtgtctatataagccaacacaattgttgcatcatttgggtaacttactgaaaaaacaattatggagaattattttattttcaaacaaatatttaaaaataagtttggctgggtgcagtggctcatgcctgtaatcccagcactttgggagaccaaggtgggcggatcacctgaggtcaggagttcgagaccagcctggccaacatggcaaaaccccgtctctactaaaagtacaaaaattaaccgggtgtggtgggaggtgcctgtaatcccagctactcaggaggctgaggcaggagaattgcttgaacccgggaagcagaggttgcagtgagtcgagatcatgccactgcactccagcctgagcaacaagagcgaaattccatcttaaaaaaaaaaaaaaaaaaaaaaaaaaaagacaaggtttaacttttgcagatcttttggtacaggattatataattgttcttaatttttatatttaaacagtgataatttaatcagcagtgggcatttcccataagaagtctattcttttgcatcattttttgtgtaatgtgctaagggcatgtcttatatgatgatgttttgtatttggaggatcatgggaaaattcaggagatcatcaagccatcatcatgttgaagacaaattctttctaaaagtgctcagcgaaagcagtgttaatattttggtgttactctcttaaatacatattaaaatagcactttaatgtttgtttatataattgcacatccagatatttatttatcatttatactggatattatatttatcatttataatggaagctagaataatatgctttagaaaggaaaaataaaatattcagtgtttgtttccttttattaaaacataaatataaaatgtcagcttaaagagaaaacatgaagtgtgagtcttcaaaaagaaaagagatgtcagaaagtggagtaatttctacaaatgaatgcatcctcttgaatgtaacacattgtacaatggaagcacaaagttattcattagacactcactgaggacttagaaagttaaataattattgagcactacatggtttaatctcagatactttctattcatgtcttagtcaaaatgattacttttttctatgtgtctttttaatatcctaacagaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaataggtaagcattagctatgttttaaatgtattgaacaatgttttttaattctttgatacctgtatgaaatagatgtcttatggctatgattttaacatacataatcatttttatatggataataaaattaggattcattatgtgaacaaactaataaataatttccaaattatcttgtatcccataaaaatataatgagggaattattttacttttaagtacattccttgtagtcttctaaatttgctttgaaatagaaaaacacaccttatttttgttaaatgtataaaatatcaaatgactgataatattgttgaattggttaaattttaaaatattcatgaataataataattcttcaggcaaggaatatctctgaaagaatatacgttttaaagatgggtttttcagaaagaatagctaatggatgctgggcttaacacctaggtgatgtgatgatctgtgtaacaaactgctatggtacatgtttacctatttaactaacctgcacatcctgcacatgtacccctgaactaaaaataaaagttggaaaaacaaaaaaagaaaagaaaaaaattctttttttttgtttaagtataatgcatactgattgtagctagtgtagttaaaaattctgcatctggaaatataaacaacaaaattatcccaagtcttttggaaaagctaggaagagtggagtcaattgactcatccatgtagagagacctccagtatgaaaatacaggcatatcttttcctcccttaaaagcgtgatgattgggttttcacatgtatgagtgagatgtgcctccctcagaccttgttatgatgttggcacattacctgtctaatgttaaaaaaaaaaaaaaaaggctgggcacagtggcttaactgcctgcaatcctagcatttaggaggcctaggcgggcggatcacttgagctcaggagttagagaccagcctgggcaacataatgaaaccccatctctaccaaaaaaaaaaaaaaaaaaaaaaaaaaaaattaactgggcatggtggtgcatgcctctagtcccatctacttaggagactgaggtgggaagattgcttgagagatggaggctgcagtgagccatgatcacatgatcatgccactgcactccagcctgggtgacagagtgacaccccatctcaaaaaaaaaaaaaaaaaaggaaagaaaaagaaaagtgagaactgagctaggtgagttttgagctcttttgtcctatttaagtggtttgaaattaaagaaaatttgagaagcaataattgaatttaattctattactttagaaaaaaggaaactgagggccagagggactaagtgatgggcaaacgcatgccactagttaaagcttgttctttttctctcagaataggcaatggaagttgtatcagaacactggtaaatttgatttagctcttctctttcactgagttgttcagatggtttttgagatttcatgtagttgtttttttttttttttttttttttttttaaattcagatgcaaactggaacatacagtgctggctaaaaggagacttaaaattattcatctgttatgtggagtcattatttaagaatctattcaggaattataactataaggtccatcttttatatgttctgtaagtaccaaataattaatttggcatttctaatacacagtttttttaaaagagctttcatatacggaagtagattataaacctcttgcatccctacatttcctattatatgttttattttttaatatagcattctgctctgttaggtttcctcttttctcctcctgctaattgaggtagcaagacagtcaggtttagggtcacgattgtcaggtccatgagtataccaaatgttcagttcaagttcaggttctagctcacactgaggtccgaagggagtgggtggatgggcaatagctgaacgaacactctgggggccttaaacaggtgaaacgtagttttattcagcagctctctatcagcagcttactcaaactaggtctctcattagcagctctcttagcagcagctttctctcactgtctgctctgttttgactgcttgggccagctgctcctatgcacagctgcacggctggctctctcttgccttcagggtcagcagcttaactctttctctctctgggcatgaacatgaaccatgctgtgccatgttgtgccatgctgagccatgccctggctcccctcgtcagagcaagactgacagctctggtactctctctctgggtacaagagcgcctgtacaagaacatctgtagagtgtcagcagggcaattataccttttacagacaacagtggcatatggccaagggatggccttcccatgttatggctacatggctgtgataacagatggagttatatgcctgcgcactactcgctgagtcatgcaggcctggacatctgccttggcctgattcttgaccgaagcacatccatgtaccttacaaagatattgcaggtataggtgggcatgtagtctgaaagaagagtgaactcagttcaggagtgctagatatttgagtggaaaaggaaaaaaggtgcgttttatatttctttttcagatgatttttcgtattcgatctctttataaacttaaaaatatgggtggctaatatttgtgctagaaagagaacaaagatattgttttcaaatagccatatacttataactcaaacagcgaatatgtcattaagttttctaattactctagtgatgatatacaccatttttatgtcaattttaactctttaaaattctttctcattaattcttctatttgatgcttaaagtctcgcttccttcagttctgcagttattgagataataccgttgaggagcaatgtgctagaaactgtccctatacaaatgaatagagacagaaagtaaagcggggctgagaggagggggaattggggagttactgtttaatggatataaagtttcaatttgggaaaatgaaaaatgttctggagttggggagtggtgatggttgcataataacgtgaatgtatttcatgtcattgcactgtacacttaaaatggttgaaatgttaaattttatatacattttattacagtaaaaatttaaaaagaaacttaaagacatgtaaaaaaggatgaatggttacgatcactgtcctttaggtgctcaaaggctagcagttgggacctgtatgtacagagtttcagtttaagtggttaccgatatgtatttggtaggtacataatgtcatgggagcccatcattgttgtgagatcttagatgggggttatctagttaagctggtgagagaagagaggaggaaaggtttcctaaggaagtagatagctgagttgagtcattagagataaataagagctaatgagaaaatatgtgggcagtatagtgttgggaagagatcagtatcacctggaaccttgttagaaatttaaatttgcatgctaaatgacgagttaatggttgcagcacaccaacatggcacatgtatacatatgtaacaaacctgcacgttgtgcacatgtaccctaaaacttaaagtataataataataaaaaaaatttaaatttgctagctcacccctgtgaataaaaaattagggggggtggagctcattaatatatgttttgccaagtcctttgggtgattctgatggaactcaagtttgaaaattcctgctgtagaggttaatatgacagattttagagtcagactacctggctgtaccacttactaaatgcactcacaaagcacttgctatgtttaacagttgttctacctctagaaattaacacaatggaaatatttacacaatgtttaaaaattatttgttgaatgaatacatattgccaaaatgctttctaaaatattttccaatttaccctccagaaatgtcttaatgagccaaaaagttaataaaaaaataatattgtctgaaggtgtgagtagtgagtagtcaacggtcagatatagcaggaagatataataaggtctgaatgatatgtacggatttggcagtgtgaaagtaatgggtctttaggcagagctcattcgggggagcggaaggagaggttgccagaacaaagggaaacttgaagaaaggacccggaagagctgatctttatgctagttcctcattcagttgatggggggacactgcagagctggaattcatatatccaaggcatactatggctggtgctgagaatatgaaaaaaacctggttactgggaccaactgctgctgcccaggtgaggaacctttggctggagtgatatttcaagaatggtaggcaaaacaggaaggatcaactcccttgtcactccattattctagtctctttctagctcccccacaggtagaatttaacaagaatttaggtagcagaggagaactatggtttgcagagttccagccccagcatggtgaaacagagcatagggtgcatttgaagatggcagtcaatagcttaaccaccagcaaaattcacttcattggctcattggctacttagaacattcacacacacctttctacgcatacctacctttccctacaacttccttataacttcatgctttcacttaattaagtgcaactatactttaaaaaaaaaatcaaaaagatcctttatttcatgtgtatgtagtatcataattcatcaaaataatttataatagttaactgcccctcaaatattgttttataaatgatgccttctgaagttaaacataatgtagattcattttttaaaaattgtctgtttagaacatactaaacaaatgataagttaaaaaaaaatataattctctcctgtgaagtcttctaagaaaatcatggcaagttcctgataagataaaaaccattccatcattaaaggggattaaaaagaggcataaataaatttgaataggaacatctgtttgctgagttttgtcattgtgtacaaatgaaactctagagttaaaattatattctgatttccttctataagcaagaaattccttaatagaagctcagaaatgacctcagtgccttggtgaaacatacttcttcatctgcggacactcagtgctcccatctctatcagatctgctgtgttacctctgttaacattcccaggcatctccaggaagacgggagatgtcatcctctccaagatggctctaccaaaccaaggctttcctggcaccaacaacgttctttctaaagccctacacttcacagaggaggcaaagcccgacgaagcaccatttctgccacggtgtccaccttaagcttccaactgccactgttgtgaggaggagccatcacagattgccatagccacagagtcttcctgaccctgtggagccactgctctcaggcactgtccagctgacgtctggtgtagccaattattttccccaaaggtccatgtctgcctgacccatggcactccacgagttgtggtgggtctgatgagctagtttctgtcatacctagacaaagaagatggtttaaaaccaattcatgctcttcattataaatccagatctgatttgggtccccatgctcacaagtcttaagcactagtaggcctcctttccaacttgggcagccctgagccaccagacatttgttggtctggaggtgatagagccttccaagttgaaggactttggggcattttggccctctactgataaaagtgggttgctgggatttgtcatgggtcccagatatctgcatctttgggtaaatattacccaaataccattcaaatgatttgcatcctaacttctttctcaattcaacatgctcactgatggttccaaagcttttcctctccagattaagtcttaaggaaaaatactgcgcctttattcatccagccagacatgtgccagctgcaaaaagttgtgttcatggcatcccggccttcaggagatccatatggtcccctttttttggaaaatgtgtcctactgtagagcaaggcatgatgaagaacttacctccacacacccagatctgaaatgttatttccaagttttctcctctccagatatccatgccagtatcatactgtccaagttcctggaaatactgtctgttcctggcaaacaatcctccagccattatcggtgactttgttggtgctgtggctttttctgctcatcctagctcagaaaggggaacaagctcctatttgaagtgcagccctcagttgaatcctccacggacaacagaggatgagctgtaggctagcgtgttggcactaatgatatcaatcactgagaacatcatggtctgctagtccacacagatgacagccagcaagggctgctgccacatcacattcacttcaattggctgtctaggaacacaaggacttctgttgtgtggactgctacactcattcttccttgaatcaatccctcacactttatgtttcttataccttaatttttccaaggaggtatttttggacatattcatctcgtcctcctttcaagtcatcaaggtcgctaacaacatccataaagatgatttcatgaagcaggtttgctggcatgcaatttgtgacaatgtgcagcatctggagacagggcagaaaaagcttcattgtggaaacagataacaattatgtaagcaactggcaggtcaggaggtaggactttacatgctgtattctttgtccctggcacatctctgtggtagcctgcagttactgataagcatattaaaagcacatttctgatagcccgtctctcaactcctgagcacgttaattaaaaatcatgcctagttcagaagacaatttcaagtggcctttttctggatcttcaatatgaccatcacatcatcaattttgtttgcttcgaactgtggctctagtaatagacttggaccttgagtgaatcaggaatagaattgttttggaaatggtccatggggtccaggccccttgagcacattctttttttttttaatatagtttaagttctgggatacacgtgcagaaagtgcaggtttgttacataggtatgcgtgtgccatggtggtttgctgcacccatcaacccgtcatctacattaggtatttctcctaatgctatccctcctctagcctcccacccccctacaggccccagtgtgtgatgttcccctccctgtgtccatgtgttctcattgttcaactcccacttatgagtgagaacgtagtgtttgtttttcggttcctgtgttagtctgctgagaatgatggttttcagctttatccatgtccttgcaaaggacatgaacttatccttttttatggctgcatagtattccatgatgtgtatgtgccacattttccttatccagtccatcactgaggggtatgtgggttggttccaagtctttgctattatgaatagtggatgagcacattcttaagtggctgagtcacttcaccgaagttgaaatgaacaaaaaccaaaactgcacaggtcacagatgtaaaaatgtacccataacagaaatattgaactgtgacacttcccataatagacttagcataactaatgggccattttcaatttctgcagcactggcagtggccttccaggactcaggctgtggcatctttcctcctgccacagcccctgtctgagccacaggagctgcccagggggtgaggagtggtgggctacactttgaacaaaaggagacagtcttattctctctcccaaatgggatgatgctatgtcacagttgtcattatgttttctgtgcaacatgtacagtattgctctctgggcagtattaattgctcctcacattcaatcactgtttcacctgaatgaatattgtggaagctaaatataaaattgtaaatttaataattccaggaatccttatataaaataatagggggaaggaaaagattgagaagaaattagttaatatatagaaacacacacacacacaagcatactgtaagggaggaaatatgcacagctgccactgctcttctttctgtattgattaccaggctgtagttaatatttattactagtgttagaccactggactaattctttaagtcacccagaggaggaacccagatatagtgccactgccatcatatctggacattgaatgtccctgtggtcatcatttccacatggaggtcacctgatgccacgactgatgaacctacaagcccctgcatctttgtgcaatcgtcatgagggctagtgtctcagatgtagttatctagttggtgagaaggtgctctagctgccagtgtttcagccttgtatgatggtagattcttcagtcagatattgggcaaccagcaagtagacaaatgtccttaacaaaagtgactgagttataaatctctagaggcctgagaagcctggctggggttggaaagtggaggtggaagactaatggataatgaatgtcccagggtggataattaaaggatgaaatcatgagtttgtttctagtctatagaaagtgacccagcagggagagaaaagttgataatcgaaggggagccattgaagatattttattgagagtgaataatggaataggccaattccatgaaaagagcacagggttggtcttaaagaaggtttacctcaacttctgagtattgagagaagaaaggaagccctatggtggatgaagatatatttgaagctcagggcagtttcctgctttattgagcaaaataggctttagctcagagaaaagtattcctttgcatagtagtaccttcttgcaatgacctaaatgctttggatgtgattaaaaattctcacttgggtgcctactctagacaatttctgatcttatcagcaggttaaggcaaaatgctcagttttaaagccccgtgaatatgtgtaaggtcttaaattctattatgtatatattataattatgatgaggtatttttctgaaaaagataagtatatgtgtaatatatagatatatataatttcagagcattataaatttgaatagttacttagttatagctgagaattttagcttcagtttagtcagccaaacagtcattggtctattcttctaaacaataggacccagaagaatgagaaaattaggtaaattaggtagattttcaaactttcttacaagatgatttttaatttggtcttcttttacttggaacctaggtttctaaaaatattagcacagtaaaacctgtcataatttcaaggaatttgagaaacagtctcccatttttttcctgccacattatatacctctatgatttggttaatatgttcattgcaccaactatcacatgctgtttctgcctttaattgtatttttgtttggctcttaaggcaatgtatctccaaacaattaaataggactctaattcaatgggtagagctggtcaatataggaagagctggtcaatataaccaatgagaactccatggaagagaaaatccataatggtgattactatagaaaagctttgaatcagactcacctattttggacatcagagaattcacaagagaaattttcaaatgcttccatgtgtaaaaaagtatattttaaaagggataaaatctaatgtttgtaagggatttaaaaccatataaatatgtcccttaagggaaagctttgtttgggctcagatattaatgtttgtcagagagtctgaaggacagatactctagaaatgtaatattttgaaactgctctgagattttctcttagatctaggaaggaaattctctttctttattaggtgcctactgtgtgttccaggcacggagctgagcatggggaacaaggttctacaacacagactcagcccttgccctcctggagctaacattctgtggtaaaaacagaagacataacagcaaagtttggaaaggctgtgctgtaataaatacagtgccttgtggaaacaagtactagggatatccagcccaggtgaagagggggcagaggagaatgagccagagagtgaagaacatttgcaaaggcccagaggcacagataccacatggcaggacttgaaaagttgagtgtggtgggactgggaagctggggaatgaagagaaatcaggatggagggatacacaagggtcagattatgaagggccctccaggtcatgcttggagtttgggcttctataactactaacacctactttactttgttttcacaattactcctgccagcattcttgatgatttcagcatccatgtgattaatcttcagtttcttgaatgcttattttcaatattcttgtattttcacaccactttgttcaccccttgtcatggacatgctcgagactttgtcatcaccaataagcatgctttttctataatctccatgtcaagaatcctgctctttgaccatctccccttgcacccttcatgttagtttattccctctactactcaacttcaggaataattctccatggttcttggctcccccttctgggtgccaggttctggcctgagtaaccctctcttcttcatgaaaagcagcccatatgcgcatctaagttgttttcacagcctgctttcctaccagcacaatttttaatggttgaaaggctttttttttttttccattttgttctgtctctgtctctttctgtctctatattagcactatttctgctaatacacttctctcacaaaactacctggacctccagtggatctctctggtgttcactccattagatatgataaaagcctgcaaatctcctagagatcttttctctgtcttctctttgatctttgctcagaaggcatttcttaattttaacagtgtttgctatctggagaggctagacacttcaagactatgaagtcctctttccttttgtttaagggccctttcttcaatgtatatctctcctcttacagcaagaagaaaccaagagacatccgcaacacttgctggaaatctccttaaatatatcattcagttcaataggcacattctatactttccacataactacagatggtaatgttaatgagctctctgctactacacaagaaggaccactgttctccagtttccaataaattatctctcacttccttttgtgccctcactggcagagtctttgaagtccgccagatttctactaacagcctgttcgaggcaatttaggttttcttcaccatgcttctccaaatccttctagcctctgtctgtccgctggttccaaagccactcacacattttcaggttttcattatggcagcaccccactttcaagttccagtatctgcattagtgatctaatgtcatataataaattaacccaaaacttagtggcttaaaacagtaatcatttattatctcacaatttctgtttttaaggaattcagctgcagcttagtgtggggtggaatgggaaaggagtatctgcttcagggtctcttacaaatactgcactgaaggtgtcagccaccaggactgcagtcatttcaaggttcaacttcaggaggagctagttttgagataaattcttggggttccaagttcttcatgggatgttggactgagggcctcagttcctccctggctatcggctggagacctccttcagttccttgttatgtggatctccccataggacagcctgcaccattgcagctggctttcctgagagtgagccagagagactcactgatgatcttgctttttattttcactgagacaacagaagcaggtggagtttctctaatgattgcttttctcacccaaatctaccaggctgcctgtatcagtgcccatgcacttttcctctcttcttttattgtgaataaattctttgagttctgatctaaggcaaaccctttgttacgtgttctgagtcccatctcttattgtcaactcaaggactttcttgccattatcctctattttctgcaccatcatgtttctctctcagctaatagacacgatataataactcccatttaaaaaaataaattttctctgttacacatttctgtcaagtaaccaccccatttcactacttcttttaaagaaaacaaagttttgaattgtatgaatacattatatcttcaaaagttaataaaaaagtcaacaagtgactctggccacgagggaataagagggtctggattactctcctgtgataaacaactagaaaactggaaaaaatgtaggaaataattattttcagacattggacaaagacagacagaactgtgattcctaagagaaggaaacaaaatgagtactcctagtacttaggctttctgaactgtagaaaattcccagaacatggcacagagctgaggaactcaagctgagcccaacaatcttgcagagataagagttcagagagggtaaggggctcaagttcatggggcagagtactttgaaagcaggagcatacagaaaaacttacagtggggccactttaactctttggctgaatatcaatctggccacaatgttgggtaagaaaaacttctagtaagagaacagttatcagggagctataagctaaacaattcacagaattcatagaggtctgggaatcgttcaagttcccacaaacgagattggagagaccttaatgggtatcagtgacatttcataggaactccagaagagctatactttaaaggtggggccaaattagccttagagtcaaggctacactatactattccccaaaatgcttaaaggatgccctaaaagattcaaattagtgctcaagtaacttaactgactttcagaacaaaatccaacactcttcaaggcaaaataaaacaatgtaatattcaaaaatgaaataatcacagtgtctggcagccagtaaacacatgctagatatatgaaaagataggaaaatgtgacccataaccaagagaaaaagaaaaaatagtcaatagaaacagacccggaaatgacagagatgatagaattggtagacaaagacagctatcattaatatgctctacatgttcaagaatgtaaaggaaaatatgaatataatgagacaggaaattgaagatgtaaaaaagaacccagtgacatttttaaagatgcaaaatgcattttttgtaaacaaaaatgctaaatattaatttgggcatttagaataatgttattcaataaaatagtatttatggtgtgcagcccatagtgctaggctctgtaaggggtgcacttttcattctccttcccttctttcctttctatcaggatggactcatggattcttattttagtttgtgggctacaaaagttacatcatttattttattactgaaatcgtctttctttctagcagtataagatgtaccaggttgatcttatacttttcctgatataacactggaattagccatttctccaaggagccatcgttccttttgttgaagaatggtatttacaaaccagtgtctggaggatagttgttcgttgttattgtttctagccctctctgtgtgcagagctagttagtgcacacaatatatacacaatgtgtgtacataatatacacaaatctatatatctatatatctctgtatgtacatgtattaaagggtgtgtgttcatactaatatgtcccattctaggccaaaactgcacagtccgttctaaacttcttttctttctgttttgtaactttcttctccagcagtgagaaagaaacctggcttccctttcccacagtgtgttacttatttgctcagtgctagaatacacacaaagcagttttagcattgctatcccatactgctgtgaaaaatgaaaacaagcgtactaactgaagtgcaatattgtttacactcattttgcctttactaaggctaatgggtacatggtcaaatattatgttccaaagttaaataggataggtcttccctctcccttcaggtggttatattattaacttggtagacattaagttctgtttgtttcagtttgcattcttctttttttcccactttctcttctctttgttgattttccatttatttggtgatatcttacatctgaagagtactttgcattttacaaaatgcttcttaaactttcctccttgataagatttatctaggtcagcactacttacttggcattcaataggtctgggtggaactagattgcttgcatttattcagaacatagattgcttagctctggaccttctgaattcctcatggggtctaggaatctattttttcacaagttctccaggtgatttttatgatgagtctagtctgggacaataactcagtctcaaattattttggattggcaagagaaaattttgaggtaatgtttttatagattaccaatctgaaatttaaaataagtgacttgattaaatgatttacaaaactaatactaaattttctaattccacttcattggtttgttcactattttgctgtcagtttacattacaatcagaaaattaggtggcaccaatttggtgttattcctgtaataatttagcatagaatttgcttggagaagctttaatatattcacattttctgggaagaaaaattggaccaaaagtcagaggacagaatgtgctttctttctaaaccatgtatggctaccaaaaatgaaattccaatactaaagaattatatctctaccttttgtgtaaaaatattaccaaaaaggcaaaaatggtaaagagacaaaattttaagttcatttgacaactgttttcatactattttcactttcaagtaaagtttatttacatgtagaggtattaaataaatagtggcactgagtttgtatatgtgtatgtatactggtaaggcataaaatattttgttgcatataaaattttcaagaattccagaaattcttaatgtttgcttgttttaagccaagtatatctcctgttacttttaaaatttgatgatccttttattctcatactttaaaattatcaaatttgttagagtatgttttgatattagtaaaaacagagttcttaacttcttatactgactttggcatgtaacaaggttggtggattccaggtttcacacaaacttgggaaactcctctcacaaatacaggaaatagctaatgtttttccttaaagaaaagaatcatttgaagtaattatataattctctaattttccatttataaaaatattgacatgattcaggttataattattttttagtcatggttactatggtctttattgatctctaaataaaatggtgatgataacagtgaaatttatcttgtgacaataaggcacgttgggtgtaatgaaatgaatattgaacatgatgcacaagacttcagttgagttccaggtctaccttctctccaaatctcagttttcttacctgtaaagtagatgatgttagttccctcaaagggtgctttgaaaaactggattagataatattactaaaggtgtttcatgtaaattgtaataatgaaatttgatgatatatttaatgtgctttctctatttttgtgtcctttgcccatcaaatacccaccagtagggagtacaaaatacttttggcttatacctggggagggagaattttcttttttcttaaagggccaaatagtaaacattttggggtttgtggaccatcctgtcttggtcacagctattcaactctgtgcttgcagaaaaacaattatagttagtatgtaaattgaattaatgttactacatttatgggcactgaaatttgaatttcatgtatcatgaaacagtcttttttttttttaattgaaaatgtaagtaaccattcttagctcacaggctgtacaaaaacaggcagatggctggatttggcctgtgggccagagtttgctgatcccaagcttagaacattttgaaattagttttagattgatgctgatagtgtcatgatggggttagctgttggcatggttacagaaagcttttttaaaaaccaacaaacaatgaattactataatgcatattttataatgtagatactatatagtcattattaaggatatatactctatatgatgttttgcatgtgtattacaattattaacaaaatgaaaaagagattgaataaatagaaaatacatcagtgaagggatgaggaaaccatagagttaatctgattttaaattcgcccttttttacaaatattcagtgtatttagaaaaggatggctttggcaagaccatctaaagtaagatgatgtgattctaacttttctttttgtcttaaaatatgactaaaattttctatcatttaaaatgttagcagagaatatatttgttgttttgtgctcaacttaggcaaatattcttgctttaaaattctgaagtttttcagccaaagcataataccttgcaagaatgtttccgacataaaacaccacaatttattcaatttgttcacagactttttgtaaaagcttttattttaatatttgaaaaacacctaaaaggtctggcttgatatttttaaaaattacattttgtttgctttgcttaaagatttagataaaatcgaaagtgctaaatcaggctacctctaattcaaaacaatattttatgggtggatagcattttacagttctcaaaaatacttttatgtgattattgtctttgatattcacacccttgtaaacatagatggttcggggattgtcttggttttattgattcaggaacctgaggctcacaaatataaacttacttgtccatgatcctatggctaataagcaaacagaagtacttgattttagatctcaatgttaatttagtgtgcttttgacactaatatcccctatacagttcccagtagattccttggcacattaaagccatgcaaatgttgtttcagggttgattttttttagtagtaaagtaataataaattctattacttgaaaatatatcataattcaaaacatttcatattagtggggtatgcagagaaagactagggtctatttttcatgttttttatatctggatgctcatatatatgctagtttattatagcttctaaagcaacacttttccatactgatttttaaattattacatttgttaattacagtgttttccctctacaaggactgcaagatttctgaaggcagtgatcatgcactatctccctatccccaggttctttgaaaaacagtgtggtttcgatatgaggtagcagatattaatggatagaatggggcagcacaggtgagatgggtagacagagacactgttactccacactcttctccccactgctcttattctatagtcacttcatttacaccaagacttagactccctaaaggatgaggcagatttataaaaaatctagtaagtaagaaataacaactgtctgttcttggttgcatgctattattttttatgccctgtatttggtaaccctacccagctaattataattttttttttaagattgacctacttatttgaaggtttaaaatgataggcaaggtattgcttacaaaaatttcctggattttctttctttttgtaaatagttttattgaggtatagttgatatataataagctgtacatatttaaattataaatttgacaaatattgatctgagaaatcactcataaaaccatcagtataataaagaaagtgaatatatcatcaattagaaaatttcttcctgctcctttgtaatcccaccctcatgctcctaccattggtacttcctcctcccaccccacctctgtccccagggaatggctgatctgatttctagcacatagcctactattactctagcattttttagaactttatataaatgcaatcatacagtactttgttgtgctttcatatacatgattatcttgagattcattaatgttgtttatatcagtatttcattcgttttgattgctgaatagcattccactaaatggttatattgcaatttgttcatccattcacctgttgataggcatttaaattgtttatagtttttgactgttacaaatgaagttgtcacaagtgttagaattgaaatatgttttcatgtctcttggataaatgcctgggcatggaatgggtacatcatgtggtaggtgtgtgtttaacaacttaagaaagtgccaaactgttttccaaaattgtatcattttacattcccatcagcagtgtaagagttccagttcctccacatcttcaccaatacttggtgtagtcagtctttttttaaaattttaaccattctagtatgtggatagtgatatctcattgtgattttagtttgtgtttcttgagtgactaatgatgttgagcatcctttcatatgcttatttgccataactatgatttatatggtgaagtgactgtgtaacattttgcctatctttttaactgggttgtttgtattattattatttagttttgagtattgtagataccttatgtatacaaatcttttatcagatagataattggcaaatatgttctctgtgtatggtttgtctttttgttatctttcatagtgcttctcagaaaacaacttttcaattttgataaagtctaatttatcagtttgttcttttatggatcatgctttttgtgtcatatataagaaatttttaattaacacaaggtcacaaaattttttacttatgttttcttctagaagtttcatagctttaggttttacatttagatttatgattcatttggaattaatttttgtatctgatgtgaggtatggattaaagttcttttcttttattgcatatagatattccattgttccagcacaatttatcagaaagattatcatttttccacagaatttcttttgtgcctttgtagaaaatcagttgtccatgtaagtgttagtctattctagactctattctggtccattcatttacttttttttgtttttacatgaatacttcattggcctgattattgcagctttataatacattttgaagttaggtattgttattcttcaaaatatgttcttcagtttcaaagttgttttggctattctagattctttgcatttccatatgaatttttagattcatcttgtcaatttgtgtaaaatagcctgttgagattgtgagtagcattgcattaaatctgtagataaatttgaggagagctggcatattaaccatattgagtcttctgacccataagcacagtacatctctcattttagttaggtcttaataatttccgtcaacagcatttcatagttttcaatgtgcagatcctaaacatcttttgtcaaatacattacaaagtatttctatttttgatgttattgtaaatgatattttaaaataatttctgtttcatcagttatccaatataaattcagtatcataaaattattcatatttccttattatccttttaatatctgtagactgtgtagcaatatcgtgctttcagtttttatattcttaatttgtgacttctgtggtttttcctggtcagtctgtgatatggtttggccatgttcccacctaaatctcatcttgtagttcccataatccccaagtgtcatgggaggaacccagtgggaggtaatcatgggggtggttacctccatgctgttcttcactattatggcggttacctccatgataatgagtgagttctcatgagagctgatggttttataaggggcttttccccacattcactctgtacttcttgctgccaccatgtttgcatgtccttccaccatgattctaagtttcctgaggcctcctcagccctgaggaactgtgaatcaattaaacctcttccctttataaattacccagtcttgggtatttcttcctagcagcataagaatggactaatacagtctggttaaagcttctttcatgttttaaaatcttttaaccagcttttggctttcttgatctttgtgtattatttttctgtattctatttcattatattctgatttgatatttatgatttctcatctgttttaaagtttggttgaatttgctcttttttttttttcctagtttgttaagacggaagctgaggtcattgatctgagacttttctttttttctcatataggcagttagtgcctatatttagtgttaaacacatttccctggaattattgctgtaagcaatatcctaccttaaagaatatgttgtattttaattttcatgtacttaaaaaatccttctaattttttttgatatgttttttgacccaggaattatttagttgtgttcagtttccaactatttagggcctttccaaatatctttctgttattgatttctgttattaatcctatttttgtgtgactggaatcctttaaaatttattgagacttgttttatggaccagaatatggtcttccttggtaaatgcttttgcaaagaatgtgcattctgctattgttgcatggagtgttcttgaaatgtctattaggtcaagtcagttgatgcgttgttcacgtttttatccttactaatttctgtctatttgttatatcaatggagaagaatgttacatcaatgatgaaatgaaattaatcaataattgtggattagtctatttctccttaaggttctctcaatcttttgcttcatgtattttgaaactctgttattgggttcataaatgttttggattgttatgttctcttggtaaattgatccctttttcattatgaaatgatcatctttatcccatggaatattcactgctttgaaatctactttctctgatgttaatataaccattacaactttcttttgactaatcttataatggtatatcttttcccgttcatttccttttatttgtgtttatagttaaaattgatttcttgtaggttgtttataattgggtctttttaatccagcatgataatctttgccttctaaatgggatgttaaggctgtttgcatttagtgtgaaaattgatatgtttaggtttaaatctttttatttcttttcttatcctattttattatttgtttccctttcctctttttatgccttctttttgattttttaaatgattctacttaatatcctttgttgcttattaattatattttcttgttttattattttagtggttgctttagcatttataatatttgtcttcaatttattatagtccaagagatagtatacctctaagtgatatcataccacttcgtgtaagaacattacaaatttctcccctcccaagcttggtactaatgccatacattttacttttacctacgttgtaaactccacaccacggatctattatttttgctttaaacaatcaataaatatttatcattttagttaaatttaatttctttgtgtgaaaccacatttctatctgctgtcatttttttttttttttttttgcctgatggattgcctttagcattttttatagtgcaagtctgatggtgacgaattatttttgctttggtatgtctgaaaaaaaaagcctttatttcatcattattttgaaagctgttttcgctgggtataggattttagaattgcagtttttcttttattttagtacttcacttttacgtcattatctttttgcttatgttattcctgatgattaacctgctgtaatctttatctttgtttttctaatgtagggtttttttttttcagataccctttaagctgggtgtcccaaatagtttacttcaattagtatttagtatcctgctttaaaagcctatccagtattttcatatctgttttaatatttagctcttatttttcaatataggcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccagtcacctctaatgtcagttcagcccataaatatgggtaagttatgcactaaaatgatgataataggtctaaacatcagtcatatataaaggttaaaaattgcttacaaaaatatttgctagcttatctcactttgcttaacactgtaatgatggtagatgtagtactgggggtattaagagtggcttctagaatgatttaacaatggtatgtatatctctgccattgtcacttaaattctgttttgaaaactgttttctttcaatcctggatctatgtaatggatgtatattgattggatatcactttttcacatctcagataactatttttgaaaatagtagcatgtttcttgcctgaatttattccttcaataaatatttcttagaggctcatgtttgtcagagactgctccaggagctggaaaaagagtgggacattagacatagttcccacctcagagagcagggacaaacaatagtaggcagagacaatgataaaagagtaaatgagtaatttactgtacaaacatgattacaaaaaacttcaaataatagacaacactctgttttctttgtgcaaagatcccccaaatctctttttatcaatttaaatatacaattacaaatgtgaataatacaggaaaatgttagcgctatgtatttaatttattaatttcatttaattatgtataatttagcagtttttctccacttatatttcctgaaacaattatatgcaaactctttatgtctgattttgcatcattggttttgacatcactagagctgcttttccaagtatctgatacaattttccatacaactcaagctttacttctttctaagttactcgagatatagcactttttgaaactgtgtatgacatcatattttaacatgaagactttcaaataatttgtcctgtagggatatagttgtgatctccacaacataattacaatggcatacaagcaattcaatcgtgaagttataccatagagaaaaaagttacaaaatctttattcaatatcattttcttttctttgaaaactaattctacctgatgattttttagtagcatttagagtcaacattgagtgcattgtttttcaaaatgaagtaggtaagggaaagtgctgtggaattttaaagaacttgaaagctttcttaattttgtctttatgcagagataattttggggaaaagtatttccttctatttgaatatatattataatatccccaaattatatgttccatgaaaaaaataaaactggtgtgatggagtgtcagggactattatttctactatgtagatcaaagaagatctcctttaggacatagcatttgagctgaatgaagaagagatatccatgcaaaaatccagagcaaaaggtgctccaagcaggaagaacaatattcacaaaatccctaagatacaatgaacttggtaatttgaggaacaaaacagaagacctttgtgctaggagtgaaagagatatgagagtattaagggatgaggtcagagttacctggtccagagcatattgtaggccagggtggagaagtaaagaactgttttggtttggatctgtttgtgagatggtgctgactggactgtctagtggatggagttgtagagtgtgaaggacagaggggtatcaaggataacctttaaatttagacctgagcatctaggtgaacagagacaccagatactgagatacggaaactcagggaagattaggtgtgtgtacagaaatcaagagctctattttggacacattgtatttgagatgtctattggaaacctaagagacgttgaataagaggttggacatatgagtctaaagtttaggggagatatatatatttgggagttgttagcgtatcaaggtttatagtattgtatgagatcacctatttagagttcaggaagagaaagactgaggggttatcagtaagaatgaaggagtaaaagagtatgttgttgtagaagccaagtgaaaaaaatatttcaagaaggagggaataagcatctatggagtgctgctgaaaggccgagtaaggtgaacaggaaattgacattgggtttatttttgtatttctaatattaatgcatattaatattgtcaacctaaaatgtatgacagataccaactctataaagcaaaaagttgatttgggagtagtaggggattgcagttctagacatgcatgctatggaatgactatgacacatccacaggggattggagtaaaggggaagcttgaaaagacatataggagacctccatgtaagctgttttgaacaaagattattggttacaagagcttgctgcaggggtggcattagctcattggtggagacagccgtagttaggcaagtgtctctgtgcaagcggcttttatggaatactgtggttttgaggaattctttacgttgttccaatgtaggcatacatatacataaggggactccttcatggcctcccaactccattgtgttagggtttcacactagtaactccagtttgatactgataacttttacagtatgcagataggaaatgtacaatagcttgtaatattgtaattttacttttctttggtatatattgttttctctttggtcatggaaacacagtaaatttcacctgctgtttccagacttttgtgtttagctgtctctgctttaaagtaactgaaatttataatacgtctcataaagtaaaacctcattgattttgactaaaagaggaaaattgtgaccaaattcttgaaaatatagaatgtgaaaattatcttatgctctttatttattgaaaataaaattcaaatcagtgtttcaatttaatgataatttctatatatatgaataattcctgttaattgtaaaaaccttgctaatatagagatgaacaaacaagaaaatgcatcgattttctatcactttggcgatctttatattttaactatatcaggaatccaagtataaatgtgtgttaaactttcaaaatttaaacattaaacatttttaatattctgagaaacttcatccctacttctgatgacaagccagggactgctgatgctgcatttattgcatgggaatatttatgctgtcagttatttgagtaggtttgtctagattatagtgatctaaaattaatagacaagctgaattttgggtagttttgtgtatttccaaatagtgttctgcaaaatgcttttttcctttttaaccactaaaataattgaagtgggtgaggttcaggggagacttcagataagttttaggatgctgggtttaataaagttaagtgggattcttacaaggggaaatcacatttagcaaaataatctcatttactgattcatagtctttaccacttaaggggagggtaatgaatatacatggattgctatgataaggtacaaggacgagacccagtattcaagcttgtttcggttctataattagtccttggataaagtcaccttttaagtacttgaaaggcaagatatgatgaaaatttatcttgactttattttattcagctataattgtcatgaaaattacttgacttaaaagtattctcttttttttccttaagtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagtaagtatattttagtaagtaaaaggaaaagttgagaagtaaataaagaccctcttaagtcccatagcaattaccctctgcatactaaatatatacatttcttctaaagcagaatgaattataattcaacatttcatattatatatcatatatagatagatatacgtatgtatatatatggctataggaaatctagttacagaaacttgaattcataattacaattattttccaccaacagaccactgatttcatcttttttttaattgctcaatctatttgaatgtttttctgaatgtggcaacagaaagatttttgcttggctaatcattagtcgagcttctgaatcttctgctagcccgatctgtgcacattcctgtaaaatccagttttagcaaagaactctgctaggtcattttagcaggaacacccccaccctggatatctgatgaatatttgatcagatttctcatcctccaccattccccaaatgatgtttgatcaccatggcctgtcttcagcaagaattctgttaggtcagtttagccagaatccctcttaccatgatgtttttgcttagtaattttctatctactccctccttcttggctataaattccctgttgtccatgctgtgtttggacttagcccacataccccgacccaccacaagaccccattgcagtgctccatatacctattgtgatgattccaaataaagtcttccttacttcctttctctttttctttaacagttcgttccgtaagtatttattgaacacctgctacatgcctggaactgttctgcttgcatcaggatacactgagatagcaggacaggataagaggaatctgggggtgctggtagggaatggaaggttgcaataataaatggaggttggggagggtgacatttgagcaaggatgtgaaggagatggtaatgtagatatctgggtagttgggttctaaacagggagaacagcagtgcaaaggatggtgtggctgagggcagtgaaggtgacagcagtagtggttgaattcagaggccagcaggggaagagaatgtggagctcaatgaaaggcctcttgggccatgtgaatactttggcactttactttgtgaaactaagtttcatataatttagaagtaaaaatcagtctttttagaactggcaaaaaaatttaaaacattttattttcacaaagagaatgatgggaatcctcagtgtcacatatggagaaaacagagttaaggcttctgtgggtttcagctttcttatctgtaaactggagataatttgtgaacttgaggattttaaataggagttattaatatctgatgttgttttatgcattcctgatgcttttcataatttttagtctgtgacatgctccccttaccccaagagcagtcattagagccagagaatttattaactttggagtacatttttgggaagctgaattttgatctcctaggctcaagtgatcctcctgcctcttttttttttttttttttttaagagatgaggtatcactatgttgctcaggctggtcttgaactcctgggctcaagtggtctacccacttcggtctcccaaagtgttgggattacaggcatgagccaccatgcctgaccaggctcaggttcttaagacttttcatgctcttctgtacagggacacttgtagttctttgtctacccctgcacagcattttctaccaggtgtgtgttataggtgtcagtagtggcttaaagcttcccacagattttagctgcatttcttaaaattctaaaggtcatatattcatcatgattcaattaacagtatttgttaattatcattatgattttttcttggacccatgggctatttaaaattttattgactaatgtgcaaactttttttttggttattgatgtttgttttaattccgctgtggccagataactactgtgtaagatattaattctttgaaatttgatgagattagcttatcctcacttttagtaaaggttccacatcaacttgatgttctgatgttttaatataatatttaacaggctgacaagattgtctcagctacatccctgctagtagacagtatacttcctgggtcttcgtatgaggttcaggtgaggggcaagagactggatggcccaggaatctggagtgactggagtactcctcgtgtctttaccacacaaggtaggttatgtaatagccacttctactgggagggaaatatatttcctgaacttgcctttgtatagtataagcatcttacattttgaggccttaaaatgaaaggaggaacacagtatcaacttccttgtttaaactttgaacaggccaatttgtgaattaaaattctgtcagagcctctaggcttgtgtgtttctattgcagtatattgtaggatcacttttcctattaaaaagaaaaaattaatataacagctccaaattaacaaactcagaaagccatttgtattgataattccttaatttacattttaaaaccaagcatatttatttgacataaaattcaaatattaacattttactttatattatataataaatgaattatttttactccagatgcttgcttttgagagttttcagtgccaatgttcatattttaaaggttatttttagcatcggaacatctacagttcattcacagcttcttcatgcagctgatgcgcaaagttttgcatagaggctccagaggcttggaatggtcctagacctgttgcatgcaaagttgggactatagaaagacaatagtcctttggctggttgtccgatctgtcaaaagggcaaaatttttcttgttcagacttactgagattgattatggcctgtacagagataacaggtaccatgcaaatatcaatccatttaacaagtttacttgttgattgcttactattttaaaagcattgattcgtcaaaaggcaagtagcaatagtagtttaagacattgacttcggagtccaacagaagtttataggagttctggctccaccacttatttggaaagtttcttaacctttctatgccttaatttccttatctgtaaaatagggatgttttacatggatatgaaatatccatataaaattaaataatgaaatgaaataattaacattggtcatgtgaagaaaaccattattgttttcttattctgcaaattaaaaattgcatagtatgtcatatgcagataaaatgtgtatctatattattaaaattttgcaaattaaatattcaatatctcatatcaatttcaataaatttatccagtgtaaatttcacaaattgtcaggtttttattaacttagttttcttattttaagctaatattttagcatctaatcatgtaaaaatactatgactttaatcttatttctcagttaagccttactatatgtatttgatttcaaagtgaaatgctttgaattttcttgtcatctttaaaatgaaaaacttcagcttaatccatgaaaactcaattatattttttatttttaaataagaattattctgagacttttgaggcagttgagtaaggaggttgtggcgcatactgaaggtaggttaagataggttaatgtactaggtacttgtccacagtaagtaatgtacaagtgaagcttgagtgccacctcggctaggattatactcagtcacgctcataaatctaatggtctggctcctgtgcagtaattttatgctactaagttttttcctgtttctatttgattatggacatacaaaacacaaatgttttgtatgaattgtaaatatatagacattgacgtttaccatgctattacagaataaagaaaacttaataaaaaccaattaaagtatttttgtttctgtttttaagggtaatcccaagatatgtgtgaaaacaaattttcatagtctatcaacagaaaatggtttaccttaactttacaactgaaatgtactgacgtttttgcagtgcactgtggtggaaataatttcttcctatgtaaaccatcatttacttgtatctcgcatgtctttgaaaatgataggcaaatgaaatttacaacaacagaggactttaaaaatagtatagaatcatgtgtaggcattaaaaaaatcatgttttaggaaaatatcgcttccctttaccctcatccataggatattggcattaaataactcaaaatgatagtacaaaccagtatttcccattttctctgctttgtatattgctgcattatcattcatacgacattcctattttttaatttatatctcgtatctttacctacttacttgaaatttttatgtatccaaacaagacaatagcggcaatcatttttacttcaggatttggcttcatagtgatttgctttaagaacttgtcctagtttcactgattcccaaagcagggtctgttggaaaatatgtcattgttgaattaagctatattttgttttagtcactttcctgcctatcagttagcaagtgacaattactggctaaaacatattttatgatgaataagcctctgtgtttagaagatagtaaagacattcatggaagctcaactcactttagaatgagagcactcgggacactagataactgtacacaaacaggtaatttcagcattatccagtttttaaattacactcattttatttttggcagtgtaactctggaatgtgttgtgaatatttttcgatgtggtacaaattacttacagaatgttttgtcttcatctgatatcctttcttccctcattacagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattggtaagaaaacagaggttttgttcattttgttccacaacttgaattttcattatggaccctccttatattagagtcctgttaaagatgtaagaaaaaatttttttcattgaattttttggagtttttgctttatattaatattttaatatgtttcaaatagatgtcaatatcaatatctcatgtgaaactgatgggtacttaactaaaatgacttgcagatggtcaaccagtacaatccagtcacttgcggaaagcactttgcaattgaggtatcataggtacgtattatttttgctgttttgtttttctgtgggcacagtgagataaaaattttctttagaaatattacaacagtagtcttacagattatttgcttcctgaaagaggaaagtataatataatgaatcaggaaatttttgagggattatataaattggtgattcttgaaaaatattcacacctgagattaaaaaattgtaatttgtttttacttcaaattatcttttctgaaaatcaatcaattctgaaaaatttgtattttaactcttgaatgaaatgcaagaaaatgtagtttatatatattttaatttgacttagttgactagaggagaatgtgaaagattataaaagtttcgtatcatttggctaaagattaatgttttggaaaaaagaggtaaaaacagattataagagataatatgaatggtttttagaactgagtgagattacttaggaaataaatacttatggttaataaagggtaatgtgttctaatgagaagtaatttgtgcttgtttatttttactcttctatgttttaaaaagaattcaaggcatcgtcttatagtggtccctttctttctaaaatcattttatctaaaatgatacaacccttgattatataatagatttttatttttaaaaatatcccatagtagtagtcaagtaaatatatactgctgttaaacactgtgtcccaatttatatttttatttgtagtggagactttcaatttgtataacatgctcatttattcttaaaatataaattttcaactagaaaaataaatcccttctctcaaatactgtgatctgaagtctattcctaatgctgccagtctcttcttatgtagcgttaggaaaaaaatgtggcaattcgtacatttctcaaatagctgccttcatcctacctaatatgagtattttaaaatcagtagaattgttcatgatatgaaattttacttttataatctgtctttacattcttttcatggcattttcacattagaaaaggtgtttatggaaaactattatgttaagccccatgccttgtttctcttattaacatttacagaataactatgaaactacatttacttgggtgagtttcttaacttccctaagcctcaatttccttgtctgtaaaacagagagaataataggacttacagtgtttctgcgagagttaatgacatatttcatctaattataatcacatggtataatttctccttgtaaatattcaatatatggtttttgctgtcatgataatgatgccaacttttcgatttcaagtgtactagtactgtgcttctactttgttcttattttctacccccagatgacccctcactcctcattttcatttttgcccacgcaccaccatttattcacacacacacacacacacacattcatgattgtaattttgagaagacaagaaaaagaagtggtatagaaaatagaaaatgacagaagaatatagattttttagcttcttctaacttcctcactcccatctctttggaaagagtaattgctacttcagctatttaaatatagtattcagagcaaacattggcccaagaggttatttcaaagaagaggaaaaagactttatgtcaagtttgtccaacccatggcctggggcccccatgtggactaggatagctttgaatgcagcccaacacaaatttataaactgtctgaaaacattaggagattttttttgcaactggtttttttttttttttttgattcatcagctatcgttagtatattttatgtgtggcccaagacagttcttcttccagtgtggcctagggaagccaaaagattggacacccctgctttatgggttctgaggtggagtgttggctaggactcacttataaaattttttttaaattttcttttctgagaaaatgaggaatatacatggttatataattcacatacatatctgaaattggtattatattaacttatattaatttgaactagaaaattatattcaccactcatttgtggtgaaatttaattctttcttcaaagtgtgaggaatttgccttccttgccatctcaggaatgctccatgactactttcatctatattttaaatattctatcactaatacataatgtttgtttaattttcaaattattgtaggttctgtctctaactggatcattttcttctttttagagtatttatttcatttgcatccctgcttagtgtctaatgaaatatttaataagagttactgtcagtttctgtggaaagatatagaattgggaaaaattaaaaaatgcctttctaataagaatgtctttttttagatggagtgaaattgtctgtattttatttattttaatttaatttaatttaattttattttgtttttgagacagtctccctctgtcgcccaggctgcagtgcagtggtaccatctccgttcactgcaacctccgcctccccagttcaagcgattctcctgcctcagcctccctagtagccaggactacagatgtgcatttgtagagacagggtttccccatgttgcccaggctggtctggaactcctgggctcaagtgatcagcccgcctcagcctcccaaagtgctgggattacaggcatgagccaccgcaccgggccttctgcctgtcttttaaacttggggtccccagtccctgggccacggaccggtacctgtctgtggcctcttaggaacccggccacaaagcgggaggtgagagagcagcattaccacctgcgctccacctcctgtcagatcagcgcagcattagattcttagaggagcagaaccctattgtgaactgggcatgcgctcctcatgagaatctaatgcctggtgatctgaagtggaacagtttcatcccgaaatcctgaaccatctcccatcccccattagtggaaaaattgtcttccatgaaaccggtccctggtgccaaaaaggttggggactgctgttttaaacaacaaatcagaattctcagatatcttcttgttgcttttattaatgtatactaattgactatttttgtatcttttaaaggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtgggtatgtcaagctgcgttgtgtcttcatttgtgttagcagatttgtatgcagattgatgcagatttaatgttatattttgccattttctgatcacattagattttgaaaaaaaaattgttcctgtttacagtggtattgagaaaatcagccttaggaagttttacagttttgaattcatttcaaattatttatagcagactttttttagcaataggaatattttctgcacactattagatgaaatacatgggtcattatgaatgaattttagtagtgtttttctaaataaggcattattttatgtttttgttccaatgtagttatgaaaacatgtaatatttgtaatccaaacgtttaatttgaatattctgaggttctcaataatctgagtactcataactcaagcctttaatttgtgaggctatgtagggcacagaagcatttaaaatagctaaattgaagtggaggaaatagacaacaatgacatacattatattttaaacattcttttcaaaaaacttttgatttcaaagatattaagagagcccttggaaaatgtgatatattctttccggttcattgtgaaatctctgagaaatgattgtgcaacaggaatgcaaaaatatcttttggtgctgttacatatgtataactaaggaagcttttgtagatcttttctaaatgtttgttttcaagataagatgtctaaaaacaaaacaaaaatgggattttcagtgaattttcccctcaaataaaatattcctcagtaggaaacatgttagaataatgttccataaaaatattaatatatactattttgttgggggattatgtcaaaaatcaatatttgagtcattatttttcaattaattaatacacatttgaattaaaacctataaccaaaaaatacacgataagattgtcttaattataagatttctttttcaatgtaaagtcccaatgaattctctccccactgtttaattccattttaagtgatttttactgcagtgatacttaatatcccaggatagcaaggaaccctcctacactcccccaaacatgcacagataataacacactcacttataagatatgacaaatgaagcctggattcagtaacatatgttacttgaataacctatggtgttatccttttcaaaactaaaataacgagtttaggttgggcttatattgcctacttagtactagaaagtaactcaacgttgggatccaaataccatctccacttattactagcctttaaatccggactagccacacaggcactatgtgtctgttttgtcatccataaaatgtagacagctcctcataccttcccagcatgggtattgagggaatcacgtaaactattgaacttcaagcatatcctttctgcagactggatattcactgccagtctgcagaaaggatatgattcatatgattcagttaattgcaaacacagatttaacctcttacagtctcttgaatattgatacttcctttcctgacaagaaattatcaagaggtgaaatacagtatatatcatcttcctgggttggtggagaatgtctttttgttctatgaagaattgaataatcatgataaactttacatgacggaaaaagtttaggtatttttgttatcaacagtcaaaagtattattgttgattgcttaaaaatgattttaaaataccatatgaaagggagactatacctttacacagtgttggtttttggcaagtgagacttggagcaagagaataataaacacccatattgtgccaatccaggtattaagttttccctgtgaatcataacagtagcatgatttataagacatggggaaataaatcaagaaggtaaaccctggaactctatcgtcagttctctcttaatttttcttacacagagtgtctacatttggccttagttatggtttgggttatttaggtttctttttgttggtggtggtttgttggttggatggtttcatacattagcccttcagcttccctttttgctactgcagttgtttcctgcatattccagccaagggccatctctcactttagattgtccactggcaggggtgactgtcaaaataatgaccaagaggagggccattccagctgcaatcccagaggcctctgctgtaccaggcattgaccttttaggttctgagccgtgggcaggtgtggagggcatccaacctgagcagttctggaggagatattcctcaggagagcacctctttaccagttggtatggatgtacttaatatttttaacaactgttttgacataccaactgaatatatgtcctctaaatggaatcttctagtcttagtgcagataatcaagacatgactatgtaaatgtagtgtgtatcataaagttgatgcttggagtcataacagagttagggcttcagagacgcactgttatgcttgggctttcaggcttttagtttaaaatatgccacatttccatattgcctgttattgtcaggaagattggccctcaaagttaaaaattaagaacttgggggaaaacttatgtagtgaatctaagcctaaggtagtttttactttagctctgaaagcagcatcataaaaaggtgataggaaaacagggaagataacctttttctttgcatttctatgatttttacattacacctttaaacatgtcttgttatgtacatatacgtatctattttaaaaatcacttgctattcagaccatctttgcctctattactgcccattaaaagcctgttttcctcagattatagaaaaccaaggctttgctctgagagactatctctgaccttgacctagaaatatttaatgatacacagcagcataagagtttcacactcacacatatggaaattgatgcagtccatgggttttttttttttttgcctttaattaaagttcaatggagaacagtttgttattgatatttagcatgtgttcagcatggtatctttttttttttttttgagacggagtctggctctgtcgcccaggctggagtgcagtggcgcaatctcggctcactgcaagcttcacctcccgggttcatgccattctcctgcctcagcctcctgagtagctgggactacaggcgcccgccaccacgcgtggctaattttttgtattttttagtagagacggggtttcaccgtgttagccaggatcggcatgttatcttttgcttgcagagccaatggttcaatttctaatcaggtactactactagctttcagagtaacatgaataatgtattgacttttttcagtcaagtctatatttgcgaaaaagagataaatccctcttttaatatatcacataaagtaatagggaaacaaatgagataatgagtgagaaagttatgaagaagatattgcttgatgaatacagatgtatgaaaatataacacaatgtttttaggcattattactatttaaattaccatcacttaatactattgtaaaaatttctagtgaagccactgcctccatccagtgtgaaagcagaaattactataaacattggattattgaaaatatcttgggaaaagccagtctttccagagaataaccttcaattccagattcgctatggtttaagtggaaaagaagtacaatggaaggtaccttttacttagaacttcagctttcctcattaaatgctatttttataatatgtaagagtttaattgcattagattaattttattggcataaaagtacattctcctgtattgtgtagctattttcattaaatagatttatctaagtctaacttttttaaagaacaaagtttcctgaaatccatcattccctgaagtgtgttttatagaacgttggttgcatattatgttccttggaaaaagattaaatggctaaatcagtttaggaaaccctgtatcactgtatcttccttgtgtagtcacggtatacatattacatattcaaggtttggagaggtccttcattaaagaaaaatttgtgaccttatttcatctcatgttccccaaactaatttttccaaggaactgttgtttctctaacatctgttgatatcttttagtacatacatgtttagtggaatgcattttggaagaagctgcttttcaaacaaacagagtcattcccgtagtggcaagtgtgcctatcatggcattccacatcagctttgtgacggcagcctgcaaagacctagaaatatcagaaacccttattgtatcattagatcacaatgatatcaactaaaacaaatgtgacagtttagctgctattgaagaatactgaatatcagcgatttgctacagtaggtcctatctaaccaatacgtttaaattctttttaaattcttaaaacatctttgtgggtagaggattagtggacagggattagtaggagggtaagagagtgtttgggaaacaaggttgcaagtaaaccagttcaaaatcttgtcatcatcagcaagggagtgacaagataaataagaaaatccttgacttgaaggagtttacaatccaagcctaattgtgactatttctgaaggcagagaacacagaatcagttctcttaattttggaatagtgttaaggtttaaaataaaatgtacttcagggccctttagatacatatgtgttggtaatgatcaatctaatgctttgacttattttacagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaaggtctgcagagattttgtaaatgtgttttgaaagtgcataagtgtgtgcttcaaatatggctgaaaagtatttcttcaaaaacatatacacaacttgtcattttgcagttcctatgagaggacctgaattttggagaataattaatggagatactatgaaaaaggagaaaaatgtcactttactttggaaggtattcccaattttaatattaatcttaaattgtatttttatactcttaaaaatttacttcatggtccataatcctgttattaatcttcggaaagctcaacaatcctgtattttcattgcatttatgagatgtatttaaagagagctaagatgtacagtggctgaagcactggcatagtgttaggagactttcattctcttcttagcttcacatattatagttacgtcagtactatttgggcaaagttacttagactctttgggcctcagttttctcatctgtgtaaatgtaatattgaactagatgataggcagtgtttcttggagtctaaaaattgtattcatatttaatcctgaacaatgtaaatgtcaccttccccgcacaccccaagggcatctaacacatgacagagtattccatttatgtgatggcataaaaacagtggatagtcccatatatgatggctgtttagcctagtaattttcaaagcatcctctcccaaatgaactgatttctatttcaagtgaatagtttatttggtcagtaaatgccaaatttaagattgacttgggaatacaacacatgaagtcaaagagtatttctgtcactccaaatgtgaattgtaagtttaatacccaaggttgaatgagcacatgtttgaaaatggtttcctgatgtaagaccaaagcctctgtaaaagttgtggtatataagaatttatgttcatttggtttctaaatccagttactctataatttcatttggtgaataatcaatgcaatttctaaagtcttccatttcaatatttcttaaaataattttttattcttttatttcatttcttttatcattgctctccttaaaaaatttagtttcttttgttattgctctcttttctttttctagcaaaccattccttcaacacattttaatatttccaacttaaagttagcattagaactgacagacatttatgagccatttattgtattctgaacacttcatacagatctccacctcccggggaattcaggacctgtattctgagagattgagtgggcggttgaacccaccgcggaagggggcactgctgaataagaaacaagagtcttgcccgacagattatttttctcatatttttggttttatctccatgggcactgttccagatacctgcaaacttctacagtgaaggacaggcagtgatgttcccatgtttgtggtagggccagctatgagcagaatttaagtagcttttctttttctttgatttgtcctctcagagctgtagtcaacagccctttggcctaggctacagctaccctctcccattgcaatatactctagaacaaaacagttgtctttctccagacagttcttatgttttcctcatatcatggattccacatttcctcagcaatgctgccaatagaagtttctgtaatgatgaaaatggtttatatctgcattgtccaatatggtagcaaccagccacatgtggttattaagcacttgaaatgtgcctagtgtgactcagcaactgaattttaaattgtatttaattttgattaatttaaatttaaatggctgcaagtggccagtggctatctttttggacaacaaagctctatgggttctttaggggtgatttgtgggagggagacaggacccttgctaatctaccatctttgcagaaccttgaatgccttttattagtcaatttgcctttcattaattttgttttgtgctgttttgttgtgttttcctaaactgagataatagttcaatgattacggttctccaagcctatgcctcttaaaccgggataagatttgcttaaggagtaagccacaaggccacaggataagtatggcactttttaaaaaatatcatttctctggcatttttaaaataataaactttacgttaaggcagttttagagttacaaaaagacggcaaagatagtacagagaattcctatgtattcccacaccaagttttctctagtattaacatcttaggctagtatgatacatttgttacaatgaattaaacaatattgatatgtcatcattaactcatctgtaatttatttcaaatccaaatttccttagcttttacccaatgttctttttctggttcaggattccatccaggatagcagatttcatttagtagtcatacctccttatgcttctcttggttgcaaaagtttcttagatcttctttgtttttatgaacttgacacaattgagaagtactggtcgggtattttgtagaatctccatcaaatgggttttgtctaatgttttctcatgattaatttagggttatgtgtcatacctccttatgcttctcttggttgcaaaagtttcttagatcttctttgtttttatgaacttgacacaattgagaagtactggttgggtattttgtagaatctccatcaaatgggttttgtctaatgttttctcatgattaatttagggttatgggtttgggggaggaagatcacagatgtaaaatgccattccatcacatcatattaaggatacattctaccaatgtgacttaccatagttgatgttaaccttgctcgtctggctgaggtagtgttgtctggctgaggtagtgttgtctggcttcccactggaaagttactcttttttctcctttctccattttagttttaaaaatgaagtccccatgcttaaggagtaggagtcatgttccacctacttgaaggtagaggacctacatatattatttagtgttcttctgcatgggagatttgtctgttctcccacattaactattttatttattcaatcatttatttatattagtatggacaatgaacatttattttagacttggtttgtaatccaatactactttattttgttgctgaaaatattcctgcttcagtcattgggagctcttttaattgactcatgttcctttgacatgcccccgtcattgtggggttttttattttaatttttgagtactggtaagttcgactttattaaaattaaaaacttctgatctgggaaagactgtcaagaggatgaaaagttaaggcacagactgggtgaaaatatttgcaaaaacacacatctgataaaggacttataaccaaattacacaaagaaatctttaagattcaacaggggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaaaaaaaaccaagtatctgaacaaaaacctagccaaagtagatatacagatgacaaatatgaatattaaaagatgttcaacatcattcatcactaaagagttgcaaattaaaacaagataccactccacatctattagaatggctaaaatccaaaaaaaaaacctgacaatacaaattgctggtgaggatgcagggcagcaagaacttttattcattgctgtggaaatgcaaaatggtacagccactttggaagccagtttggtaatttcttacaaatttaaacatagccttaccaaccacatgatgcaacattgcatcctaggtatttactcagctgatttgaaaacttaagtctacatagaaacttgcacatgaatgtttaagcagctttagttatattcaccccaaactagaggcaactaagatatccttcaaaaatgaaacgattctgtatacttctgaaatggtgggtatatagcactatgcatttgccaaaactcctcgaacttcatagcacaaagagtgaatcttaatgcatgtagattaaaaagaaaatcatttaggaggttgaaggatcccaggattgactgtaaactgtgacaaaggaatctacctgtattacaagtgtatgaagcaacttcactgaaggtggtgggagaaaaggccactttggaacttgagtggagttgttggaaatgtgtggaatcttaagactaaaggcaaaagaaactgtacataagcactgtactctagttgatacagttctcacagggctatgggctaacaattatggtactgctctacatgtactctggaaggggacaagcaagtaaatggatggtggatggtgggacccagatttctcactgttggattgggaggttacacacaagcacaggatgatccatgtggcaatgaattagagttggggatataggtatgaacttatatctagcttaatatagatatagctagattctggtttaggatacatgtacattttcttgatttgtaaggtaagagggcctaaaagtaatgacatccagtagtaagacatgtgcccagacttgtttctaattaccatcgttcaataatagaaacaagggctattggaagaaatggctaattttagggttggggcagaaaatatacgagattagcctggaggatcttgtagtaccagaaagtaaggaagcttaacattctcttacttgatggttaccaaaaaagtattcattaaaactgacatgtttttttttcaaataaaatgcaacatttgcatgactttgaaacatttctttcttgcggtggctgctaaaatcttactttcaacctatccagatgattccaagttttgcagggatacatgtatatgtgtttatttttctctgccatttctaacttagaggcatctcaccggcaagaaattgagatgtactgttctagtctatgatatacagtccagccttctctgtctttataagggattgccagcatttaatcttacctgccataggtgaagttgattggggaaatggggtacactgttaacctctgtggaatataagaatagaattgaactagacacttattttacattcggatctttaatgacctgatattattatttttaattatatgacagaaattctggggtgccatagacactgttttgatggcctctgttactcattaacctttgcagacattcttacattctagataatcttccaagagtatcagaggaaaggaaaatgaatgacaaatcttactatgatcaatatatgatgattaacaccttcacagctcttgttgttgcttttcattttctgagggttattccttgtttgctttttagatgaggaaactctctactccttatgtctttcatttctctaaaattagagtgaaacttcttggtagaaaagtgtcttgatcatatccctactttattatcttcaagtgatttattctctgggccttaagaaaaaaacctcaaaaaggggaaaataagtttgctatgctccataacgatccagacaccttcatggagactgtggcagaggcaaactctatcccacccatctccccagcctctcagccttgtaatagtacctgccctgatctggcccctgcctcctaataagaaatgtagaatgagagttatgtgagctcagttagtataaaaagcactgcagcccttaaactaatcaatttctatatttactacagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaaggtaagaagaggtacagagtggtaatccattgcctcttttaatatttaacttttgcaaactctcctattttaaattatctttcaagcagcctgcaattctctgcatctgaaagtctctctttcacctttcatttcctttgtctggaaaaataacaaagtacattgtacaatgatcacataatacagtccttgagctttcatttgggagaacattgttgtaatggtgttataatatatgagaatgttttagtgaatctaatacttaaatcttttggaccaatggagatctttaggtcaataattctctctccctatgtacatatacatgtatatatttatattcatacatacacacatataaatatgtaaaaataagtatatatcatattaaatatatatttaacactatgtaaaatagtaatagcatgacatgttatatggatgcaggttaattgctgagacttaaaattactatggacttcattgaatgtgagtagcaaaccttcttgcattaattttgatatatctgattaatcggagaattgagacccactttcaataggaatttctagtctagattacatattcaaagtgtaaatttttaatggaaaatacaaattttctgtgtctctaccaatctataaaggcctttccaactgttacctcctttatgaaatctttgcttattgctttaattgaatatgccctatctcttctttaaatctcagagtgcttcctgtctttcttattttatgtcctgtttacattatgattacctttgtatttatagtgttaagcatcgagttccatagcacccagctcagtgttttatgcttaacatttcctaagtatatatattctagaaatatctgtagaatgcgtcagtggggtaggtagtgggaattgtaatgtgagaaaaactataatggttggagtgtccagagcctaataggtaagacaggtattaatgaaataatcatacaagtgaatgtctatttgcaaactgagagataagggcctgcaggaaaggaatataattttatgaaaggaatgaaaaaaaggaacctgacctggcattgagattcagagaagccaccttgaggaagtggtactgaactgaaatctgaaatgtgagtaggaattaaacttccccaaaagatgtaggggagggcaggaaaagcattggctcctaacaagagcagccagatcaaaagtctatggcacaggatagaaaatgaagaaagaccagggtggctttggtgtgggaaatcatggaaggcagagaggtgcgttgagacttggccctcagggccttgcaggcatgataggaattttaccctcaaatgtagaaatccgctggaggcttttaagtgggatgctgtgcagatggtgttaaaatgaacagatttgtgctttgagagtatcactccatcagtgggagaggatggttaataggcttgtgcagtattccatatgagaatgcctttttgaatatatcaaaaaattgctttttaaggttttagggagtatcatgtttctcttcaatgtcatctattcccatatctctctgtttaaatgactctcatgatgcaaaagtaattgtcatgtatcatatttatttgtgtaaattgtctgtcttctcttccttattccctttagtaggttataagttcctcaagagtattagtagatttttattaatttttaatttaaaaattaatttccttcttttcccctcagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatggtaagtttactatactttagtaagttgctctcatggattaatatgacactacagattattaattctattaatatagccagttaatgaaaacttcaaaaatatagaggatactaccatcctaatacatataatcctataacctttatcaaaacatttaattctcttcctcttctcttctcttctcttttcttttcttttcggcagggtctctctgtgttgcccaggctaaagtgcagtggaacaaacatggctcactgcagcctcaaccttctgggctcaagctatctttccacctcagcttcctgagtagctgagactatagacacacaccatcacacccagctaattaaaattttttttttttggtagagacaaggtctcactatgttgctcaggctggtcttgaactcctaagctcaagtgatcctcctgccttggcctcccaaagtgttgggattacaggcatgggccaccacacccagcctaattctgtttcctttgacattttctcattttaacattttatacaggggttatcatatcatatcatatcatatatcctatcctatcatatcatatcaattttctcctcatttctttctaccattatttttaatgatatagcattttattccaaagtccacttaaactgtttgagattctttatgttgcttccagctttatcttttcttaaatcattttttaacagcttctgatatcttctgccaaattgtttcctcaaactgtgtaccaacttataatgccactaacaatgagtgggaatgctagcctgaaggtctgaggagctaggactgggtgacctagaccagggtattctcccaaagttagaccagttattccaggaggtgagtcaagcacaaagtataagtgcacaagacagcatttctaagtctgagtaaggattgaggaaagttaactagggaagctaaggattgctatgatcttattatacaatatcattctaaggactcataccattattttattccagggacctagaatttagcatcagggtaaatttatttacaaattgttgaactgaatttagttcatcaccactgatgcgcaggtagtttctctctgtgcttttctttaaaccatgaggatataaaatttaggcttcacagagatctctcttcttctggatatattcttctagaagaatattcatatattattagcatttgtgaaaatcatgatggatccatctggagctttgctatagggttggtcattttccatggatcaaaatcccagatcttgcaaggggtctcgtggtctccaccaccattttgtttgcataggatttcacaagactttagtctcccagctaccttgaatggaatggggaaactaagtaagctgaattcctattaaaaaaaggagtattgcccactttgggggtaagggagaggtagtagaacatattgctctggaaaaggaaatgaaggaaagaaaaagctcatacaccctgcacttgaacaaattggctatcactggaacatgcctttgaaaaattgcaatcttctgtctctggctaagatttttagaaaaatatttggaaaactattgtcatgactagataattagaagtgcttaagtttgttttgaaactcccttgataatttaatccacaaataataagtaatttctatgtttggaaatatatgatagtcactttaattcttttttaaaatgtatgttccactcattactattaattttgtataaatgagccttttacgtatttttctcctcagatcattttatccccattgagaagtaccagttcagtctttacccaatatttatggaaggagtgggaaaaccaaagataattaatagtttcactcaaggtaaaaattataattttagtttccttttacaccaatgtgtgtgcctaatttgtttgcagtaatattgccatctgattattctttttctgatagaatcatggaagagtccaaagtcttctgtagatttttcatggtgaggttccaaaggaaatatttttttcctctaaaaataaaactggagctatagaaatagagtcactgggcctcttatatttctgattcatcttactgtacttggaataccaacattttgattttgttattactttttaaattgtcttcaaatctaagcaacctagcaatgatatttcaagagataaacatttcatttgttgttagaataaaaatcattaaaaaaattcatacatgtattatccaacagatattaattgagcattgttctaagcactgtggattgaatagtgaacataagtttctgcccttatggatcttaaataccagtgctctaattgagagtgatgggcaaaaaataattatataatgtcagatagaaataagtgccatgaaggaaaacaaaagcaagataaagggatggcattaaatgtggcactttagttgatagccagaaatggtctttctatggaggtggatgatattcgagtaaaaccttgcaagtacagtaagaccctacttgatatagtcaatagattcttggaaactgcaactttatgcaacatgaactacaggaggtccttgaataacatcattttgttcaaggtagtttcattataatgttgatgagaaaaaaaaggttttgttatacattgccatttcacttaacattgcagtttccaagagcctatcaatgatgttcagtgaagacataactgtacaaatagcaaaagcattccaggcaaagggacagtgtgtgaagagcccctaaagagtggggatgcttggtggttcaagaaacagcaaggaaatcagtgtgtgtggagtgaacaagatagagattggcaggtgtggaaggttgggtcctccaggagtagatactgagacagtcatcataacaagtttgacactttggcccattataatgtaaaaatgatcaggtagagaggaatggcaaataaataaatttgaaaaaatattttgctaatttacagtagatatgatgctgaacaaaataataagtattttattaatgtgatcacaacatatttttatcttcattttttatttttatatttttgaaggtaataagagatttgtgatgaattcagaaaatgtctactataatttttgatacagaaagaaattaatatttcctcaagtttctgagttgtgtaaattgtatttctttttcagatgatattgaaaaacaccagagtgatgcaggtttatatgtaattgtgccagtaattatttcctcttccatcttattgcttggaacattattaatatcacaccaaaggtattgtacttgaggttaagaatctttacggcaaaagtccttacgcgtattcaaaccctgatttaaaaccttctaaattaggaatattaaagtcttctaagtgcttttatatgtagtctgtatacaattaagatagcataaaaaggaaaggcctgttgtgaggaaatggcattccattttgctaggactgtaagagttaaagaatgaggaaagaaacacgaaacacagcttaacagttaaagacaggttttctttagataaaacctgaggggcttctggccaattttgttcaggagcccctttctcttacagactaagagtatgtattggttttagggtgagggggcttatcacaagcttggaatgtttatgtgtgagggagaagtttatggcggggttggaatgtctctgggaggaggggaggttatcttggggctgacatctttccagctggatggggagggttatcttggggctggcatgtgcctggtcagggaggatggaatgtttctggttggagatgttatttgtggtttatggtaatgctgaccttagccattaggctgatgccctttggatttaggtggtttttgattaaggggaattttaatatgaggtgcttgtccatgatggtgatgctcctgctctgtcaaggacaacataacttcaaggaagaatttagttttttaaaaaaaatgtacatacattcaggaaacaacaagcttataacaggaaatcctaagcagtatgttcttggaggtggcaaaaatggctttcagagttctgcagtttgggttaaggacgttttgtggtgaagtgggtggtaaaagtagccttttagtggtgacctggagcagtcagttcatttatgatcagcaggcactctgctttttagagatcagcactgtgtggctccagtctgcttggcttgtcaggcaaatgcctgagttccgtggatggtggcatgggtgccatgatactctctgtgctgagaagtccagtgtggttattttacacatgccaaatctctgtagaaaccatcgtcttcaggcaaaaaagagagagaggagattttagaatctgaatttatcttgtagttaagtgagttgatggggccacatcaaatggaattttttctggtacccactttgtgaccatttttaatatttcaatttctttgagagaaatctatccagtgtttagcatggtgcttggcacacagctttcaataagtattggctatttctattattacagtgattttcagcttgggtctagataaaagtttggtagaaatcttcatgggctagcatgtgaaaatgcatctgaccctacggaggcatagttgatctggtggactaatttctagcttgtctgttcactaactgttcacattttcaatatggatgtttttctctaattttgatgccctgtttatcctttgtagaatgaaaaagctattttgggaagatgttccgaaccccaagaattgttcctgggcacaaggacttaattttcagaaggttgctttttcaattttttttaacccagaatatatacgattgcaatctagacgccatatgacttatagagcattaagcatttttaagatttaaaaggtcatattttattcaattcatcttaatatatctgttattatatactttcaagaatagcaggatgcagggatttgaaatcaggaagaaacaaatttcagcgcatagtttatcgtatgagagttcacaatatacatatgttgcttctgtgtcacagtacataataaaataaatattagaaagttaagggtcaatctgatggagaacagatatttggatacactttttttggtataaactgtatttaggcaaaaggctggaatcaatatttttaatgtctataattatctccataattatttaaataaattagaaaattatataatcctcaaacattacaatctgaaaaatgcagtgatcataataaaacttatatttatgcagaagttccattcaagtacaagtactttatgagagttagtcaactataataaaataatttgtatttacttctatagtaggatttttcagaaagctctaaatttagtgactgttttattaattctcataatgtcccttgaagcaaagctagctttccactcataaaactggaaaaatagaattcagtcaagtcaaaatatacagatttttaaacaatacttatttggaggttattatccaggtttggtgattgcatctttatcattagtcacttgttaaaagttttcaatggtttccttttgaatacaagatataaactaaagccccctgaagctattaatagtactcaaggacctctttctacaatctgttatcaacctacctatacgactttttctatccctgggccttgatgatacctttactgttcccatccaccttcacagagccttccttgtacatgaagatcttgctctaggcccttctttcctcaagccttcctttaaccagtgtaattcaaaagaatttctaccccctttaagttcctagatcattgtactgtttttttaattgtggatagtgctctgaattcaaagactgtattttatccatcacaaatatttgtagtactcctcctgctgttctttatgtgcaaagcactgagatacatattcttacatttattaagatttttacttacattctcaatgtttcagtttcctcttctgtgaaataggctgcttaccttattaggttgtttgcgggactaaagaagatggtacttgtgacatagtaaggtctcaacaaatattaattattattgtacatatttatgtattttatattactattattattctttcagttaccctatgggacaagtgttattctctctattttgcaaaagagaaagctgaagctcatagtggttcggtaacttgttttagaggcaagattagcttaccagtttgtctggctttggagcctgttctaatagcagctgttctctatagcagtggcttctttttctttctttcttcttcgccatgacccacagtgaaaaaaacttaggttggtgcaaaagtaattgcagttttggcatttttaatgtataaatacgttttaccttccaacctagtacaccatagatacagatatgcaagaccgaaatgaaagatacgcaaagcagctttacttcttgcttgaaatagaatgttttaaaattctattttatttgttaaaaatgctggttgcaagacactaaattgatttcacaacattcgaatggcctatgatttgcagttagaaaaacactgttctacagcttatcaatgaataagtaaacaactaatattgtagacataatgaacaaagaaaaagattgaattgtaatttttcagcaggagaaagaatgccctgtcttcagaagcagcagtagtgttgttttatatacgaacaattctttttatagaaacttcgctttgcctgagtctaatcagccacactcctatatactcctcacctgtgctgttgctcactaagccagagtcttctttcattaaaacagtgttgccgagtttttcaagtaaatattttttctctcatttatcttttactaagaatttatacagtgacattttgtgtagttgtgatgatatttcagagagagatatatatatgtcgttcattcatttgttcaacaagcacatggtgagtatttatatgtaaggcttggctgttgctagggtctgggagaacagatttttcttaccatatgagaaataagacagtgaggtcagagaagagtggctgggttgaaagtagaataggaagagcttgtctccttttgcctctctaaaatagttcttttctattcatttcatccatatattcaatatgattgaatacttaccctataccagtcactatagtatgccctggcattataaggataagaaaaacactatgtgctcctgagtatacagtttaatggggatgataatcattaatacatttatcatggaaatagcattactttttttttgtacaaatttatggggcacatgagaaattttgttacatgtatataacatataatgatccaatcacaaccttatagttgtaaactacatgttgtgaaagaaggggttccattgtgctgagcgcttataatgtgggaacctggcttagtgtatccgtgggggtgagtggataaagttaagcaaattacatttgggccaagatctggtagatgaacaatcattaactaggttttgaggcagagatgtggtgtccagctaagtacctgcaaacactaagtcatgtggaaggcagtacctagcatattcacaaactggaaataggaagactataagactttttcttaaatatgagggttttatgtcaaaaaacctatatacttatctaagtaaaattgccaaattttcagtatataggtatatattaattcagggaatgatcatcttactttttaatgtcacttaaaaagaggctgaaacactctctcttcagcatttaagctctgaaatcttacctatggaccaccatgaagtggtttctcagtgttcaggagggccatgaaatgatcaggcccacatcagcaaaatgcagtttaaacctgcagcaaattatttttcccttttccagaaaatgcctggcacaaaggaactactgggtggaggttggttgacttaggaaatgcttgtagactacgtcctacctcgctgccgcacctgctctccctgaggtgtgcacaatgctgccacaggtcatctgacagaccttatatacaagtagattgaaatattgccacattttttcaagttctggtaaattaaagaaatgtgaagaatttttataatacagtgggtgtgaatgttcttatttgtaggactgattttttaaaaatctctggaaatatttgactttctaatcttataaattattttttaagcacagctaacccacaagatgcttagtttattactagggctgaccaggcgcataaataacactattaggaataaattaggttttggaatataatagaacatttaaagagtaaaggagaatataacttcaaagattttattaatgataaaaatcttctaaaattcattaacttttttctctttagcctgttgttttaatctcctaaacaattaaaatgtacccttttctttttgagacagggtctcgctctgtcacccaggctggagcgcagcggtgagatctcagctcactgcagcctcgacgtccttgggctcaactgatcctcccacctcatcccctttagtagctgggaccataggcgcgtgccaccacgcccggctaatttttgtagatatggggttttgtcatgttgcccaggctggtctcgaactcccaggctcaagtgatccacccacctcagcctcccaaaatgctggacttaacagatgtgagccaccacaccctgcctaaaatatgctttttaaaggaaaaataatatagtgtaactcactttatattactaaacaggaaaaggcaaatttaccatccaccctatgtttcatattcatgttatttaaattatttcatagggctaatagccttatattttctgatgataaaactgaggcccagagtggttcagtagcttgtcttgctcacccagcctgtccatgtaacatctgtggttcaaatccagatctatctgactcaaattgatacccgtgccatcagttccatattaacaatgtatttcttaatatgcttaatgccactaaattatacacttaaaaatagttcaaatggtaaatattgttacgtatattttaacatcataaaaatgggcaaatgatgtgaataggcatttctccaaagaagatacacaaatagccaagaagcacaaatgaaaatatcctcagtgtcattagataatagggaaacacaaataaaaaccacaagatgcccagtaggatggctataataagagacagatagtaagtgttggtgagaatagagagaaattagaattatcatatactgacagtgggaatggaatagcaactctttcggtaaatagtctgacaattcttcaaaaggttaaacatagaattattatatgatccagtaattccattcctaggtatgtactcaatagaaatgaaatagcaaatccacatgggaagttttataagaatactcatagcagtattattcataatagccaaaatgtgaaagtaacccaaatgatgaataaataagcaaacaaacaaaaaactcacactatattgcaaagaaagcagaccagaggagcctattgtttttaaaaataattcaaatacaaatatagtattttttaaaggaagtaataatttctatatcaagtgtttcctttaatttgttctccaaattcagatattttgaatattgattattatgaaagtactcttaacctgaaatttctagacatctaacatgattttcaaaatcttccctaaaattaatctattccacttttgaagctgtcattttccttccccttggtttatattaaatctaaatcctgaacctataattatgttaatcaaatgtgtttttaaaaatccaatattttgaatgtatttctaaaagaaaaatgaaaagaaaacatttatttaaaaccactatatgccagacattgctaacaataggataataccatatgtgattaaaaataattttgccaatataatttcctgccagatcttttttcttttgtatgttccacttccttttctcttttaaaattagtttttctggataatataaagatgaaaatataggacaatatgaaaacagctctatattaacacaatattttaaaactttctgcattttcttcatttttaaaataaataaaaactacaggtaaagtttgtcctgcttgttccactatttccggtccctcctcttcctggaggaacccatgatttcaagaatgctgtagcctgtgtttgtctagtttgtgcatttatactttcctactttcacatgtgtgtatccatgaccaatgaagagtaatcctttgaagtactgaaaatgttaatgtacctttcatattattccaaaaatatctctgaacattgtgttttgagctctctccaagttgatgtagttaatttagttcacacatttggactggtctgtagtattccattatacaaacatagcacaattcatttattcctctactggtggatgtttaaggtgtttgaacacttttttatatttattacaaaaagtgctgcaggaagtatggttgtatatgtctctttgttctctcatgtatatgatatttctcaatatttaaaattttttgaaaaaatatatgtgaatgacttaataatgaaatgttacagttaaatatttgagtttggaagaccacttcatgaaaaggacagtccccttttccacccctccgtacccttagtcttgctctccaaatgcctctttagttaactgtctgacttttggtttttctggtatgtcacctttttatttctaaaaaccatatgcttatgccactatgaaatgtagacggtatctattgatttctggctacaacgaggatttactcccacacattattccctccttgtgtttctacccatattgtcttgtcacttttttcaattccttaagtaatcatttctccaacctcagaaaaatctacttaaacttccatttcttgttcttttaaacagaagactatttcttggagctcccctgctatttttttttttaaataaaaacattagcactcttacgcttccctccatttctccctctactttccaatctctaaatctaagtttatgtttttccttaagtcagggttgatatgatgttctgtgttgtaatttgtctgtggtttatttttaaaaatagaaaaactaataaactgaatttgcattgttatgattatgtaaatattgtgacttactgaaccaagtatttaataatatgtgattacacttctcagtggttccgatgtcaaaggggaattttttaaaaaatatattagatatattccacctgttgatcaaaattgtgccgaattttagttagcttcatttttagtttttatcttttttcttttccttaagtttctaattgtcccttccttcctcttcctccctccattctttcatccattcatccctctctccctccctctctttctttcttttcatgctgtctttctttctccttccccttctcttccctcccctcccattatataatctatgctgttatgttacctattttatccactaccccatctttactggaggtgttgttctagtggactctccaggaactcctctatcctcctacttcaatcaggactaggctttctctaaaattactataagccatcactctaaactttcccttaactggtttctggttagtactgtttcctggattcctttccttcatctttcttaactacacccttaagtaacctcctaagaagtatgcgataagtctccatctctccatgcctgaactgccttttattctgccctcctcgattgttagtttggtggagtatcaattcttagaaatagcctttccaagagaacattgagataattcctgccttaacatatagtatccagtgttgcttctgagcagtcagatactattgtgatttttactcctcactgtttacttataatttcctttttaaacagatgcttgaaggcagcatgttcgttaagagtcatcaccactccctaatctcaagtacccagggacacaaacactgcggaaggccacagggtcctctgcataggaaaaccagagacctttgttcacttgtttatctgctgaccctccctccactattgtcctatgaccctgccaaatccccctctgtgagaaacacccaagaatgatcaataa

SEQ ID NO: 91 - DNA, 214777 bp, Homo sapiens
ccggtctggcttgggcaggctgcccgggccgtggcaggaagccggaagcagccgcggccccagttcgggagacatggcgggcgttaaaggtacatcgcggtccccggctcgcttgtcgtgtggtggggttgccacctccgttccggtcaagcctggggctgcgccttccgcgcgccgttggggaacggcctcaccacccttcccgcctctccggttcgggaggcgatcgaccgctcccttcgtcccttggggtgtgggtggagcggcgtttcgggggagccttggccctttttgcaaggccgctggccttcctgctctccagtggcggcaccagacccctccccagcctgagccctcggcgagagcggcgccctccacctctcctgagtttttaaacaaggtttccacttcttgacgccaccctaacgcctttcttctggttttctgcccctccgcagtttcctatttgccacaaaggaccctttgtctccagcgttcttagcattgggaaacttaatcctctttttcctaatgatttttccaactgggcagagttgaccgcgggcgggtgtcaatggaaagcacccagaaagacggtgtttctcgcagtcgtggagagtagattacgtgtaattttaatactgctttcttcggtgttttctctgtttatggacagagaagaaaccagtgtgtgtgtagtatgtgttttttgcatggggcagttggtaaaaacaccgcgtcccttatctgtatggcttcagagcaatgcgagacggaaaaggttttttgcaaggcttcctgtattttggtaggaaaacattccatttctaatctgtcgaatagagtagcatgacttgtttttatattggcttttatatcatccttgaaatttgcacccaaagatatccccagttaacatctgctataaacatgtagatagtatatatacgagtacgcctctgttcactatgaatttatccgagtatgtgagctgttagcagcagacattttatcgttatttctggctgacttttatacttaatatcagtttagtaaacatggtttacttggagagtgtcgactgtgttatatatccatttgaagccaatgccgaaaacagatgaaaagtagtgtctcagtactacacatgatcagaaactaccaaatcatgatcacgtttatgtgtgaatgtgttagaaaattgtgatgtagtgaaaaaaaaggaagtctgaaatggaaacggactaagggaaggaagcattttacagattgttcaacttttattgaggaactactgtatgccagagacttaggatacaaagataaatgagaagttattggtgggtgacagagctggaaataattatattactatgtcagtgtttatgttgggctcagatgcggtgggagaacagatggtgggttggattttgtcctccaaaaagatgtgttcaagctctaattccctggtacctgtgaatgtgatcttatttggaagtagtatctttgcagatataatcaaattaaaatgataactggtttaaggtgggccctaatccaatgactggtgtccttataagaagaggggaatttagacatagagacatacagggagaataccatgggaagacggagacagaaattggagtgatgcagctacaaagtcaggagcaccaaagattgttggcaaccatgctggcaaccactgagtgttaggaagaggcaaggaagggtgcttccctacagccttcagagggagtgtggtggcgctgctgacaccttgatttcagaagtccagcctccagaactgtcagaagataaatttctgttgttctcagccatccagtttgtggtactttgtaacggcagccctaggaagctgatgcaggtgggattgattcccctgctccagagaaaggactgttttcacagaagaggcgatgcttgaactgaatctgaagggatcaatgtggcttcccttggcaaggcatggagtgaaggtggagtatatcccaagtggggaggacagcacgtgacatggcgcagggcttatgaaacaacatgccttcttctcttcaggtacttaagctacattagtaagaccagaacttagtggtgagggttgaagctggctggacaggcagttaggagtgagtcaggcgatggtgagcctccgtgccagaacaacttgtaggctgtggaagcaaccgcaaagggatggcagcggtgatatatatagttgaaagatcactgtctgctgtgtagaggatggattggaagagtcacagaggcaggaataagaggttaagggcctgcaccagggctgtagcagagagtttaagaagtctgggagattgagtcaccttgacctactgattcattggaaggtggaatgcaatcatggtgtcagtcctctaagataggacctttaaagtgtagggatagtggtttggttttacacgtgttacacatgttgaatttgaggttcttgttggcggtcaaggcagagaagtccagactggaggtggaagtacaggcctagttctttaggacctactctgggctggagcatcagttgcggccgggcccttgtggtagtaggagctttgggttgaacataagttttcagcaggagtgcgtggagtgaaaagagagatggggttggatttttggtcaactccaactttaagagattcagaggatgtgattcctgaaaaaagaggaaaaaaaagaccaaaaagaatcaaacagaaagatggttgtgaacgttgagaaactggtatcagaacagaaggaagaggtctgcagtacctagctttgacaggcctcatggaggagggggtactgccgatggtcaggcacagaggagaggagcaaagcctgctgggaaaagatcatctgaatgaaatagtatgtggtatttgctttccatccacacatgggcattttccattaaagagtggaaatgtaaaaagatatgttaaaattgacagtgtttctttgtcccttaacatgtgtatactttcagatgttttttaaaaagcactttggcaccttcctattaaagagtctctctaaatcttctctcaagtaaaaggaagcaatcaaaaatgttcattggcttaattaattagtttaatactaattatgagtattatggacttttttcagaagaaaatttggataagatagtctcctatgcttttgatttctacctttatcaaagaacattgctaaaatgagtagatacctgagtcagtcagcatttatttggctacctccttttgccaagcactttacatagattatctcatttaattcccataagctcaataaggtggcaccattatttccattttacaggtgagaaatcaggttcagaggattagcttctacccaaagtcataagaccagatggtggcagagttaagatttgactcatgtttgtgactcagagctcaagattttgtaacaaccttgatactctgtttctcactcagcagcacaacaagggcaaatacgttcctactcccgcagagactagtgtccaatagatacagggaatacatattttattcagtgcacactagttgggaattgtttcctacaaagacatgaaaacaatcttcaaatacttgcagtactgtggtttggggaggcaaaatgatcaaaggtatatattacagggaggcagttctggatataatttaaagaaggagggctttcaacatttagaagctgttggaattaaatgacttgccttgggaggtagtgagttttccttcactggagttatgtggaccaactggctgccctctggtgacaaatacagagggaattcatccattggataggggttaggtactggaattacttgagacctttgtatactttatgatttcaaggtggcagacatgggtcattgtcttaatcagtttgggctactataagaaatatattttagactgggtggcttaaacaacaaacatttagtttccacagttctgaagactgggaagtccaaaattgtggtgcagtcagatctggtgtctggtgagagccagcttcctggtttgcaggcctgctttctgctctcacattggagaacagagggagagaaacacagagagagtgtgtgctctactttctctcttcttataagggcactcatcccatcgtggagaccccaccctcatgacctcatctgaacctaattatctcccaaaggtccacctcctgatagcatctcacggtgagagggatggagccgggaaggtttcaacatgtgaatttgaaagggacacacataatgcagtctgtaacgggtcaaatgtaacctcaataaaatgagtaaattgctacatttgcttgaatttgggacctttttttctttcttttttattttagtaaatgtttttattgataaatgattcacataccataaaattaacattcttaaagtgtaagatttcatggtttttagtatattcagaaggttatgcagccatcactactatctaattccagaaaatttactcatccgccaaagaaactctggacctattagaagtcactccccatttccccaaaccctctagtgcctgacaacctctactgtgggaactttaacttttggctttatttttcacagctctcgtggcattatccttcagtggggctattggactgacttttcttatgctgggatgtgccttagaggattatgggtaagttatcatttcaaaaagaactattcctctttctgtgtctttgtcactattagtatgggtgttagagagttcggtcaatttagcaccaagttctaaccagtgagttagtggagcccagtttatgaacacagtccctttgtgggtcaggtgtacttttgcagagggctctgttaaaaattgatgtattcattccataagcatttgtttaacacctactctggactagctggggacacacaaatgaagagagagtcctgtcctcaaagaggaggtaaagttctagttgtgagtgagagacaggcaaacggtctagtcagtaatctggcagctgcagtggagatgccagcacagtacgctggagctcggataaagtgcacctgagtttcagtgggacagtcagggaaggctgcatggcagaggttgtatctgagccaagactaggtggatgaataagagtttttcagggtgatgagtcaggggaggacattccaggcagagggaacattctacacattttttcattcaaccattgttggttgaatgcttcccatgtgccagctactgttatgggaactagggattaagacataagaaaacaaaggtcctgctctctcagagtttgtgtttcagtgggggagacggacagtaaacaacaaaagtatgcatactgtcagaggtagaaatggtacaaaagatgaagagcacagaagctgggaagacagtggtcagggagggcctctcagaggaggtaaaaagtgagaagaaatgtcaagaaaatcagcaagcaggccatacagatctctagggaaaaagcactttaggcaccaggaaagctgaatgctaaggcccggagacatgaaagtgtatatagccttttcaggaaaccacacatggtacattatggtacagcataaattgtagtggagtggcaaaagaagggttagtcaagagtgtaaaagtcagcacttagggctctatatgcctgccgtgtagaggaggttccattttatacatcagacaatagaacctgggaaaatatcttgagaatgggtttggaggagggggttatgttaaaatgtcattcttgccataacgtgagactagataggaaagagctgagactgcagtcagggagaatagtaggggactactatcataaatcaagcaaaattgagggctggggcagtaggaatggaaagaaaaggagagtgagttaggaaaccaaaccaaccaacaggttttgttcatcgatgtcaggattcaacaaggagggagagttcttagatgtctcccaggtgattggcttgaacaactagatagaagatgatgtgattaggccaggcaccatggctcacgcctgtaatcccagcactttgggaggctgaggcgggcagatcacgaggtcaagagatcgagaccatcctaggcaacatggtgaaaccccatctctactaaaaatacaaaaaattagctgggcgtggtggcacacgcctgtattcccagctacttaggaggctgaggcaggagaattgcttgaacacaggaggtggaggttgtagtgagccaagatcgtgccactgcactctagcctggcgacagagcaagactttgtctccaaaaaaaaaaaaaagatgatgatgatgtggttaagacctattgaagtgagttattatgacagtgatgaattcaaatccatcaccgcagtcctggccaactattacagaaattgtttaaacccaagagggatccagatataagcggtcacttatatttgtttagagccttcacagcaattactttattctagcttttggaatgtaatacggtattattatcctcatttctcgctgggaaaccaaagcccagggtagttaaagacttacccagattgaacagcagtaagtgacagagcccggccgtggtggctcatgcctataatcccagcactttgggaggcaacggtaggaggattgcttgaagccaggagtttgagaccagtctgggcaacaaagtgagaccccattctacaaaaaactaaaataagccaggcatggtgcctgtagcagggttgggaggctgaggtgggaagattggttgagcccaggggttggaggctgcagtgagctgtgatcacaccactgcagtccagcctgggcgacagagtgagactttgtctcttaaataaaaaagtagaaaaaaaattaaaatggcagacatggaaatggagctcatgttctgacgcccttgaccaaacgtttttccactattccacaaccaactgtaaatctaggagttttaattctctgtgatacactgtctttgtaaggtaagaaaatgactcattactgctactacaaataagtttgttttctatctttattttaattttttgttttttagagatgccacaacacccagctgattttttttagaagtttttgtagagaccgagtctctctgtgttgctcaggctggtcttgaactcctggcctcaagtcatcctcctgccttggcctcccaaagctgtatcttgatagtgaaccaggattatcatctatattggaagtcagcaaactgccacatataacctgctacctgtttttgtaataaaggttttattgaaatacagccatgctcatttgtttatgaattatctttggctgcttttgcattgctctgccaattatctttggcagagttgagtagttgagatagtctttatggcttgcagatcctcgttatttactctttggccctttatagaaaaagttggcccacccctggcctatgtatttattgaattgtatatatttaatatttacattttatatataaacaaggtttcttgtacattaatatttctcttagttggatatcggtggcttactatgaatgaaaacatagagtcagattgtttttcacaaaactgtcactgtattccaggaaaaattaagagttcttggctgtggatatgtaaggtgacatatctattccaaaccccttcccctctctgtgtctcctttctcactgttgaaagaagggctttgaagtagagaatgtctaagggctacttcccacaatattgtttggtgattcttgaaacatactatcatccctctagtttaaaatcaggggtccaaatccactgtttccatcctgagtcctcttgaaggacacattcccttcttgccttttggttgcctagatctgtggctggaatgggaggctttcattagtgtggcttcatcccaactcctgcttgtaggtgctgtctgggcgtatctgtgtgattacagtattgtggtgatatgaattattgtagtgtatatataaaaatgagcagagactttttttttcttaagaaatgaagcataagaaatgtctgatggagaaaaaaagattatttttgaagtactgatagagaaaatactgttggaaaccagatggcaattttttttttataattgcaaaatgttgaaatttgggaggaaaacagttttgttttgtttttgcattacactattaattgtgagctcttataatgaagatcaaagtacatctaagcttttcactagtgagcatatttattttcatgccttccgtacttaaaatttatttattattttattcatttaacaagtataaatggagtacatcattctaggccctggagataaatggcgtttgatcaagactaatctatcagatgggaataagtgttgtgcagaaagttcaaagagggtggtatgttcgagggtgacctggggtacattagaatagatgaccagggaaagttctgcttttagaaaggaatctgtcagtttagatcacatggtatgaaggagtcagccaatgagaagatcatggggaaggacattgcaagcagggggcacagctagcgcaaaggccccaggataacagctatgagctcaagagtgttcaagggacagaaaaaaggctggtgtggctacagattaagcaaatgaagggaaaagagtacaaaatgaatggaagaagtagataataccagaccataaaggctttgtaggctagggcaaggaatttagggtttattctaagctcttaaaaggtttcaagcatgcgtgcactcaaaagatctttaccgaactagcttttgcaagacactctactatgttctatagggaaggcagaaatgaccaagttaaaattctgtctttaaagaaattgtggctcagtggtacagaaaacagtaaagtttctagggtatatattatatagtggcttcttaacacaatataagctacctacatagtaattttaaaattatcactacttatctatccctggtagaaatcatcttatgttctaatattcacaattaattaattttttgacctaaacatttaaaatagcaatgattttgaaatagtagtatgtctttcatttaaaatgtaactgttacttttctttttggattttgcctgggtccaactgacagcgtttactggcccttattcgtcctgattttccacgccatctcccccatcccccatttcattgccaaaagagtcacctatgactcagatgcaaccagtagtgcctgtcgggaactggcatatttcttcactactggaattgttgtttctgcctttggatttcctgttattcttgctcgtgtggctgtggtaagttttattttctattgttttgcccaaccgttgctgagtttacttcagaggcctgtgtctgggacctccatttcatgctcattacttaggctttatactcaaggccgtgtgtttttagtttctctgttcctctactttagacctgcctaacagtagttcggccatgccttcagagtgctttctttatttctcttacaacttttagccagacgatatgatttcttactttttctactttaagctattctctggaattgttcttaaattcctgcctcttaaatcttacagtaatccacagatactatgctagcagtacttttctagttgcaagatgaagatatttcaaattcttctcctgcaaatgggatcatggactcaactctcaactcagtataataggtatatgttgagggacaactgtgtagcttccagaaaatgcagtgaataagttgacatcttcacttccaagacaaaaactttctttttgtcttcagagtacacattgtaggtataatttattcaattatttgctattcactgtctttcctactatttgattttattccctccaattacgttctattttaattttatgaaactcttatttgaggcattgaatatcagataagcgcaagtcttgttcattcaataaatatctttgcaacaactgctacttgtaaaacaccagaaataagaaataggtactgtctctgctcctgaggaacacagaaactagcttgctgggtaagtatactataagtgtactaagtgagacggttgaagcatgatcagaatgccataggggcaccaagaagagagaaattccgactggcatttgatatgggcctctaaggataaatagcatttgtattgaggtaggatggctgttgtatggaatgacattcaagtgtaagaatgcagtatatagaataaagaagaatccagtgtggtagagctaaaagaaagttgttgaggttaaggctggaagggttgtgaaacctgattagcaatggtcttgaaccccatgccagtttgatctttgtctagataatggggaaagattgaaggtttttgaatacaacaagattgtcatgactttatttttcttgtgctttagaccagcccttcttaagcgctgcagtaaatatttatattttttcctttcaatactgccatcatattttgtgaagaaactttcattgatgtttctcttgcttaaagtaaaacaaaaaatgcccactagagggtactctcacccccaaatgtgcttctgtaaaaccatctacaaaccatctactaagctggaaagcagttttcagttgtatgaagactattatttaaagtcttttcttgcctagaaaagaaacacacaaatttataactctacaatttttattttccatgaaagaagttgatgtgtgcagaactttcagtacccaatattgtaattgcactatttataatcttaccacttgagttttacttaaggcaatcattgtcaattaaaaacaagtagagaaatatgtctaattgggaacatgttaaggatgataccagacttaattaacaagcatcacagaagtaattagactcattactgaacagttcattgtctcctgttacattattaagccttttagcagctttgtgtaacatttcattggatgtttctaatgcagaaaataatagggattgcaaagagtacaatatgaaggaagtaaggatttaatccttcttttcttgtctttcagatcaaatggggagcctgcggccttgtgttggcaggcaatgcagtcattttccttacaattcaagggtttttccttatatttggaagaggagatgattttagctgggagcagtggtagcactttattctgattacagtgcattgaatttcttagaactcatactatctgtatacatgtgcacatgcggcattttactatgaaatttaatatgctgggttttttaatacctttatatatcatgttcactttaagaaagacttcataagtaggagatgagttttattctcagcaaatagacctgtcaaatttagattatgttactcaaattatgttacttgtttggctgttcatgtagtcacggtgctctcagaaaatatattaacgcagtcttgtaggcagctgccaccttatgcagtgcatcgaaaccttttgcttggggatgtgcttggagaggcagataacgctgaagcaggcctctcatgacccaggaaggccggggtggatccctctttgtgttgtagtccatgctattaaaagtgtggcccacagaccaagagcctcaacatttcctagagccttattagaaatgcagaatctgaagccccactctggacccaggacattttgatgagatccaaaggagttgtatgcacatgaaagtttgagaagcatcatcatagagaagtaaacatcacacccaacttccttatctttccagtggctaaaccacttaacctctctgggtgttacctgctcatttgtttaaaaaaaaaaaaaaagtctcacctgctttcatgctgaggacaagttcagatgttcaagcctataatatttaggcagttcctcaaatttatgaaaagtgttctcagaattgggagacagtcaaagggtacaaagcctcagttaggaggaataagtgtgatttttttttaaagatcacttgcacagcatgctaaatataggaataattgaatgtatatttcaatattgctaagagagtaaatttctaatgttctcataaaaaagttaaatatttgagatcatatgttaattagtgtaatcattccaccttatattcaaaaatcataaaaccgtattgtaccctataaaaatatacaataatttgtcaatatataatcaaaataaaaaacaaaacatactctctcccccaaaaaaacatctcagtggggaacagatgtatcttttcatctgaaagacaatgctgggggaagagctccactgagatgcgggcagggaggctgggctcgagccagcccctgcgttagcaggagggggagaacagataggtaactcttttacatttcctttatgatctggcacttctccccagctccttccctctgccccccacccctactcctcaacagttctggtttgccctgacttctctacggctctggcttcttcccgaagagatataggagccatgtaagcacgcagtgggtgaactgcttaatttcactacgtgttgatgtacttgtcttccgtcctgtaggtcttttctatataactttatgccacccttaaatgaatcattgggtatacctgtcatgttggatcctgtaatcacagttttccctgctcacctttttgtctaagatctattgagaaagggaaatatgggaaggagaaccatttgatcagaatacaaccaatagtctttaagcattgttaaagtatgaaactgaaatacattcaaaacacttaatccttgaggcttgtgatctgagtaattagcaggtatgatgctgggactggaaaatagaaagtaataactaaagggttaatgtgcaacgttattttttggccttgttcatgattttatgttttcagtgtcctgtgtacatatagaattgttaaagttgtcatttccaatatttatattagaaaaattatttagatactttataattttaaccggcatttttaataatgacacttgcatttattgtattgtaataaatttcacttttaactttaaaagtttaactttaaaatttttttgtgatgttgccttgcctgaaaagataacaaaaatgagagaatttcttgatgttttaaaatgggcagttttgagcaataatctgtcctaacagaacagtagcaataagttttaggataccatcttgaatgtctagttggtgtgcaatagcttttctttctaagatggcaataatgattcatttctactacattttgcaaaagtgtttttgttgcttatacacattttcaataaccaaggtagccttcatatgtagccttaaagcattacctcttgattgtatctttagattgatataaagtacttgcatatagagtatttgaagtgatagattattagatttgctctatgtctgaaaagagagctattctgcagtgcctaaatatcatttaaacagtaaatattaataggaaatattgctatatctgaatatataatacaaaagtttgatcatggtgacacaaatgttggacatttttttccttataaaaggctctttttttatatattgtacaatatatttggagattcagagcatagtgactatagtcgaaaactgagattgcacttccaaaattggccacaagtaaataatcttatgaagggattctttatcatgtttcaaacaagtgggttacaagcagactttgagacacttttccacagaaacaatactatgaattggtgattgagttcccaggccaagcctccctcaacaggttcaactctaatatacctaacctgtgatactgaaggtgcctgcctgagttttgggtctctgagacagggtagtgtgagtagtttggaggaaggacagtgcaactttccaccccttttcctaagaacaaggtctttctccttttaatttttccactcattttcacctcctaatgcccttgagatccaggtacactcctgggagttttgttcacctctcccaactgagaaccttcccactgggctccatcctccctcctgaggttcttcatattccagagtcacccacccttctcctcccattagtcagttctctaagtacagctgatgtcatgtggtgctgagaagaaagcagatcacacttcatcacagaaagaatgccttgtgattatcttctccacatctgaaattccttttgacacctgcattgggccgactgccattcccatgactgctgcacctgcgtttttagagaatgcctcataacccactgattctcattcacagagaatgggagaacggaatgaagaaagattccagcagcttatagaaggatagcaatattttgggacagggaaaatcctgtcatacctcatctcttcctcaggaggagttctgagctggtcctgcttttcatagttgtttcttttcttccacttaagaactcatagatttttcttactgtcctaaggaagtccttacctctgaggtatctcctcaatgaatactgttttcaaggctgaaatagttcattatgttaataaccttctttatgttctcagggaaatgcttaggtggtgtcacaaaatgtgccttttcttttctttttttttttttttttttgaggcagagtctcgctctgttgcccaggctggagtgcagtggtgcgatcttggctcactgcaagctccgcctcccgggttcacgccattctcctgcctcagcctcccaaggagctgggactacaggctcccgccaccacgcctggctaatttttttgtatttttagtaaagacgggtttcatcgtgttagccaggatggtctcgatctcctgacctcatgatccgcccgcctctgcctcccaaagtgctgggattacaggcctgagccactgtgcccagccaaaatgtgcctttgcaaagtttgcgaaatcagattttgtatcccaatagaaccaaaatatttatgaggatgctagcattttccaagcatagtaattagttcacaactgagaaatattatgtctgtagtagataaatattagttgtgcattttaatttaattctcctttttccattttgtctcatgaagtaccttattgcaaaaatcccactgagtaatagctcataaattataatctttcaaatagccatgctaccagcgtacaacagtgatacatgtaaccccaaatgtgatgtgagaggacgattactttgtaaataaaacttgttattgacattttaacaaaggcttttatgtacattattaaatgaaaaagtttatattttactttgcggtacgttacatttggaaaggagatcagcaagttaattttcccagtgtttttgtctgtataatcttaatgtgaatctgaccagtttgaagcctgtacttgctgtagttgaagagaaacagttcaggaatgttgtgctgactggaaggaatccaggccttaatttctgtggctgacactccccatggtggacatggaagattggaaaagctgtattggaaaagaaaaaaacctgacaccttaagaaaagtgctctacatattttgaagagtctttttgcacactacagaaaagaatgcactaatagaaagtagtctttaaggaataatatgtcctccttatgcacaaaacatttgggaaagatctgatgttttactagtggatttaggcagccagattgtaaagaaatcaagctagttatttctttgcattgccaagctaagtgtaaagttaaacttttaatagaaatagaaataaaaatttgataataccaacataactataaaatggccataagaaaagtcagttcccaaggaaaattaatagatgaccattttgaaacatttatttgtggtcaatacgaggcacataggcaaagtggtcttaatcctgagattgctcatttggagaagagcacacttggagactgcacaatctctcttcacttttgattatatctttatcaaaattgaataattctaagtgtttacacacttcggaatgaatgactagatattaacttaagtgtgtgcattcatttttcccctcagaataattaaataataaaaccatcagttcaactttagctggataatcattgcacttatcaatttaaagcataaatgcctctgcctcaacactttcatttcctctgtggttgagagacaaattatatcaccacactctgtaaagtttcatgatttcttacagccttctcctcaaaattgtatgcttgttcatctgacaaacccagaattctccagtacttccaaccatccctgctgcagccttgccatttgtggttccttgacagtgctgctgttaaaatccacttaaccactgatggaaatgagttacgtgagttctgaacacaggttttaatcggattcctgattaaattaatggcagtgagtcttaggcttgatttattcaagattccatggtgtggaactgacagttgctcagctctttaataaaatcatgtatatatgtatatattttgagatggtatctcagtatgttgcccaggctccctgggctcaagctatcctcctgcctcaacctcgtaagtagctagtacttctgctggaaacatgcaaatgtccattaactgatgaatggataatgtgatatatccattcaatggaatgtttttcagacataaaaaggaatgaagtactgaaacattgctacagtgtggatgaatcttgaagacaatatgtgaagtgaaaagagccagtcacaaaaggccataaaaggtcacaaaaggctgaggcaggagaatcctgaacccgaaaggcggaggttgcagtgagccgagatcgcgccactgcactctagcctaggcgacagagggagaccccgtctccaaaaaaagtttatatttcagtgtaagtagaaaaaaactaggtaaataaagtatatgatacggtaggcgctactggaaaaaatatagtggggaaggaggataagtagtatttgggtcattgtggttttagatagggtggccatgaaagcctcacccaaaagaggcaaagaaaagagccatgtggattttagggtctccttctgttgcccaggctagagtgcagtggcaagatatggctcactgcaaaccttaacctgagcgcaagggttcctcccacttctacctcctgagtagctgggattacaggcacgggccaccgcagctggctaagttatttattttttgtagagatgaagtttccctacattgaccaggctgctctccaaccctggcctcaagcaatcttcttgcctgtctcagcctcccaaaatgctgggattactggtatgggccatggctcctagccgcctttttttttttttttttttttcaaaaaatattccaactgaggtttggcatttattgcttgagaaataaataatataaataaaatagcttgatttaggaaatgaagttgtgctagctggaacactggccaggttatggccacgataaagaagagaccagccgggcacggtggctcacgcctgtaatcccagcactttgggaggccgaggtgggcagattacgaggtcaagagatcaagaccatcctgaccaacatggtgaaaccccgtctctactaaaaatacaacagttagcagggcgtggtggctcacgcgtgtagtcccagctactcaggaggatgaggcaggagaactgcttgaacctggtaggcggaggttgcagtgagccaagattgcaccactgcactccaacctggcgacagagcgagactctgtctcaaaaaaaaaaaaaaaaaaaaaaaagacagttgagctagagagtaaataaagtggcccctaatacagtgggtatagattcatgaagtggcagtagctgaactgtagctactgttaactttgaggactaattaagacaatgtcaggaaaattttctttttcttttttctttttttctactctgtgtttcttcattatctgaatttatcctcatgcaggttggaaactgctgaaagcagtccatttttatgagctcttttattctaagccaaatcagtcagattacaaaccccattgtattttagataacccaagtgattattcaggtgctcaaaagcttttagagaactgctaaacctcatgtacttctgggcagtatcagcaattaaaagagtttaattttctaggtgaaactgattctggtttggatttctttatttggactgagagatattttaaccaggttaaaatattggtgcaaagccatctctgatgagacttaaaatcataaagctacttccccatgcagttcttgtcaccatttcagggtactgctgggcaataggacatgagttcccattgcttgtgggatcttcagatgtatatccctccagtgaattggactcagtattgttgagacatcaattttccgcaacatgatttatagattgaaagcaatcacagtaaaaatcccggtaagatttttaggagaaattaatatattccctgatttctaacttattacaaagttatacattagacaatgcgatattggagaaaggacacccatataaatcaattgaatagaatcaataattcagaaatagacccaaaaatatatggtcaaatgatttttgatgttaaggaaaaaataaaaacattttaagctgaggagatacaggacaaattatttgccctcatggagcttaccttcaaatgggcaagacaaataatttttaaagtaaaaaataattcaatagtgaaatttgggctgggtgcaatggctcatgcctgtaatcccagcactttggaaggctgaggcaggtggatcatctgaggtcaggagttcaagaccagcctggccaacctggtgaaaccctgtctctactaaaaatacaaaaaattagctgggtgtggtggcagatgcctgtaatcccagctactcaggaggctgaggcaggagaatcacttgaacccaggaatcacttgaaggcagaggttgcagtgagccgagatcatgccattgcactccagcctgggcaacaagagtgaaactccatctcaaaaaaaaaaaaaaaaaaaagctgggcgcagtggcgtgtgcctgtaatcccagctcctagctactcaggaggctgaggcaggagactaacttgaacccggaggcggaggttgcagtgagccaagatcgcaccactgcactccagcctgggcgaggaagagagattctgtctcaaaaaaaaaaaaaaaaaaaaaaaagaaaaagaaaattgacagtagtgaatgctatgaagaaataaatcaggataaaggcatagagaatgacttacagtggtgctatttaaatagggtggatagagacgattggtggctgaatagagctattgaataatgagaaggaatcaacacgatgggacctatttttaggtctactctttcgattctttttaattttaggtctactctttcacttattctttcaagaaatatttgttgagcacctattatgtgctcaacataattatattattctaggtgctggagatagaacagtaaataaaacagacaaaacccccagcccccatggtgcttactttttttttttttggtagggaagcaaaaaataaacttcacaaataagtcaaatggatggtatgttagtggaaatgctaaggcaaaaaaaggaagaaagggatgtagaatatgtgtgagtgtgcgtgtgggcgtgaacgggtgacggtggcttctgtttaagatacagtgcccaagaaaggcttacctagaagatgacgtttgaaggaagtagaggcagttatggaggcggcaatgggcaagatggttcaaaaagagggataagcaagtgcagcggccctgagctggagcgtacctgtgagctggcatgaagccttcagggagagtggagggagataagataatgtgtgtgtaggggtggatggatcctatggggcccagcaggtcattgtaaggcgtcggcattcatttagagatgagacgccactagagatatgagcaggagtggcctgattatgttttattcggattgctctagctgtgttttaattaaaactattttataaagagaggaaaaaacaattttgcttttccaaatcaatcatgtttatgtctttgaaagaggagaacaacaaatcacagaaaacataaataaatgcattttgttcagggacagatggctgaagcaacgagagtgaatcacagagtcacagaatcacagttatgtgcaaagcactcaggaaatagcttggtccctaattaatcattccatgttgttaaactctgtggagataaatttagccagcagtaggtagaatgagatgaattctcatgaaaacatgttttcaatgaagttggcaaagaatgctgtgtaaaccccaaatagctgaaactatgtcctaatagcattgagcttggtgtgccacatccttagcaataaccacttgagtgtctgtccctggggcctgcagatgaggatgttaacatctgatttagcagaaggggtggggagagtgatgggggacaagggagagagtcctgaaacatacaggtggtgaccctaggagctgactttggtgccatttaggcatatttgctttcaggactcacacttccttaggtttaagctatcaataaaaggaaagtggtttctaagtcctagcctttggactgtattcctttaattcatatagtggagcagggggaaagttatcattttaatggctggtagcacaattccgagaagaaaacttttttgtttatttaatcttagataagccatttgagtgttaagagctatggcccacgacagggaagggatttgaaatgttttagataataaagtgaggagaatttgggatttgcatcagaatgacgaaggggaagtgggggaggggtgatacactaacaccagtggagaagaaatccagggaaaaggtgacagaaatcctggccactgaagggctggagcctgaggctaaaacagtgccagggagaccctctggggtgacagcctaagaatttttgataacaaggatattggcagagcagtggtgaaaccctctccccttttcccattgcttctccctcctttgccccagattcccactcaaagcctgtgatacatactgttgttcactgtggtgttcaggtatactgaggggtaggagagtgaagaaaaggagaatggtttgcaagtggggttaatgtgggctgagagagaagaggacagcaaagaggcgtgagacacagggtaaagaaagcattcagagtaaaatggaccaagaggtgagtaggagaataagttaccccaaatgcctcagaaatatttgttgggaggactctgctatatgagacttaagccctttttaaaaaaataaaataaaatgaaaaggtgattcccaaaaggttggtgccttatgaggcttcatctgcataggatccctggtttcacaactccttatcttgaccagactttctattgattccaggtctttagacaataacttaattctttcaaccaactgtcaatcagaaaatctttgaatccacctatgacctatgacccctcccctactccaccccactgatttgagtttgtcctgccttttccaactaaactagtatatatcccacatgtattgattaatatcttttgtctccctaaatgtataaaaaccaagctataacccaaccaccttgggcacatgttctcaggatctcttgagactgtaccttgggccttggtcatttatatttgactcagaataaacctctttaaatattttacagagtctgactcttttcatcaacagctggaatatttgtttcttgatctaatgatgattacacagcagttttaagtttgtgcaagtttatttggttttatacttacaatatatacactcaataaaatatgatatacctcaataaaaataaagcaatgccttccctgcctccaaaaacaaaaccaacctgggaatacaaagatcaaataacagtgcctgcagaagcttagaaaatcggcacagatgtgacatttgactcagttcagcacacattatggagggttactatacaagggagactgcacacagagaccatactcaggagcctgaggatcctgaatcactgacctagagggaagaagtaccagcccctatcttgaggacctcatattacaaggcagtaatagacatgcaaaaattaatagcaacagtctgattctggcaattggctgatatgccaactcttaccacttttcaacattgtgctagatatgtaagtggcagaaagactgaaaaggaataaacagattattatttgcattctatgctcttatttacttagaaaatccaggagaatctatacactattagaaaaaaattacacttataaaacttactagataaaagatcagtatcaaaaaaatcaattgctttcctaaacaccagtactaactaattagaaaatgcactgggcacagtggcttaagccaataatcccagcattttgggaggctgaggtgggaggatcacttgagcccaggagttcgagacctgcctgagcaacatagcaagaccctgtctctgaaaatgcaattttccaaattttcaataggaacaattacataaatgattataatatatatatataattttatatatacacatctatatctgatgttataaagatgtgcaatacttggagaaaaatttcaaaaattttttgctgggtatataagctctaaatatataaaaagatatactatatttaaatactaagggataaagtattaagcattcaatgaatactggaaaaatgattggatgagttcatattggacagagccacatctcggtcttcttttggaatcctttcttcatatagtacctagaatagtgcctgacactgtgggaaaccaaaatatgtcacctcaaaatatacttctttggcgtattttcagttggttattcagagaagtagcagacaggaatagttctgaaaagctgttcttttgggggtagatttgcatctgtagaggaaatctgcattggtgaggtaaagaacagacacagaggctttctctgaggtccacctatctggatcaggaaaaaggaactcaataagaaaaggagactaaagacctgatactttttttttttttttttttttatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgttaagacctgatacttttaaagtttggacagtgaaacttttgctgcatctcttccttctgagggctgctcccagagagacttcatctgcatcacaagacagcctttgctcaccatgcctttcctccccacaccctctcataatgtgttgctacctccctgcaggagcctttaggaccctatttctttctgtagcttaaaatgctattgaagcttcaactatctggcccttctttgattcttcgagtctcgtagtttgtgtggctcctgtgcacatgtgcatgtgataaatgtgtatactttgtctcccatgaatctggctattgtcagtttcttttatagactcagattaacaaactttcagaagggtggaggcgggcggggggtggggtggggagggaaatccctttgctcctacagcaaagtagtagggactcaaaaaatatcgaagagaagaaaacaaaggagaggaaaggaggaagggatgaataactttatttaaatgagaaaagtggcactgagttaaaaattattaaatattttgaattctttatgttattacaatttttacttttgctaacatcctcttgctttattgttgtaataatgtgtgctcatatagtcattaagagtttacaaaactgtgtcaattaggtccatataacaatgaaaaagcagcagcatcactggaaaatctcgaggctcttcaaggttaaggggcttgccttagatgacaaataacctgactgttactcagacccaagttttttgacttcaagggcagcgactttgtactctacagatgccaatctaaatgggctgcaagctagatgtgtaggctatggattgccatcctaattgggacacttttgagagcagaagtaggtgttatccattatgttgggacaataggtgtaaattggtaccatcttgggtacatccaaggtacagtttaccttatctatggctgaaaactgagtttaaattaattcttcttacgggcagcacaagtcaaaaagccctttgccaagctgcacagattgtaaatgctgctcctggctgtgttcaatgtatatttggacaaagtcaataataaataaataaaggtcaactatgaattaaggtaggtttgttagtttgttttttggtaaaaggaatgtcacttgcttagagaggttaatatactgcatgtggggcaaagttgctggtaagtatcattcttccttctgtccttcgaaccccaaatgacacatcttgttcacgtatccactatggtgtaagacatcactgggtgctggctgtaattttatcttccttcttaaagtctttataacgtgaagataatgagtggatctgtgcgaaactcactaccaggatcagccaatacttgtttttctgtggagcttttggtgattactttaactgaatagagttttttttttttaaacagcaaatctttcaatgtattagcaattttaagtaagaatctctaacttgtaacacacactgaacttagagttttgttttttttctacacatgccatttctgcaagtgaacttaagaaatttcaactaatatagaagacttaatcaattctcaattacatgttgtaaattaacctgctaacaggaacaggtgaaactctcttaacattttaaggacataaagtaatcaaatatgcagatttaacacaaaaccattaatattatggggttcttttcaatatttctatgcttaattttaaatcttttttaggataaaattgttttccaactaagaaaagtattgtcatcctattttgtgagataccactaagtcaaatgagattgcgtaatgaccagagatattattagttgaggtgctgactgtatttttatctgatataccaatgagtcttttcacttgggtaaatatgtaggagctggatttctgagttgaatggtaagtctgtttttaactttgtactaaactgggattttgttttccaaagtggctgtacaattttgcattccaaccaacaatgtatgagagtcctagttctgcatgctcatcagtaaatagaattgtcagttgttaaattttagccattctaatagttcctacccttttttagaccatatagggtaatgacattgccatggcatctgtaaactgtcatggcgctagtgggagtgtcttttggtatgctaatacattataattagtgtataatgagcaatgatatcgaacagaggtcactttcattgccatgtgggtttgggtgggttttggccagcttctttactgcaacctgttttatcagcgaggtcccttctgactaatgatgttaagaatcttttaatgtacttatttataatctttctatcttcagtaaaatgtctatagaaattattggtccatttctttattgagttgtgtgatttcttaatactgagttttgaaagatctttatatattctgaactcaaggctttattgtatatctcatttgcaaatatttatccagtgcatggctggtcttttaattttctttttcttttttctttttcctaactgctagatgatgtgggagtcttttcaaatccttagcatctttggaagagcagaagtttaaatttttgataaaatctaatttatcttttttgagacagggtctcactctgtcactcaggctggagtgcagtggcacaatcatggctcactgcagcctcaaccttcagggctcaggtgatcctctcacctcagcctcctgagtagctgggactacaggtgcccaccaccatgcctggctaatttttgtattgtgtgtagagacaggatttcgccatgttgcccaggctggtctcaaactcctgggctcatgtgatccacctgcctcagcctcccaaagtgctaggattaaatttatcatcttttttttttcttggatggatcatagttttggcatcttcttagaaatctttgcctaatgtcgtgatgattttctcctatgttttcttcaaagttttatagtttaaaattttagatttaggtctgtaatacatttgagttaattttttgtaaagggtatgagtgatcaatcaaggccctccctccttcctttccttccttccttgtatattgaaatccaattattccagcaccatctgttgagtcttcctattcatgaacagggactgtctctccatttatttagtttctatttgatttctttcattagagttctatagttttcctcatatagatcttgtacataatttgttggatttataccgaagtagtttggttttgggggtgctggtataaatggtattgtgatttttcttttctttttttttttttttgatacagggtctcaccctctcacccaggctggagtgcaatggtgcaatcttggctcacttgtaactttggcctcctgggctcaggtgatcttcccacctcagccccttgagtacctgggactacaggtgtgcaccaccatacctggctaatttttttgtatttttgttttgcagatatgggtttttgccatgttgcccagactggtctcaagctcctgggccccaagtgatttcattcacctcagcctcctaaagtgctgtattgtgtttttaatttcaaattccacttgttcattgctcatacataggaaagtgattgacttttgtatattaatcttgctctagttacttattagttccaggagtctgttgtttattcttttggattttctacatgaacaactatgtcttctgtgaacaaagacagtaatatatattccttccagatccatgtacctttcatttcatgttcttatcccagtattatctaggatttccaatatgatgttgaaaaggagtggtgagagggaacatccttatcttgctcttgatcttggtgagaaagcctcatgcttcttatcattaagtatgatgttagctgcaggttttttgtagacattctttatgaagttgaggaagatccactccattcctagtttactgacagcttttatcatgaatgtgtgttggagtttgtcaaaagctttttctgcatatattaatatgattatgtgatttttttcctttagcctgttgatgtagtgaattttacattaattgatttttgaatgttaaaccagctttgcatatctgggatgaattccacttgctcatggtgtataattctttttatacattgttagattcaatttgctaatatcttgttgaggattttgcatccgtgttcatgaaagatattggatctgtagtctttttatgtaatgtctttgtctggttttggtaataaggtaatgctggcctcatagaatgagtggggaagtattccctctgcttctgtcttctaaaagagattgtagagagttggtataatttcttccttaaatgtttggtagatattaccagtgaaactatctaggccttgtgctttctgttttggaaggttattatttattaattcaatttctttaataaatattggcctactcagattatttattgattcttgtgtgagttttggcagattatgtctttcaaaaaattggtccatttcatctaggttatcaaattaaatttgtggtcataaagttgttcatagttgtccattattatcccgttagtgtccgtgggatctgtaatgatgttccctctatcctttcttgctttgttgttgttgttgtttttgagatggagtcttggtctgtcgcccaggctggagtgcagtggtgctatcttggctcactgcaacctccacctcccaggttcaaacgactctcttgcctcaacctccccagtagctgggattacaggtgcccaccaccaagcccagctaatttttgtatttttagtagagctagggtttcactatattggtcaggctggtctcgaactcctaacctctagcgatccacctgccttggcctcccaaaggcgtaagccactgcacctggcctcatttctgatattaggaatttgtgtcatctttttgtttttcttggttatcctagctagaggcttagtggttttatttatcttttttttttttttttttgctgaggttttattttggaaaaaaagagcaattgaattgttttgtagctggagagtgcctcaggcagtgaactcctcctggggatgggctgagggcaagggctaagcctcaggtgggtctcctgttccctgtgctcccctgcacagctgcctccctctcggaccctggggcagccgcaggaagggtaggctgggaggggctgccatggctgttcacttgggcaggacatcagaggactcgaacaccagcctcccatcacaggtcttgattttcttcacaactacagccctggtggagctgctgcagctgaaggagctggagcctgtgccagagccaaagctggagcccagcttccctccggcaactacctgtaggtggcaatctccatgtccagggcctatttatcttttttttttttttaaatagcttttagtttcattgattttttttctattgattttctgttttcaatttcattgatttctgctttcatttttattatttcttattctttctttagaattaatttgttcctcttttttctagttttttaaggtgaaagcctagatgattgattttatatctttcttcctttctaatatatacatttaatggcataaatgttcatctaagcactgtttttactgtatcccacaaattttgaaaagtcatgcttttattttcatttagttaaaaataattttaaatttctctgagatttctcttgtgacccatgtgttattttgaagtgtgttgtttaatctccatgtattttggaattgtccggttgtgtttccgttattaaatttttagtttaattctattgtggtttgagagcagatgttgttttaaatttgctaaggtgtgttttatggcccagaatgtggtctatcttgctaaatgttccatgtgaactggagaagaaaatgttttctgcaaaagttggatgaagtagtccatagattttttttttgttccagattaaatgcttttttaaaaaatttattattattatactttaagttatagggtacatgtgcacattgtgcaggttagttacatatgtatacatgtgccatgctggtgcgctgcacccactaactcgtcatctagcattaggtatatctcccaatgctatccctcccccctcccaccaccccacaacagtccccagagtgtgatgttccccttcctgtgtccatgtgttctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatacacccagtaatgggatggctgggtcaaatgatatttctagttctagatccctgaggaatcgccacactgacttccacaatggttgaactagtttacagtcccaccaacagtgtaaaagcattcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaattactttgagttcattgtagattctggatattagccctttggcagatgagtaggttgcgaaaattttctctcattttgtaggttgcctgttcactctgatggtggtttcttttgctgtgcagaagctctttagtttaattagatcccatttgtcaattttggcttttgttgccattgctcttggtgttttagacatgaagtccttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctacatatggctagccagttttcccagtaccatttattaaatagggaatcctttccccattgcttgtttttctcaggtttgtcaaagatcagatagttgtagatatgcagcattatttctgagggctctgttctgttccactgatctatatctctgttttggtaccagtaccgtgctgttttggttactgtagccttgtagtatagtttgaagtcaggtagagtgatgcctccagctttgttcttttggcttaggattgacttggtgatgcgggctcttttttggttccatatgaactttaaagtagttttttccaattctgtgaagaaagtcattggtagcttgatgggtatggcattgaatctgtaaattaccttgggcggtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctgtctgtttgtctgttattggtgtataagaatgcttgtgatttttgtacattgattttgtatcctgagactttgctgaagttgcttatcaatttaaggagattttgggctgagacaatggggttttctagatatacaatcctgtcgtctgcaaacagggacaatttgactacctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaatgccttttctgcatctattgagataatcatgtggtatttgtctttggttctatttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctctttttttgttgtgtctctgcccggctttggtatcaggatgatgctggcctcataaaatgagttagggaggattccctctttttctattgattggagtagtttcagaaggaatggtaccagttcctccttgtacctctggtagaattcggctgtgaatccatctggtcctggattctttttggttggtaagctattgattgttgccacaatttcagatcctgttattggtgtattcagagattcaacttcttcctggtttagtcttgggagagtgtatatgtcgaggaatttatccatttcttctagattttctagtttatttgcatagaggtgtttgtagtattctctgatggtagtttgtatttctgtgggattggtggtgatatcccctttatcattttttattgcgtctattagattcttctctctttttttctttattagtcttgttagcagtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttctctaattcttttaattgtgatgttagggtgtcaattttggatctttcctgctttctcttgtgggcatttagtgctatacatttccctcgacgcactgctttgaatgcatcccagagattctggtatgttgtgtctttgttctcgttggtttcaaagaacatctttatttctgccttcattttgttatgtacccagtagtcattcaggagcaggttgttcagtttccatgtagttgagcggttttgagtgagattcttaatcctgcgttctagtttgactgcactgtggtctgacagacagtttgttataatttctgttcttttacatttgctgaggagagctttacttccaagtatgtggtcaattttggaataggtgtggtgtggtgctgaaaaaaaatgtatattctgttgatttggggtggagagttctgttagatgtctattaggtccgcttggtgcagagctgagttcaattcctgggtatccttgttgactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaagatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactccgtatccaatttgccagtctgtgtcttttaattggaacgtttagtccatttacatttaaagttaatattgttatgtgtgaatctgatcctgtcattatgatgttagctggttcttttgctcgttagttcatgcagtttcttcgtagtctcgatggtctttacattttggcatgattttgcagcggctggtaccggttgttcctttccatgtttagcgctttcttcaggagctcatttagggcaggcctggtggtgacaaaatctctcagcatttgcttgtctgtaaagtattttatttccccttcacttatgaaacttagtttggctggatatgaaattctgggttgaaaattcttttctttaagaatgttgaatattggcccccactctcttctggcttgtagggtttctgccgagagatccactgttagtctgatgggcttccctttgtgggtaacccaacctttctctctggctgcccttaacattttttccttcatttcaactttggtgaatctgacaattatgtgtcttggagttgctcttctcgaggagtatctttgtggcgttctctgtatttcctgaatctgaatgttagcctgccttgctagattggggaagttctcctggatgatatcctgcagagtgttttccaacttggttccattctccccgtcactttcaggtacaccaatcagacgtagatttggtcttttcacatagttccatatttcttggaggctttgctcgtttctttttattcttttttctctaaacttcccttctcacttcatttcattcacttcatcttccatcgctgataccctttcttccagttgatcgcatcggctcctgaggcttctgccttcttcacgtagttctcaagccttggttttcagctccatcagctcctttaagcacttctctgtattggttattctagttatgcattcttctaaacttttttcaaagttttcaacttctttgcctttggtttgaatttcctcccgtagctcgtagtaatttgatcgtctgaagccttcttctctcagctcgtcgaagtcattctctgtccagctttgttccgttgctggtgaagaactgcattcctttggaggaggagaggtgctctgctgtttagagttcccagtttttctgctctgtttttccccatctttgtggttttatgtacttttggtctttgatgatggtgatgtacagatgggtttttggtgtggatgtcctttctgtttgttagttttccttctaacagacaggaccctcagctgcaggtctgttggagtacccggccatgtgaggtgtcagtctgcccctgctggggggtgcctcccagttaggctgctcgggggtcaggggtcagggacccacttgaggaggcagtctgtccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctctttgagctgtggtgggctccacccagttcgagcttcctggctgctttgtttacctaatcaagcctggacaatggtgggcgcccctcccccagccttgctgccgccttgcagtttgatctcagactgctgtgctagcaatcagtgagactccgtgggcataggaccctccgagccaggtgcagggtataatctcctggtgcgccattttttaagcccgtcggaaaagcacagtattcgggtgggagtgacccgattttccaggtgccatctgtcacccctttctttgactaggaaaggaaactccctgaccccttgcgcttcccgagtgaggcaatgcctcgcccagcttcggctcgtgcacggtgcgcgcacccattgacctgcgcccactgtctggcactccctagtgagatgaacctggtacctcagatggaaatgcagaaatcacccgtcttctgcgtggctcacgctgggagctgtagaccagagctgttcctattcggccatcttggctcctccccccatagatgttaattatatccagttaattgatggtgttgttgagttcaactttgtccttactggttttatgcctgctggatctgtccatttctgacagaggagtattcaggtctccaactacaatcatggattcatctatttctctttgcagttctgatgtttttgcctctcattttaatgtatgtggttaggcacatacatattaaggattgtatatcttcttagagaacagacctctttattgctatgtaatgcccctctttgtccctgataactatttttgctttgaagtctgctcttaatgaaattaatagaggtactcttgttttcttttgattagtgttagtatggtatatctttatccatttgtttttaatctatactgtctatttttaaagctggttaattgtagacaacatatacttgggtctggtttcttcatccactccaacagtctctgtctttgattggtgcattagaccactgacatgcaaagtgattattgatatagtgggattaatacctactctatttgttagatttttatttgttgcccttgttctttgaccctgtttttgtcttccactctttttctgtcttttgtatttttaattaaatactttacatggttccattttctctgttatacttttttccatatctattgtatctgtttatttaaacattttttagtgtttgccctaaaatatgcagtatacatttgcaagaatccaatccttcaaataacactatactgcttcatgggtagtgtttttagtaacaaagtaacccaattctttcctcctatcccttgtgtcaatgctgttattcattttacttatatgtaagcatacataagcatatagatacacataagatatatacataagcatatataacctaatacgttattgctattactattttgaaaactgttacatcttagatcagttaagaataagaaaaatagaagtttttaatttttccttcactttcttctccttctgtattcatattatgcatatgtttatattttgtagttgtttcacagttcttgaatatgctgtcctgctttttctagtctttattctctttgcttttcagttttggaggtttctactgatagatccccagtctcagaaattctttcctcagccacgttcactctactaataagccatcaaagccattcttcatgtctattacatggttcaaaaaaattgtttatatagatgtatggggtacaggtgcaattttgttacacgcatactggtcaagtcagggcttttatggtatttatcaccagaataacatacattgtacctattaagtaatttctcctcacctgccctctcacctcttcccctttctgagtcttcattgtctataattccactctttagctccatgtgtccaccttttttctcagcatccacttacagtgtttacagtgttctcatgtttctttgtttcttttctttttaaatttcgagacaggctacaacagaatccaaatccataggtaaagcaaactactcatgtaatttcaaagctgaagttgatagtatatttgtacccaatatgaatggttcacctgcatgagttttgagttctcaaaggccagtagcctcctttcccttttatgcatcttgagtacacttgagttagcctatgatacatgaatacctacaaagttgaggcctataaaacttacatggcaagcaatttgaaatgtgccaacaatgtgatactggagcaaccatagtgctgagaacagctttgactactgcaggaaatccacaaacctcaaatttagatgaaaacatttttgaacttaattcatactgagggacaaattatggtaatagtggagggaaagtctttttatgtgagatacaggaggctcctttagctctttcacctcctagagtcaccatagtggtaccttcatttattccttctcaaatattcctcccatcttcatttagatctgagtttcaggcctatattattttccctctttctgaagaactcttgacatttctttcaaggcatgtttactgacaacaaagtccctcaattttcatttgagaaaatctttgtttcccttttgaatgaaaattttgctggatacagaattctaaattggtgatttatttctttcaacactttattttactctaccttattcttgtttgagtcgtttttgaagagaattccaacgtaatacttatccttgttcctccagtaggtaaggggtttttgttttgtttttgtttttttgccttcctatagcttctttaaggattttcttttgtctttgattttctgcagtttatgtatgatattcctgggtgtagatatttcttggtatttttcctgcttggcattgtgtgagcttcctgaatctttggtttggtgtctgctattaattttggaaaattctcagccaatgtttctttattttttctgttcctttttttctcctccttttgttagtcccattatacctttattatccttctgtaagtgttccacagttcttggatatttgcaccatttcttttcagtctttcttctctttgctttgcaatttggcagtttctattaacatatttgcaaactcaacaattcttatctcagccatatccagtctactgctgagtccatcaaaggcactcttcatttctgtgagacagacataatctataggtgaaaggaactgatgtaaatacacctttagtgtgagattttatgcttatctggctaagagctctgcatgtattcctgtctgtctcccaaagtgtagaaagattttttttgttgttcagtttctcttaggacaacaggtcgttgtccacagtatgtgactcagcacccttggatgatgaagttggctaagatgttggcaggcagagaatcacccatggtgttgccagtggtagttaccgagaagccagctggggtgctactgaattctctggggagctgacctctgagagttgcccttcagggtgctggaaagactagctgggaagtgtacctgtgaggacaatcctgaaactcacttggaagctgccctatggtatgctggccaaactcactagaaagccacccttaggagtgccagcaaagctcactggggaggcatcttctacctatctcacatgccactggcagctatgtgcagcaagaacaaaccaaaaaagcactcaaatcaggaagtggagctccttcttccctcagcatctttctaatgccctctactggcaaagcttaccattgtccaactaacaaagggaaatgttcacaggatccagctctgccatcccaacccaggacaaagaagcgtgaatttataactcaaatgtaataaattaataactggcagaactgcccattacacataggatatattccaattctttgccagcacctataatgatttactctctacctatttcttcaacattattggaggtccaccctgcctactttccaccattttagccattctctgttatttgcacactccaagctcatcttacctcagaacctttgcccttgctatactccatgcttggaacaagtttcccctatatctttatataactagctctctattaatatttgggtctttgttaaatgtgacctcatttgaataatctaaaatgagcccacatgcctataataccttctgttgttttgctgtttagttttcttcacggtacttatcactaaattatccttttttttttttttactatgttcttatccacatagtaataagccaagtaagagccagaccataatctatattacatatcagcaataagaagagtacccggcaagtagtaagtgctcataaaaaatactatatagttgttgaatgaatgagtgatctctgttttatagctgaggactgaagctcagagagagaaagtaactttcccaaagaacacagctagcaagtgccagagtcaggagtcacctcaggtcctcctgatcacagtgctctgattgtcatggctctgtaccaccacctccctgagtgctggaaagagtgtagctgaggtacatgttacagtggagtctctaaaataattgagcttttgttatctcattacccatttttttctttctatggatctggctctctactgtgtgtgcatagatacagatccatgtactcgtgccccctactcagaataataatgtgttaaatatctttcaaagaaagaattattagacaaagtcatggaactcttcaccaaaaagatgaccttcaagaggggccatgcgcgatggctcacgcttggaatcctggcagtttgggaggccgttcgagaccagcctggccaacatggtgaaaccccgtctctactaaaaatacaaaaattagccgggcttggtggtgtgcacctgtagtcccaactacaggagaatcgctttcacccgggagactgaggttgcagtgagccaagactgtgccactgcactctggtctgggtgacagagtgacactctgtctcaaaacaaaaacaaaaacagaaacaaaaacaaaacctttgaaatactttgtaaaattagaaattgggtattgagaaaaataaaaatacatcaaatggaagacaggaacctagatcccatttttttcttttctttcttttctttttttttttttttgatggagtctaactctgttgcccaggccagagtgcaatggtggaatcttggctcactgcaacctccgtctcctgggttcaagcaattctcctgtctcagcctcccgagtaagtgggattacaggcgcccgccaccatgcctgccaaattttgtatttttagtaaagatggggttttaccatgttggccaggccagtctccaactcctggcctcaagatatccgcctgcctcggcctcccaaagtgctgggattacaggcgtgagccaccatgcctggccccagatccagttgtctaataccattcttcagtaaaataaaccagggctcttaggagaagtggtcaattctagcactggggcaggaaatacaaacataggcctaaggtaccagggcataaggaagtgttcagaaaacaaaaaaatcacacaacgatggggatatgttaaaaggaactgtagccagagaagggttcctaatggctgaagacagaaaaacttgagcaacaaagtcaacaaaatagtattggattataaagtataaataaatatccacgagtctgtccatactgatacaaataaatgattgaataaataaacaagtagtggagaataggtggatctcccatacagaagaatcccaaaaaatttatgtagatactctgtcctcaaggaggtagagcataattccacattcaagtgtgggttgcgcatactgacttccttcaaaataatacagttatggagagaggaaaaactaacttcatagtggaaaaatctgacaaaccccacctcagccaggggatcaaggtcagcatcaatggtatatatttttgatatgatgtgataagaaaggcatattatttccatagtcttcctcagcaaaccccaaacatcagcctaatcgtgaaaaaatcatcaggcatctcccagttgaagggccttctataaaatacctggccaatactccccaaatctgttaaggtcttagaaactgttttttaaaattattattatacattaagttctagggtacacgtgcacaatgtgcaggtttgttacgtaggtatacatgtgccatgttgttttgctgcacccatcaactcgtcatttacattaggcattactaattagggttactaatgctatccctctcccatccccccacccgccaacaggccccaatgtgtgatgttccctgccctgtgtccatgtgttcttgttcaactcccacctatgagtgagaacatgcggtgtttggttttctgtccttgtggtggtttgcttaaaatgatggtttccagcttcatccatgtccctgcaaacgacacgaactcatcctttttatggctgcatagtattctatgatgtgtatatgtgctacattttcttaatccgttctatcattgatagacatttgggttggttccaagtctttgctattgtgaatagtgctgcaataaacatacatgtgcatgtgtctttgtagtagcaagatttataatcctttgggtatatacccagtaatgggaccactgggtcaaatggtatttctagttctagatccttgaggaatcgccacactgtcttccacaatggttgaactaatttacactcccaccaacagtgtaaaagcattcctatttctccacatccttccagcatctgttgcttcctgactttttaatgatcaccattctaactggcatgagatgttatctcattgtggttttgatttgcatttctctgatgaccagtgatgatgagcattttttcatatgtctgttggctgcataaatgtcttcttttgagaaatgtctgtttatatcctttgcccactttttgatggggttgtttgtttttttcttataaatttaagttctttgtagattccagatattagccttttgtcagatgggtagattgcaaagattttctcccattctatatgttgcctgttcactctgatgatagtttcttttgctgtacagaagctctttagtttaattagataccatttgtcaattttggcttttgttgctattgcttttggtgttttagtcatgaaatctttgcccatgcctatgtcctgaatggtagtacctaggttttcttctagggtttttatggtgttaggtcttacatttaagtctttaatccatcttgagttaatttttgtatatggtgtaaggaaggaatccagtttcagctttctacatatggctagccagttttcccagcaccatttattaaatagggaatcctttccctatttggttgtttgtgtcaggtttccccattgcttgtttgtgtcaggtttgtcaaagatcagatggttgtagatgtgtggtattatttctgaggcctctgttctgttccattgatctatatctctgttttggtaccagtaccatgctgttttggttagtgtagccttgtagtatagtttgaagtcagatagcatgatgcctccagctttgttctttttgcttaggattgtcttggctatgtgggctcttttttggttccatacgaactttacagtagttttttccaattctgtgaagaaagtcagtggtagcttgatggggatggcactgaatccataaattaccttgggcagtatagccattttcatgatattgattcttcctttccatgaacatggaatgttcttccatttgtttgtgtcctcttttatttcattgagcagtgatttgtagttctccttgaagaggtccttcacatcccttgtaagttggattcctaggtattttatcctctttgtattaattgtgaatgggagttcattcatgatttggctctctgtgtgtctattattggtgtgtaggagttcttgtgattttttgcacattgattttatatcctgagactttgttgaagttgcttatcagcttaaggagattttgggctgagatgatggggttttctaaatatacaatcatgtcatctgcaaacagagacaatttgacttcctcttttcctaattcaataccttttatttctttctctcgcttgattgccctagccagaacttccaatactatgttgaataggagtggtgagagagggcatccttgtcttgtgctggttttcaaagggaatgcttccagtttttgcccattcagtatgatactggctgtgggtttgtcataaatggctcttattatttttagatacgttccatcaatacctagtttattgcgagtttttagcatgaagggcggttgaattttatcaaaggccttttctgcatctattgagataatcatgtggattttgtctttggtcctgttgatgtgatggattacgtttattgatttgcatatgttgaaccagccttgcatcccagggatgaagccaacttgattgtggtggataagctttttgatgtgctgctggattcagtttgccagtattttattgaggatttttgcgttgatgttcatgagggatattggcctaaaattctctttttttattgtgtctctaccaggctttgctatcaggataatgctagcctcataaaatgagttagggaggatatcctctttttctattgattgaaatagtttcagaaggaatagtaccagctcctttttgcacctctggtagaatttggctgtgaatccatctggtcctggactttttttggttgataggctattaattattgcctcaatttcagaacctgttattggtctattcagagattcaacttcttccactggtttagtcttgggagggtgtatgtgtccaggaattaatccatttcttctagattttctagtttatttgcatatagatgtttatcatattctctgatggtagtttgtatttctgtgggattggtggtgatatcccttttatcattttttattgcgtcaatttgattcttctctcttttcttctttattagtcttgctagcggtctattttgttgatcatttcaaaaatccaactcctggattcattgatttttttgaagggttttttgtgtctctatctccttcagttctgctctgatcttagttatttcttgccttctgctagcttttgaatatgtttgctcttgcttctctacttcttttaactgtgatgatagggtgtcgattttagatatttcctcctttctcttgtgggcagttagtgctataaatttccctctacacactgctttaaaagtgtcccagagattctggtacattgtgtctatgttctcactggtttcaaagaacatcttcatttctgcctttattttgtaatttaccctgtagtcattcaggagcaagttgttcagtttccatgtagttgtgtggttttgagtgagtttcttaatcctgagttctaattttattgcactgtggtctgagagacagtttgttgtgatttctgttcttttacatttgctgaggagtgttttactaccaattatgtgatcaattttagaataagtgtgatgtggtgctgggaggaatgtatattctgttgatttggggtggagaattctgtagatgtctattaggtccacttggtccagagctgagttcaagttctggttatccttggtaaccttctttctcgttgatctgtctaatattgacagtgaggtgttaaagtctcccattattattgtgtgggagtctaagtctctttgtaggtctctaaggacttgctttatgaatctgggtgctcctgtgttgggtacatacatatttaggatagttaggtcttcttgttgaattgatccctttaccattacgtagtggccttctttgcctcttttgttctttgttggtttaaagtctgttttatcggagactaggattgcaatccctgcttttttttgctttccatttgcttggtagatcttcctccatccctttattttgagcctatgtgtgtctttgcacatgagataggtctcctgaatacagcacactgatgggtcttgactctttatccaatttgccagcctgtgtcttttaattggggcatttagcccatttacatttaaggttaatattgttatatttgaatttgatcctatcattatgatgttagctggttattttgcccattaattgatgcagtttcttcatagtgtccttggtctttaccatttggcatgttttcatagtggctggtaccggttgttccattccatgtttagtgcttccttcaagagctcttgtaaggcaggcctagagtgacaaaatctctcagcatttgcttgtctgtaaaggattttatttctccttcacttaggaagcttagtttggctgcatatgagattctgggttgaaaatgcttttctttaagaaggttgaatattggcccccactctcttttggcttgtagggtttctgccgagagatccgctgttagtctgatgggcttctctttgtgggtagcctgacctttctgtctggctgcccttaacattttttccttcatttcgaccttggtgaatctgacaattaatgtgtcttggggttgctcttgttgaggagtatctttatggtgtcctctgtatttcctgaatttgaatattggcctgccttgctaggttggggaagttctcctagataatatcctgaagagtgttttccaacttggttccattctccccgtcacttttggtacaccaatcagatgtagatttggtcttttcacatagtcccatatttcttggaggctttgttcatttctttttactcttttttctctaatcttgtcttctttctttatttcattaatttgatcttcaatcactgacatcctttcttccacttgattgaattggctattgaaccttgtgcatgcatcacgaagttcttgtgccatggttttcagctccatcaggtcatttaaggtcttctctacattgtttattctagttagccattcattcttctcaccttttttcaaggtttttagcttccttgggatgagttagaacatgctgctttagctcggggaagtttgttattaccgaccttctgaagcctacttctgtcaactggtcaaactcattctcgtccagttcgtttccttgctggcaaggagttatgttcctttggaggagaagaggcgctctattttttggaattttcagcttttctgctctcatttctccccatctttgtggttttatctacctttggtctttgatgttattgacctactgatgggattttggtgtagctgtcctttttgttgatgttgatgctattcctttctgtttgttagttttgcttctaacagtcagacccctcagctgcaggtctgttggagtttgctggaggtccactccagaccctgtttgcctgggtatcaccagtggaggctgcagaacagcaaatattgttgcttaatacttcctctggaagctttgtcccagaggggcacctgcctgtttgaggtgtctgttggcccctactggaaggtgtttcccagtaaggctacacgggggtcagggacccacttgaggaggcagtctgtccattctcagagcttgaacacaatgctgacagaaccactgctcgcttcagagctgtcagatagggacgtttaagtctgcagaagccgtctgctaccttttgttctactataccctgcccccagaggtggaatctatagaggcagtgagccttgccgtgctgcggtgggctccacccagttcgtgcttcttggcctctttgtttacactgtgagctactcaaggctcagcaatggcagatgctcctcccccagtcaagctgcagtgtcacaggtcagactgctgcactagcagtgagcaaggctccatgggtgtgggacctgctgagccaggcacaggagggaatctcctggtctactggttgctaagactgtgggaaaagcacagtatttggtcaggagtgtactttttctccaggtacagtctgtcatggtttcccttggctaggaaagggaaatcccctgaccccttgcgcttcccgggtgaggtgatgccctgccctgcttcagctcaccctctgtgggctgcacccactgtccaaccagtcccaatgagatgaaccaggtacctcagttggaaatgcagaaatcacctgtcttctgcattgatctcgctggagctgcggactggagctgttcctatttggccatcttggaagcaactgcccatcttagaaactcttacagccaagaggagactaaggagacatgctgactcaatgtaatgtggtgtcctggatggatctgaggaagggaaagaggatatttggttaggaaactctgaacaactaaagaaatctgagtaaagtatggatgttagttaatattcatgtattagaattggtttacagtggttacaaattatagaggacactgggtatgtggtatagttatacgagaacaatctgtactctcttagcaactcttctgtgattctaaaaccattctaaaataaaaagcttccttaaaaaaaattgatggcagagcaggagtaagtatttttgttttgtaaccttggaaaaaagagagttgaggcaaaatccacagaggactagaacctgtattcctatctggtgtgggaggagagagatgacatttggttgggagaaggctggagccaagttatggtgttcagtttgtttctgctctgctgtcatagggctcttccttggaggagctatagctctatggaaccgtatgaatgggagagtaaggttcaacagttcgttggtgtgacctgggtgtatgtgcacatgcggatgcattgtgtacatgcaaactcaaatccccatagcatccagctaggaagtctaaatgagcaaagcaagttgggtataagaaataagaaagtgctgggagctatgcttaataggagacacaagcctcaaatagcagaacagctgctgctctgttcagtgccgggtgatttttgctgtgcgggaaggtgaactgagatgcattttctggtatttcaaaagaagctgaaaatctagatttactttttgaatgtggaaaattctgctttttaaatgttggcaactatttcagaaagtttttattaatcatcatgtatgcccaatctgtgttgaaggaaatgtgtctgtggactgcacacagtccataccaccaggttgcaattatttctgtcaacctgagctatgctgagtccggtgggctaatacagatgaggcagggctgtgtctgtgtggtgtagagcatggagtcagtctgtgtcctgagctgtgatgagatcattctgtgagagtaaataactgagcttgtacttgaaagttgaggacaatgtggagaacaaagagctaagagcacaagcaaaggtccagaactagaacatcacagggtgtgttttggagactggatgatttgagtaaagaatcatgaagagcagaagtagttatcaggctagaaagttaggctggagccagataaggatgggcctgagtatttggaatatatactgttggcaacagatgactaaatactcgggttctcttgaaggagtacagggcagaaatcaggagatagaatgagaaatttgacatttacaccagaactttccagccacaaagagcaaggtagagtcaattaatgcactgagtctagttagaatgattgggttaaggtgagagtggccattcctaacacttagcaaaacagtgtgtatgcatatgcctgtgtgcagttatttgattatacatacactttccagctgggctaggctggcctatctgggcccagtcaactgctgtggacactgagctttaacaccaataagtgcgtgccgtattcatcctcattctcatttctttctcagtgcctcttgaccctccaaggattattgcactgatccagaactgctaaaatggagaaagccaggcctgacctgtgcgcacagcacacagcattgatatttgatgtgagattaggtcagagtcagccgggaagccttctaaagcgtggcatacagccaacaaaatgaaaaggctttattctggggggaaatgtttccctctctgcctggcttgctttccttatcctcccttagacatcctttcccctaaattctagttcattattttcatttgaaactctcaaattccactgggccactagctgaccacattcctccctaaacaatagcattctattttaaacacttattgtgccaatgttgacattttaatagcccaagaggggctgaaataactactcctacctcaccaccatcaccaaggagatcaagtatcatttctaggatttatggtaagcccctcacggtgaaagcacaaaaatcagaggccaggaaattggcagctacgtattttaaataggatttcggtaatctttggctggtctttcctaacaatgttgaagttgatattttgtaacttaacattggttctagttctgcctggtgagtagctctaatctcattttcattatgtgagaaaacacttattaattagtagaaactattggcaaacttgatatagttgtgaatgaataatgtaaatccctagtggggcccttcccaaacccttgctccccttcctaaataagcaaacagagggaaatttctgattttagtgggatgatgtaccactgattacccaacattgcttatgactttaccattaagatttataatgaaaactcttttatctatatgtaacaggaattaaactttatgcaacaagttaaataacaaactttctcgatatccaaatgagtgctttctttatccaagttcatcagtgtaggggaaagtcctaaccttatttcaaaaatgtgcaaaatattttgtaataactaggtaattctaaaaacatataaggaattatctgaagttaagtgtggtgagtgaagtggatgattgatagtcatttgggagcagtaaagtgggtaagagtaaaaattaatgagacagtcttcttcacgtggttcaaaaaacagcttctgaaggcagtttccctggaagagctccagaagtgttcttgtatgtggcagtaaagaaagacaatactcctgatgactggtaaccaagtaatgctggcttaaacagttacttatgtgataatcaaacttcccttgctgatataaaagtttttatgtattcttggtttgatcactcctaatttgtctgcatgcaaggagaaccagacttaaggtaggatccactcatttactgactgattgcttattgaatgccttctctgtgctggacagtaggagtaagatgaggagcactgtggactttgtccctgccctcatacatttatgataaggggttgtggggtcagggcatggaaaaaacaaaaggcaaatctttaagacaaactgattggaaacgactgctattggttaaatacacccacatgttgagataatttgtactttcccaaaacattatcttgataacattatagtcccagaaagcgttagggaatgtagtaatgaaactttggcaggtcttgtgcctctacaatgtttgtgttgctcatgacctttgtacatgaatgcttttgcccatgtggccagtcaaaaaatgacctggttgacctgtttttccaaaagacctttgaccaaatctttgatggacaaacagagaatcatgttttcaagaaggatctacttgcaagcaaagttctatagtgtagtcagggaaggctctatgaagtaatgaactcttctggcaaagatctgaaggatgagtagaaaatagtctggtcatgagctaggggaagtgatttacaggcaggagtaacatgtggaatacagaataatttgactttaataaatttcaaatggtaaaaattttccaaagttcaaaatagaaacataacatcccgtgatattagaaaatctcattactttactttagtctggccagaaatgtgtcaagaggaagacttcaaagaggtagatttcatctctctggcctgtaaacaaaatgcccaaaacacttccccaaggcttaaagtcagtttgtaattactcttttcatcacctcagaagaatttccaaactttagtaacgtagtaaaattttttttggcctttgtgaataaatactatgaaatttggttcaaaagataaagcaaagagcaactgaggtcttcaaaacatcatgtatctagaaggtattaccaaacatccgttttttttaaaaaagcataaggcataaaatcaattcactaatgtcatgctagagtgaggtagtaaaatgaggcaactcagaccagatggtgtaattcataaacagggctgtcatttgggaaaacgggtggagtggatggagaaattaacttgcagtctttccccttccatttcttcccaatccaactaaccttattcctctgggtcatttagctgtggctaaaacacacacacacacacacacacacacacacacacgtgtgtatatatataatatatatataatatactttttacttatagccataggtaaatggtgaatgaagtagatgattgacctgtgtgcatagcacacagcattgctatttgatgtttgatgaaatatcaatgctctcagaataaataattaaatgagtgtatatatatagacacacacacacacacacacacacacacacacatatatttcttttttaaaagagtgtaattgatgccaaagccactttctcttcagagctgcttaactacatgaagagtgtgcaccaacctggggttgcaaagagttctctaccttgtccggcttctggaaaggatgtgcgctttgctcaatggggaatggataagatgaggatgtcccactgctggttggttagtacatttttgtagatgaagcaaagcacatctgttcttatacagaatctcatctttaaaagggacctcagatagcatctaattcaaaaactcatctaatgcagtgcagtattcctctaagatacatacataaatgctggctaaatgcccccagggatggaagtttactgcctcacaaggcagccaattatctttctgacaggtgccattcttcctaatactgaggtaaagtccattgttctttagcttccacaaaaagcagtgataatactcttgacggcttgccctgtgccagggtctgtgccaaggagcttcatatgcattgtttgtaacacttgcaacattagtggcaggcagggatcatcctgcacattttacaggtgagggaactggcacaaggtcacacagctaagagagaaggatctagtctggctaaatccaatgcctaggccaatttcttgacaccatgcataattcctgtttcaaatttctatatgtgaaggcaccttttagactcttctgttttctcattgatttctcatatggcatgccttccaatgctttcagaatatgctatgacagtatctctataaaaatataaatcaatacaaaagttattgacccctagaaaatgacaatcacatacttcaattaaaatgagtagtacaaagagacttccttgaatcttttaataatggcatttatttttacataataacagcagcatattggttaagacatggatttaggtagatttgacacctggtttcaacattcattagctgtcagattcggggcattttatctaacttctcaaattatcagtttctcacttacaatgtggggatgatgatgatgcctatgttttagaattgtgagacttgacatagtacatataaagcacttagtatgatgctggcactatcttcaataaatggtattattatttctttatttgcagcaaaccaaaacccgtatgattgttgtcaagtaagacttcccctacatcatgtttgtaaattagaatgttagctataattataagaaattgaaaaattcatgttgtctaatcaatattacattttagccagtagtttcagccaggatcttggttctctcattaaatatactggtaatctttttcaattttgtgtcacctgcaattgttaaacatattttcagtatctttatccaagttgttgctaaaagtgattgaacagggaaatcaatgtttgttcccatctgtgggtgctgttaacagcttcgtatgtgtgttttacagtcacatatgtaattttccctgtgcttttctgtctatatcatacacttgttgtatcccctagtgatctctgaagttttaagctgtctttgacctatgattctgtacatctcctgatattgacatagctgaatctattaactaacttctaaaatggaaaccaggacacctggggctcagcactagcctttccccagtgtacttaagccctctgtggctccatttttcatacttttaaaactgagcaaatatttgccctctccttcctttcaatgatatggtgaaaatgaatttaaagcaattataaaaaggacatgtgttcttataattggtagcatatcatttacagagaaattcctcatctggtcactatctaagtagctaaacaactaaacattagcaagagaagtctttgagcagtcaatgtaaatgacaccaagtctatgcatttatcatgtgctttactcatagactcatacttattcacagtcccattacatacacacatctaacaagcttgtttatttcatttcccagtccacagccaaatagaggaagaaagtggatggagactgcccaaagtgggtaaattgaaagtagcaagaaaaggccaggtgcggtggctcatgcctgtaatcccagcactttgggaggccgaggcgggcagatcacgaggtcaggagtttgagaccagcctgaccaacatagtgaaaccctgtctctattaaaaatacaaaaaattagacaggcgtagtggcgtgcacctgtaatcccagctacttgggaggctgaggcaggagaattgcttgaacctgggaggtggaggttgaactgagccgagatcgcaccattgtactccagtctgggcgacagtgcgagactccatctcaaaaaaaaaaaaaaaaaaaaaaagtagcaagaaaataatcattttgaaaggtgaaaaaaaaaaagacaagagaattataaaaattagaaactcaaaaagtaaagaagcctgagaccactaattaaaggggaaagatagccttaaacatcagttttcaagaacattactgaattacaagttaatactataattgatgttcaaaatgattattcattattgtgttggacttccgtgttttcacatgctcagcattcattctgctctcctctggaggcagcactatgatttttcttcagaaaattacccttcccaatttgtattctgttccaaaggaaccatcatgtaaggagctttcccatctcctgaacaaggctgagcttatggtccaagacaagtcagtcacctttttgcaggaatttggatgttgagcagagccaacacaaagctactgggctggctcatccttatggtggtatcctgaattcttcccttccacgtagaaccctggagctgcatggtccctgaccttttcaagactggttgtccaattttcttttaatttggaagactactttaaaacattctaataaaatatgttagtcaaaggtggtctttggctgctcacagcttgtgtttcataactgacacagattcattaaagggatcaattttgttctatatgcagtgttcaaaaagccacagatatttgtaataaaaattaaaaataggccaggcatggtggctaacacctgtaatcccagcactttgggaggcagaggcaggaggatcacttgagcccaccattacgaaaccagcttagacaacatagtgaaaccccatctgtacaaaaatacaaacatttagctgggcatggtggtgtgtgcctgtaatccctgctgctcgggaggcttgaggtgggaggattgcctgagcccaggaggttgagtctgcagtgagccatgatcacgccactgcactccagcctgggtgacagaacgagaccctgtgttaaaacaaacaaaacaaaaaaccccccaaattaaaaatatttccatccaacttggttaaaatagaattgaaaacctttagcattaaagggatgtttccattataaataagttactaatttcctaaccatactagatgaatgagttgttattgcatacaaatccaaaaattattacattttattgtagcttgaatatatcttggtgaactcattttcttagagtggctctggttagctctttattaaaatgacaactgatgtcacagaagctgcctgaggacacatctaaaatgaacatgcttttagtggtggttaaaatactttgaacagtcaacaaatatttacagctctttttgtgtaacgtgctgtactaagtgctgggataaagcagtgaacggggtggacatagcctcagaactcccggagcttgtggtccaatagctcagtaaaggtctactgaatgaaagggagacttccctttgctcacaatgaggtcattcctcatgtttttgccaatgtatttttcctgcctggataatccaccctctgacctttatccacatcctttacccatttctttttcaaggtccagatcaaacagcaagttctccactaagcctctaacaataataacactgatggcagctaaacatttattgagcctgatgctaacctctttacatggattacataactcatttctcacaatgcactatgagatatttacatataattcttcagtaacccaattgaggggaattgcagggcaattaaaaaatacgtataacttaaaatgttgaactcagcatgcccagaactactagaatctttttgagcatagaacttaaaatgtaaggtgcgaagaaaacaattttatattttactgtgcctcagaattgcttggtggggtcttttaagaaataaagatgccagagtacattgtcaaaatttccaactaattaaaaacacacaagcacacatatgcagaacacagtacagaaaattgccgcaaatatcttctaaagataaccacaaattgcactttatgtgtttccattcagtttttcttctttttttgtagctataatcttttagacataattttaggataggtatcaccttatcagtgagatctttccttacccacctccattccctgtcctcattactgcttaagttttctccaaagaatttcttaccttctatttattaattactttttaatttactttgcttcctcagagtaacttatctccccacctccccgtggccccacttccacatacatactagaatgtcagctccataagggcagagatttttgtctactttgctcacttcagtatctacagtcgttaacagagtgcctggcatggagaggtagcttagtatctctttgtccaatgatggatacctgaatgaatacaactgtcaaagtgcccttcagaaatgctgtactatttccacttctacacgaagggtaaggcagtgccatgtggaaggtatatttttaatgggtgggaccttgagtcatcccttgaatgccacctgggatctctgtggcaggcacttgcaacaccaaaggagtgtacactgtgcctggggccaagggcaggtgccatacacaagtgcaaggccatactgaagaggccacctgccctcaaatgggttcaacaggaatgctttttaaagcaatgccccaaaattggttttagcacttgattgtataacctgaccacattatgagttctggaatttgttcagggctgtgtcctgtttcctttagatcacatctttctctcacccagattgcctaatttttgaacttttaaagagcagagtactgctttcagtgctatttagtcatttcccacagctcttcatccctttagagtagcttttatagttacttgggccattttgggtagtggacattggattactatttttgttcaaccaaataaatggaaggcttcttagtattattaatgctcaaaacatgcaacccacactcctattatgcaattgaatattgttttgaagtcatcctgtaattacaagatttccttccaaatcagacaataggtctgaaagtagtaattttgacctaaatatgtgcaagagcttgaagggcttcttataaaaactaagaggaagaccaagtttagtggaaaaacacccaggctaggatttgggagacctgggtcccactgacatctctgccaattattggctctccaagtccccctttggttgggtaatggggccgtccatcctaactcactctattatgtggaatataaatatgggaatcacaatgaaaactgtaaaattatattacatctaaaaggctgccatgttttcttaaacactggttaattatggtaggtagaaagaggtcttttgaaggcttttagagctcattttcccaaattgttttgtgtggacctctgcttcagggagatgtatttagtcagcttttgctgcatgccaacttcaatatcaaagtggctcatattccatacacattcctatgcttgctcgtctgcagttcagttagagttcagtcctgaagtttaagttgaaaggaagaaacttgatcttagtgggtacttaatctgttcagctcactaaaaacaaaaacaaaaacagctcagttgtatggaaggagcatgttaaccacaaaaagtaggggtagaccagaaagaagtaagctagaaggtgggttttggaatgagatcagcgccagtgaatctacccttcagttctagatttgagaaaagtagtcaaccaccataccaatgggcaacaagtaggaccaatggaaactgtactcaccccacctgttgaaaacctggagtttgagtaggtcttgccttgtgtaagaaggagtggagaagaaaaaaatcacaccctacatttggtcagggccaaacaagattgaggacaaatagaactttgtgttaaaatacttgtcccaggtccagtttcgttttgcaggattcagaaagagttgtgtttgtttaatacagtcttataaagaatttccaatcccagaggattcatgaagcaaagtgatgctacagcttccacggtgtgtatgtcagagcaggcaggattttggagattgtatatcccaacactgtaattttacaaatggaaaaaggcacagggaggaaaataaagctcaggattattcagttggaggagatagaaatgcacctaagtcccatagctcttagtacaggacatatttttttttacaatagcagcagcagcagcattattaaataatgatcatggaacatttatgaatctaggcatagttctaagtattctatatggattatgacttttatgccttataatagcccatagaggtacacttcccctttgtacaggtgaggaaaccgagagaggcagagaggttaataaacttgtccccagagtaacatgtaagaaaatgatagagataggacatatcatgaagcaatttccaaagcgtatctggcatataccagcttcgcttccagagacatctacctgaccagaggtagagcagtagtttacacttcttcacttgttcagacaataaagaaaatgggttttgaggaagccctgtatgcctttctaaaagtgctttctaagacagagtacatatttcctgatcttctgtatatccgtcatcaaactcaactgtcatcttcttaatgccaggtagatactaaaccacaaatcctccaaaacaactgggcagaaagtagaagacaatcagcagcattcactgctttctaagaaggcaattcccaggaatacagtcctgaaggtttaagttgaaaaagaaacttgatcttagtaggtatgtaatcagtttagctcactaaaaacaaaacaaaacaagacaaaaaacaaacaaacaaacaaacaaaaaaacaactctgtcaggtggaaggaacgtgaaacgtgttaacccatgaaaaacagaagcaggccagaaggaagccagctagaatctagggtttagaatgcgagcagtgcctgtcaatctacccttcagttctagatttgagaaaagtagtcaaccaccacaccaatggacaatgagcaggaccaacagaaactccatccacctacctattgaaaacctggagctttaataggtcttgccttgttcaagaagtagagaagaaaaataaaacaattcctatggtagaaaaaaaaaagatactgtgcaacaaagaaaaaccgtatcgagatggtttttgaggaagaatacacatgtgaaaaccagctagtctgggatccagaaaaatatttaagaaatagtctggcatcctcagaaaagtacaagaagatatggtgtctatgaaccaggagctgcatggagacagatgtatccagtaaggactagagtgaagctaagatataatggaagggagacaaaacactccctatctctggaaacaaaataaaatggaatacagggtgccagttaacccttgcagtaaatgataatttaaaaggaaaatacaaaatacccacaggtgaatgataacgaaagtatctcatatcaaaatttactggaagtcgctaaggcagaggaaatttataggtttgagtagattttctgtttttcctatttatttatatattaaagatatatacatgaggatatttatccccattttacaaaagaggaaaaagaagctaagagaagttgagtagcttgtcaaagttcacactaccagtaatagcagagccaggatctgaaccaggaggtctggttcactcttaataagacagaaaaatctctagcaaggttaagaaaaaaagaaaagatatgaataagcaaaatacatgataaagagagaaagaaaaaaatgttttgaacaactagcttacactccaataaatacgtatatattagtttcctagagctcttataacaaaataccatagactgagtggcttaagcaacagaaatgcattttctcacagctttggaggctagaagtctaagatcaaggtgttggtaggtttggtttcccctgaggcctctctccttggcttgcagatgactgactgccttcctactgtatcctcacgtggtctttcttctgtgtgcaggcatgcctgctgtcacatgtatctccttataacaacagcaggcaggttagatttgggcccaccctaacagcctcattttaacataatcacctctctgaaggccctatctctaaatacagtcacaattcgaggaattgaggattaagactttatatgaattttctaggaatatgattcagcccataacagtctagaaaagtgggtttcggggaaaaaaaacccacaacttcccagcataaatgtgaaatagaaaattaaatacaccaataatataacatgattattaatcctttccttttactaccacattcctagtagatagagactgtggttgttttacaggtgagtccaaacacactttccaaggaacagaaaatccctatattactttagttgtatcagaaaataaaagataagaaaaagttgcccaactcatttcattctaaaagtggattgaataggtataataaataaaagtaaattatagaccaatgtttaagacataggtacaaaaatcccagactttatattatttaaaagtaattacagcaatatgtataggaattaatacatcattatcaagttcaatttattccaggtatgtaaatatacttcaactttggtacaagtttggtacaacttcagacacattatctttcaggtaatttgctaatgttactaaaaaaaaaaaaacaccccagaagaaaagttaaaaccctaaacaaaaacaagaaaaagaagagtataagaattagaagaaaaaagaggaaattagcattttagaaattttatatgatgatttaatatggaacacctacaacaagctacagatacattactaaaattgattaaaaagtttagataagttgttggataaaaatcaatatacaaatacattgtatttctatacaacagcaacaaagctctaaaagagctgaaattaaaagttacaatttaatttacaatggcaattttacacatacacacacacacacacacacaccagggaatgagctgaaaaaataaagaccttaatggagacaattattaaatttattaaaagatattaaaaataccagaattaatagaagatatatcatatgtatgaatttgtagacaaaatattttgagatgctgtatctactcaaatggaacaatatattcaatgggattaaaatatgtatctgaaggcaatctgtgttgtactaaaaagcttgaaatgacaaagcttgaaagctggttctaaaatttatatagatgacttgagggtctgagaatgacccaaattgtcctgaaaaagatgaagcaaattttattattaagcttattaaataagaagtgagtgagtgactggtatgaggactaagggaccaagggagcaatggaacataacaaacttggtatgtgacagaggtggcattgctgaaaaccagtgaaatgagggaattggtcaacatatggggttgaaataattggttacttacatggaagaagtggaattggatgttcactttaccatgaacatagatatcaattccatgtctattaaaaatgtaaatgtgaggctgggtgcgatggctcaagcctgtaatcccagcactttgggaggccaaggcaggcgtatcacaaggtcaggagttcgagaccagcttggccaatatggtgaaaccctgtctctactaaagatacaaaaaaattagccaggcgtggtggcacacacctgtaatcccaactacttgggaggctgaggcaggagaattacttgaacctgggaggtggaggttgcagtgagccgagattgtgccactacactccagcctgggtgacagagtgagactctgtctcaaaaaaaaaaaaaaaaagtaaatgtggaaggtaaaagtctacaaagggagtatctgtgacttggggcagggaaatattgcttagacaaaacacaaagcgcacaaaccataaagagaaagattggtaaatttgagcacattaagaacctctgttcatcaggagacactgtaaggacagcagaaagcagacttggagaatgttgtgtgtgtgtgcgtgtgtgtatctagcaaataattagtattcagatatacaaatcaatattgatttttctacaaatcaataagaaaaagacaataccatggacatgttctcaaactccttagtaatcttggaaatgaaaattaaaacgacaatgtatcaccatttcctacctatcagattggaaaaatacaacctgatattacaaaaaactgttgatgtaggacaatgagaaccttagacaatgatagattcagcatggaattaacctaaaggaataaggcctgtctcctaagtttttgagggagttacgatatcacaacaaccttaggcttgtgtggcatcagcctgtgaatattaacttatatcaaggccaccgctataaaatcaaagtccttaaaatgccctaccaggacttggtatgtatgatctggttctcccttgcttctctaatctcacttgttactactttcccatcactcttgccatcctcagtccttggaagtatttctcgattattcttttatatttgccattccctcttaccggaatatccatcctccagatatccacatggctctgtctcttcattcattctagtgcctgctgaaaggtcatctttttaagatgatttctctgataattttatctgaaaagtgaccacccatcctacttgtcactatcttcttccttgtttttttttctttataaccttcatcatgactttacattttaaatttttaattttttcccttctctccttttttttttgagataaagtcttgctctgttgtctaggctggagtgcagtggcacagtcatagatcactgcagggtaattttaaattttttgtagaggtagggtcttgttacattgcccaggctggtctcgaacccctagcttcaagagatcctcttgcctcggccttccaaagtgctgggattaaaagcaccagtcactgtgcctggcctttacacttttttattgtgtgtttgtatccgtccactaggctactattgcgatacccctagttcccagattacttggcccatagtaggagcttaatatttgtgtaatcaggggacatgaaattccttataagctcttatttaatagaattaacaaaatattttacttctagattttaaaatctaatttactaacatcatttgggaattttgttacatatacatgcctcccacacttttttttttaaaaaagagttcgtttatcacacacttgttttttaaactaatgatttgctttcaagtcagtgttgtcacacgtccaaggttttcctacattctggtcaatatttattctattgtggactgtacaaagagagcgtcatcagttgttcttttaacactgagacttgtcaatatgaactaggaaagaatgatgataaagaacaccgaaggtacaggaggactctgggtgaggcatagtgccatcagatcagaatcctgagtatttcatgcaactgaaaagcctctggcttcaataataactcatggggaaggaaagttgttccacacccaaagagatcatattttgtaacaagccaatgagatcaagatttgtttaggtcaatttcagagcaaacataggttatcagatgcatccttcaatatggtttactagaatctgaaaattgcatgcttcttttgaagaaaaggatggttaaaggatactgctatgatttttattctgaaattcatcacaatactgtatatgtttataaggaaatctgctatctggtcagtgaaaggaactatctttcagacaactaaattcatgtttgtttcatatgaccaaaaatgcagacagaagccggatagtaaagatgccaggcagagagaatacacttgaagtagttggaaactacttgggtttaaattattggttgaaatctactggggttcaaattccatccatgccactcactgtttgacattgatcaatttagctaactcctctaagtctcaatcttttcatccataaagcatttcttcatctataaaacagggaagagtaatgagaaaattcagataaagcagtcaacacacgttcataattatgttaatttacaactaacgtatcttgaatgcttaccatgggccaggcactgactgggctaagtgccttatgtatatttttttcttttttaatcattatgtgcagtaggtgttgtgattatatcctttttacaaatgaaataaaaggcaaagatgagggagccaggacccaaaccctctgccctgtggtgggccccaaagtctgcatttgaaattcttggctttcttgcatctttctgttgccatagagagcatcaccatcaccttttagataggaggtggggttcagatgatcttcaaggttgcttacataaatcttttcttgttgtcacatgcagacacacaaactctctctctctctctttctgagaggtcagcccattttcctgtctgctacaagttgtgccattttcagtattgttctaaaatcagattagtcacaatagatcctatagtgcttccattaccaatttgtacagtcagtctacaatattgcttataaaaatgttcttttggagccattgtgggtctctttgaacatttctgcaatgttgtctgtacagacagtacatccaagaagaatgaggatggggaatgacgtaattaagcctgttgggaagctctctctctaaggtgaactggagtgtcagatggagttacggtgcttctgaacaccattccccaaagctccattttggaatcttagatttaaaaggcactttagcaaatactgtaaaccttttctctcatgctgaattactttggtaatattcttcatagttatctccacttgctgtagttggagagggaagcacaatcttctgggaattttaactttatttctggaatctactaacagatagttcattcagccgtttttctttatgcaactttcattctctgatgtgagttctgcctttgaaagcagaacagaatagatatatattttattcatgaaaaactttaaaatttgaaggtaacagtcaaatttcactcatgaggcagggattgggtctcattttgtgctccattataaccatagcacctagcgctgtgtaggaaatatagttggtactcattaaatttcttgatgaatgactaaatgagttctctcttttctccactagagtgactgaaagaaagtattatatttctttgacatgtgaagcataaaatgtgaccattaactcttctcaaatgtgagctccatgtggtgaaggaccacatatcatatgtaagcaggtaaattcatgattgagtgaataaatcctgaatgctgctctagtagtggttgtaacgttttaccctgccacacttggccatgacttgttggagaaaaggtaaatatctgatttaatctgggccaatcaaattcctctcctgggtatttggaattaagacctatctctggggagatgagctgaaagttccaacactaaggctgaaagtgaggactagttaaagcctcatggaggctaacatttctaggagaaccaagagtaacaaagatgagagacacgtgacctcagggagaacatgaggtgggccatatggctgtccagatacctgatggctttccagcccgtggctccagtttccatgatggtcagctgttcttcatttctttgagatctctgaatccttacaataatcaccgtcccaccctgacagaaaaacagagaaacacacacatgtgctgttattgaaggttgcctatgttagttctgttcctaccactctataaaacagtttattcaatctaatataacactaattcttgactcatattctgcacacagataactaaaacacccagatcttttcacacaaactgcagtttaaccaattgtataatagaatttttggaaagtttgctcattcacccattcattcaacaacaatatattaagcaactactgtatgtgaatggactttttatagtttttactatttgtctgtcagttgtcactttttgctgctgcgaaggatgttgtcttttctttccatttacttattagcagtggaattgagtaatgatgagtaaaataaaagctcgtaagctctgaatgtgggcactacatgatgtttgtcatatctattttgagtgtggaaagaacattttgcctactgtctgtttccctcttagattctgggttgttgtaggtatagtaagtaaatattggatacttgaattgttatgtgtggttttatatatacatttatatgcatatatcttatataaatttaaatctaaatatatatacatagctaggaaaaaacaaagtaaggttgtaccagagtaaagaaaagttgaccatatttaaataaataaatgtgattacatttacagaccagcagatgtacttgggactgtcacctctgtgtatcttgaataaaactgaaggttaaacttgtcccttcattgggctttaaattaaaaaatttttttttaaaattatcttaggtacataataggtatatatatatttatgggcacatgtgatattttgatacaggctacaatgtgtaacacctcagggtaattggggtatgcatcacttcaagcatgtattatttctttgtgttaggaacattccaattccactctttttctttctttctttctttccttttctttctttcttttttcgtctttcttttctgtttttcttttgctctccttccttcctttctttctctctttctttccttctctctttctttcatctttctttcttctccttccttccttcctttctctttctttctttgtttctttctttcctctttctttccctccctctctccctccctctctcttcctttctttccttctttctttctctttctttctttctttctttccctccctccctctccttccttccttccttcctttctttctttctttctttctttctttctttctttctttctttctttctttctctctctctctctctctttctttctttctttctttctttctttcttttctttctctttcctctttctttccctccctctctctctctctctttctctttctctttttttctttcttcttcttcttcttttttttaacaggatctcattccatcaccctggctggagtacagtggcatgattatggctcactacagcattgaatcaacctcctgggctggagcaatcctcccatctcagcctcccaagtagctgggactacaggtgcacaccactgtacctggctaatttttgtattttttgagacagggttttcttatgttgcccaggttggtgtcaaactcctgagctcaagcggtctgcttgcctcagcctcccaaagtgctaggattacaggtgtgagccaccatgcccagcctagttattaaaaaatatacaattaattattgttgactatagtcaccctgttgtgctaccaaatactagatcttattcattctatctaagtttatttttgcacctattactcatttccccaccccctaccactcccaccctgctatccttcccagcctctgctaatcatccttctactctctatctcaatgggttcaattgctttaacttttagctcccacatgtgagtgagaacatgagaagtttgtctttctgtgcctggcttatttcaccgaatataatgtcttccagtttcatctatgttgttgcaaatgacaggattttgttcttttttattgctgaataatacttcattatgtatatgtaccacattttctttatttgttcatctgttgatggacacttaggttgataccaaatcttggctactatgaatagtgctgcaataagcatgtgagtgcagatatctcttcaacatactgatttcctttcttttggatatttacctagcagtaggattgctagatcatgtagtagttctatagttttccaaggaactttcatattgtttgccatagtggctgtactaattgacattcccatcaacagtgtatagggactccccttttgccacatcctcaccagcatttgttactgtctgtcttttggataaaaacctttttaactacagtggaatggtatctcattgcacttttgatttgcattactctgatgatcaatgttgttgagtatttttttatatacctgttggccatctgtatgtcttcatttgggaaatttttattacagatgttttgcccatttgtaaattggattatttgattttcctcctatagagttgtttgagttacttatatatttgggtattaatcccttgtcagatggatagtttgcaaatattttctcccattctgtgggttgtcacttcactttgttgtttctcttgccacatagaagctttttagcttgatgtgatctcatttttccattttcactttggttgcctgatcttttgaggtattactcaagaaatagttgccaagaccaatgtcctggagaatttccccacattcattgggcttttagttaatctcctccatcccactctttacttcaaccaaatcaaccaacatttaaacactcattttcaagctgcttttctgtaattccaatttgttgggatttccctggcccctatcacttgtgagttcagttttatgggtgagaggggacttgataaagaaggcacaatttttttttcataccccaaatgccagggcaataagccaagtttatacttgatgcgtcctccattttcattagcaatagaaacagtatagtgctactaaggtcaggggtttgaaccctggctctgctacctttcaggtatgcaatctttcggaaattctcttaatttctttgagcttcagtttcttatttctaaaagataattaatactaccagattatagtgattactgtgagggctaaaagacttaatgactacaaaatactcagcacagtccctggcacctagtaaatatccaataggtcatcgcttccagtgttgtttttattactgggggatgctgctgtccacgtaccaaaagagaactgtaaaaaacagcttgcaaagtaagagaaggaagggaagtgttttaatgtgtaatggcacattacattttctggtaatcccaatgttactttaaaaaatcttaaaaatttgacagtggtagcacagtttatttagagccttgtcttggggataatatgaatttttctgggaggattatacataccaggcttcttttcctgtgagagcaaattcccttggacttcttaaatttctgttttcttggtgtagagactgttttctctaattcactgtgggttttctgaacttttccccgttcaatcctagtggtttcaatctgggctgttgtaagaatggcttttagaggaaagagatattagaaatgacagcttttcaagatgaaaaaggtgccttaagactccaaataattctgttataatttttcatttcttcttaagcattttacggaaaatggcccatcttgagtatttttatccttgggcctaaaaacaagttcttgttagccagcggctaggcctttgaagctgcagtgcttgtattttggtctccaccctcttggatgacttgtggaagtatcttccaagctccttcctgattgcgtttccccagtttcaactgagaaggagaaagaactgtgactatatcgatgatttcagaagtgtaaacaacttatcatgtttgtggaacactggataaccctcacaggggatgctgaggaatctggatgcccatggatttttaataatgggagagaatgctatttggaaatcagaggattgaatggatcttggattggatcttgaacacaagactccaactccaaaataaaaactgtgggctgaacaatatgcaattatatatgtggttgtataatgtgcttccatttccttactacaccctaacaaagtctttgttgctggcagggagatcagcctggccttaagaatctgcttctgctagttcagatgggaagtgattagtgtttgtcatatgcttaaaatcctttatgataaatggcacaggcagttattttcgtatgtacacagaatacatcacgaagatcaaagaactctaaccagaggccccatttccagctaacaggtctgagtctatttgggtttagattgtaaaacttcaggaaaatctaacgagcttatgttaccctgaacaagaaatgagatttcttagtaatacccactattgctaagtgactattaaggtagccaaatatcattctttacctatgctttagtttaaaatttcaaagagaggtatggtcagatttatccatgtgttcaatatctaagattttgtcttttaagggaaagcgctttctcctctgattttctgcctaggggaacctcaaggtatctatggcgtaaaagccaaacgtctgttttagcaaatagccagacattacagtggggagtatgtagatcatcttgattattttaccaaccatcagggcagagatggaaacattgtgagctgggaacattgagtttcatttttaccagtatccttgccttttagaaggtatctgttaggagtacttaaagtaaaatggattgtttctaaaattgtgagatgagctatagggcagcttttctacttaattagcttttgtcgttttgtgtttctgttgagaaaagctgagtgggacccaagctatccattcactgcagcatccaagttgcttagaatccttttagaatttagctaagaatactgtttctacccattccaaaaagtatagctagataatttgtaaattcaatttcatgttaattataaacaatttcttgtgctcctttctgtactgtgggtatttaccgagttcaaccatagcttatacctcatatgagaaagattaacaataaaaaatcttttctgtgcacaagtgggggtaaaagactcattatcttctctactttacccccagtgcacccaggctccaaactccagaatcatatattctttctccacttccaatctaatattaaatcatgttgatttttgtctcaacaatattttttgtttgtttttaatttttcattaccgttgtcattatcttagcttaggctctcttctttcatgaattaagcttttccttattatgcgtgaagttattaattgaacaaacacttattattcacctactaggtactaggtattagtaggtgggaataacagcaataatcaagataaaaccttatgttgggtacaatcttcttactcaagtcactgaaaagcctttaaataggtcctttatgtattttctctctctactccaaaacattaaaaacataattgcaaaactagttttatgtaatgcttcattatggcctgagatatcctaatagtgtggccatagtcttctttctagggttacttcatattattttcttaattttcccacattttagataaatgcatgtgttaggtatacgttaccatgattcctggcctttcgtatagcttcagtggttatgttattcttgttgtatgggaatgctttcctctccatctcatatgttaaaattcatccatcttttttttttttccaaaaaagtgaatatttatttatttattttaaatttaatttaattttaagttctgggatacatgtgcaggacgtgcagttttgttatataggtaaatctgtgccgcggtggtttgctgcccctatcaacccatcagctaggtattaatcgtccatcttttaaagctcactttaacttccacttttccatgaagcttttcctgatcttcctcctccttccatcctggaaaatccttgcagtttgttctgcagcatcacacctagtgtctagccatccctactttgtccctacactttttgaattgcttaccaacaacttagagagggagctagagattgttgctggccattgctccttgttttttctcttatttcaggtacttttttgtattttgtcgattcttcccggacgctgccagttttttgcccatctctgttctatttttactgcaactccacaccagttctggttctttggttttcctacttgttctcttagcatttgataattgattctccacaatagattttgaaataacttcttggatttttttctaaattaggtattacagggtaaggtcttgcttttgctccatattccagaatccaatcttgcctggggccaaacccatgccaggctttccctcttttttctcccaaggggatggggtggtcagtcaattatctttatagatatttttttcattaaaattaaaaaattcttaattgtggcaaaagacccataacataaaatttaccatcttaaccatatagttcaatagtgttaagtatattcacattgttgtacaaccaatctgcagaacttttttcatcttgagatctttctttacatttttaagcagtcatttatttacttgttttctcttgtatatcggaccaaaattttcttgaggacaaggctgtgttactgacttgtgtatcttttagtcaaactacctggtataatcaattaataattgtttcatgaatttgaattgaccctggcttccctgatgttctaatctaatgtgcactccacaggaaccctattctgtcaacagacctggattctgatatcaatgaaatagtgcacatcttgaaaacatttccactaatgtaaacaagaaagatgaaagtcaacagagtaagaagttggcacaaggagttgattccgtctgctttggaggttttgctttttggcttaactgttacatggtgctattgtttttgttctgggaggtgggacagtgctgctttatttattttaagaaggcagcaagccaggaacacataattgaaaggaaatttctgtactggcgtattattttttcaactaagatggcaataaataacttgcaacttccttttgtttgaagtggttgatatgaactagagtttaatcttatacactcataaaattgcacatggcaaatactttcacaattgctatttaaaaataggcctatatacttacacactactaataatgtgtccctttacatcatagccttacagcattaggggaaagtcattatctcccctcctcctatatctccaaatgttctctgagggcttacgtctcttatagtcacctcttgttctgacttctggattctcaaagttattttcctcacctgcattttgcttcttttggctgttctctctcctccactagcatgtaccccaaagcatcaatttttctttggtttctcaaaatatcacttaaggcagttgtctgtatgagatatttaacagagaaaaagctatcacaaaggtttactttatatcataatgctacagaaaaatttaaattggacttaggcacaagttcttaaactttcttagccactgtaaatattttatagactgacttctctcttcaatttctagggtctcctgccatatcactgatttctttccattcccttattgctaatctttggcgcctaatctcctgctaggtggttctggaaatatcacaacccttccaaacttaatatttctctagtctctatctatcatgacctggggctatgattccatagtcataatggcatttttttcactaaaaagataattatctcaaaatgagtcaaagacttaaatgtaagatctgaaactatgaagctatgagaagaaaacataagggaaatgctttaggatgttggtctgggcaaagattttatcaataagaccttaaaaaaacaagtagtaaaagcaaaaacagacaaattggagggttatatcaagtgaaaaagtttctgtacagcaaaggaaacaatcaacacagtgaagagacaatctacagaataggagaaaatgtttgcaacctatacatccgataaggggtcaatatccaaaatatacaaggagctgaaacaactcaatagcaaaaaaagccaataacccaaaagacctaaatagacatttctgaaaagaagatgtacagatggccaacagatggaagaaaaatgctaatatctctaatcatcagggaaatgcaaatcaaaaccatgataacatattacctcactcctgttagaatgactgttgtcaaaaagacaaaaggcaacaaggtttggtaactatgtgaagaaatgggaacccttaacacactgttggcaggaatttaaattagtgcagccattatagaaaacagtagggaggtgtcctaaaatattaaaactggaactatcatatgatccagcaatctcactactggatatttatccaaaggaaaggaaattagtatgttgaaaatatatctgcactcccatgtttattgcagtgctattcacaatagacaagatatggaatcaacctaagtgtccatcaacagatgaattgataaagaaaatgtggtatatgtatacatgagggactattattcaaccataaaaaagaaagaaatcctgtcatttgtggcaacatgaatgagcttggaggatatatgttaagtggaataagccaagcacagaacgacacacaccacaagatctcactcatatatggtagctaaaaaagttgatctcatagaattagagagtagaatagtggttatcagagcttgggatgggtaggggagtggaggatagggagacattggttaacaagtacagaattatggttaattaggaagaataagttcaagtgttctatagcacagtatgaagactatagttaacaacaatttattgtgtatttcaaaacagttagaagagagaattttgaatgttccaaatataaagaaatgataaatgagatgatggatatcacaattaccctgatatgatcattacacattgtatatacttgtatcaaaatatcagatgtatctcataaatatatacaattattatgtgtcaatcaattttttttaaaaagccacaataaagaaaatactttaccccaaagataattatctccttaagagaaaatttgttttaataaaaacttttattttagggccaggtatggtggcacatgcttataatcccaggactttgggaggccaaggcggtgggatggcttgagctgaggagttcgagaccagcctgggcaagttggcgaaaccctgtctctacaaaagaaaaccaaaaacaatagccaggtgtggttgcacgtgcctgtagtccctgccagttgggaggctgaggttggaggatggcttgagcttgggaggttgaggctgtagtgatcaaaccactgcattccagccttggccacagagtaagaccctctctcagaaaacaaaaacaaaaacaaaaaacacttttactttagaattgttttagatctaaagaaaaattacaaagattacaagaaagttcatgtgtactgtacactcagttttccctattattaacaatcttatatcctttctatcacattcctgacaaatagtaacatctgcttaaatacttccagtgactggcaacccagtatgtcttaatgagccccattgccagataactctagagcagtgtgacttgagatgtagtcctaggaccagcagcagcatccatacaacctgggagctgcttagaaatgaagagtctcagatctcattccagacctgaattagaatctacattcaacaggatctccaggtgattcatgtgcacatccaaatttgaaaagtattgctctagtgttcatatacatatatatatatatacacacacacacatatatgtatttttcccaaaagatggcaaccaaggtcttgcaatcacattgccccattcattaatttatctgtgtattcacaaaacatttcttaagagcatattatgtgatttaatttgaattttttttagaaaaaattatccctaccctaaaaattttcacattccagtcctgtcatgcaaaaggtagttgaatgaacagggtaatttttattcagaaaagagaggactaagtttgaagagctgaccctgaaagaaaagcaaattcagaaaaattcaggaaaagcttattctttataatatccattctttggtctcaactgggtttcttttaactttgtgtgcatctagtctgtttcttattccacatgacagctgttcagataatcgaaggcagaatccaagtttttacttggctggactcttcctagattgttcaaggctagacacccttcctgtcttgagctgtccaatagtaactttgtcctgcaggattgcttttacatgaatgtcagggtctgcaactgaaagattgatgaaagggaaggcaggctacctcatccctttgccctaatcgtaggtggaatgggaatgagagagaaagaacattatgagtgggttgtttatacactcaagcctcaggacatataaacaggatgaaaccacttatctcacccttactgactgttttctacagattgtggcattttcctgtatttgctcttctctcaggcacagctcttcaaacttagtcttctcttttctgaacaaaaattaccctgttcattcaactgccttttgcatggcaggactggaatgtgaaatttttgagagtagggataaggtcttatttaaaaaaaattcaagttaaatcagtgcttagcaatcatatgttcttaagaaatgttttgtgaatacacagatgaataaatgaatggggcaatgtgattgcaagaccttgcttgacatcttttgaaaacatcttagtgcgttactgtcccctgtccctgataaaatgtggcatcatgaattgagcagaatactccatatggtgtatgaatattgtaggatagtggtataattaatttccctaatttagaatttactttttgatgagttcagcctaataaagatgaaagagaatatgacccccatcattatggcggtctgtgtttagaaggccaaaatagacccctacaacgttgacttagcttatcagtaaggtagaatttgctttaaatggcaattttgagatttttcttgaggagctgaaaggctttacaagattaggaaggtcccccactggctaaataactgctgagggctttcccccttttctttccatcattctttgcttccttctttctctaactgcattgcaagccacttccctcacctgaaattactttttttttctgtaaatactattacaaaaaaaactgtaaaagagagtggtaaatgcagagtagatggataaacataatgacccaagaatgacgatggcgaaatatgacattttctggtgttgggtataataatgggtagagacggaggaatggaaaaaatagactagctcttttgccatggcaacaataagtgcatttattatataaacagaagaaggaaaggcatttatttggtccttgttccttttccctcctaattctcagtttctcctgttttttgtttagtttagattctcaaaagctggaagccagttaccttgcaaagacattgatcatttctttaaatacccaggtatatgcttgactccataatattttactgtttaaaaataaataaatgaatgttttctttaaaagctgattgaagaatagctcaagtcctcttttatcaaacatagaagaatgctctctttaaaagtttgcatctttatcttgagtcaataaccttacaagcaggaatcaaggcacagttttctttccaattgagtatcattagaacattgtctggttcattcatgtatgtctcaagggtaaatggccatcagcgagtctctgacagagaaatactaagtgatcctagtctaaaaggaaagccaatgtgcacttgagtagcagcattcactttacagagagttcaaagggcactttactatgtctaaatgccctttatgttctctggtgccagcaggaaaaggaaagctattaaatgcttataagagtgagacactgtattttaggacataggaaagatggggggaaatagatggcaaactaattgtaagtcaagaatatagcgagtttcccaaagagaattcctgcattttcaaaatattcttcttttttaagggtgtgtggggtgggtggcgtaaaatggaaaaatatgtaaagcctcatttaatatgttttctgaataatccaaaattttcaacatgagctgtaggttgggttgggttggggcaaatcgatgaggcaggagcctaaaattataccaaatttctggatataaatatcagccccaccattattagatatgtgaattccgggaagatacttaatgtctttgagtcccagccttcacgagtatacaattaggaggataaattccaccacggagaaatgttgtcaggtttagtgtagtaacatatataatgcagtcagtagggggcctggcatgtgttagggcttcaaaaataagaaccacatttccattcccactgtcccttaggatcaaatctgcagacatcttctttaggcatttaatacctcccagtattccttgtctacagctcatcgatgtttgtttaccccaagtatttgtataaaattttacacacaaccttcctaacttacatttaagactgtgccatttctgattttctagaaaagagttcagattccttatcacagcatttaaggacatccatgttctgaccctgacctagttgggctgtgtccccctccaactctcatgttaaattgtaatccccacatgtcaggggagggagcttgtgggaagtgattgggtcatggggttggatttcctgcatgctgctctcataatagtgaatgagttctcatgagatctgatggcttaaaaatatggcacttcctccattgctctccctttcctggtgccatgtaagatgcgccttgcttccccttcaccttctgccatgattgtaagtttcctgaggcctcctcagccatgtggaactgtgagtccattacacctcttttctttataaataacccagtctcaggtagttatttataacagtgtgaaaacagactaatacagacccccccaacaaataacatctcctttataaagaccctatgttatattggccagttcctcaatatgttctgaaatatttttcctccataatttcattcacttttcccctgactataatacagttgacccttaaacaacatgagtttgaacagtgcagtttcacttatacacagattttcctctgcatctgtcaccctgagagggtaagattaagcctaccttttcctcttccccctcagcctactcaacatgaagacagtgaggataagacctttatgatgatccatttccacttaatgaatagtaaatatattttgtctaacttacgattttctgaataacattttcttttctctagtttaacttactgtaagaatatagtatataatacatgtagcatacaaaatatgtgttaattgacaacattatttgtaaggcttttggttaacagtgggtaattagtaattaagtgcttggggagtcaaaagttatatgcaagtttctactgcacgaggtgttggcacccttaacccccacgttgttcaactataccttccatttctgcactttgaaaggttattctttaaattccagcatcaatgtcatgccctctatgaagtcttcctgaatactttggacagaagtgatttctgttcttctggaattgcctagtaattcctcataatattaataataaagttctatacattcgtataatgctcaaatcagtggacacttcctgatttagatatgatttaacctgcatagagtagttgacaatacaagtgactttccatccattttcctcctctgacttctgaaacattctggttttcttactacctatatggcttctctttctcagtcttctcagtgaatttattcatttcctaggactgcctttaaaacatactacaaactgggtggcttaaaacaacatgaatttattatctcagaattctggaggctagaagttcaaaatcaaggtgttgggagggccatactccctctgaagcctttaggggagaatatcccttgcctcttttagcttttggtagcctcaggcattccttgttctgtggcagcataactctaatctctgcctccattttcatgtggctgtcttccctctgtcactggtgtccttaaaagaagagaaacagacacaaggaggaaaaccttgtgtctgtttctcttcttataaggacactggtcatattggattaggtctcatcctaatcaacaatgacctctcatcctaatttgattacatctgcatagagcctattttcaaataaggtcacattcacaggtactaggggttaggacttgaacacatcttttggggggatacaattcaacccaaaacagtagcgttcccatttcttgcctctcccttaaatattaggtttcttcagagtgatttcttaggctcccttctctcagcaattatttaaataatgaggaaaactaaaatttggcagtgtcaaatatgtgaatcataaaacaggtgtaacacaagggtccaaggaggatattcgagatacagtgttctgatgcgtcctccttgaatgtgactatattcccttagcttttcctttagaaccacacttgaggtggtggagcctttaaaaatatttaacaaatgttacttttgaagaagagagtaagagtatttaataaggtaacattggcaatgtgaaagttatatgagatacataatcagtggtcctcatctttgtctccttcttaaagaaaacaagaggaaatgattgaccactggaagggtaatttttgtgggctgaattgtacattccccaaatttctatgttgaaaccccaacgcccagtacatcagaaggtaactgtatttggaggtagggccttgaaagagacaattaaattgaaatgaggctattaaggtgaaccctaatgtaatatgtcttatgaagtcatcataagacagggaaatttggacataccaagagactccaggtatgtgtgcacccagaggaaagaccatttgagaaaatgaccatctgtaaaccaaggagagaggttttaggagaaaccaagcctgctggcaccttgatcttggactttcagcccagaactgtaaaaaaacacatttctgatgtttaagccacccagactggcattttttttttatggcagcttagcaaacgaatacagcaatttttagttactgatttagtgactagtgtggtccagatgctattctgggtgctgacgatatagcttccctgtggagctgatgttctagcggatggagaaagggaataacaataaataagtaaaatatatgtcagatcagactaagtgctacagagaaaagaagtcagagaaatcatcatatagaaagttgcaattttatagttatgaagccttcattgtgaggctgaaattttaacaaatatctgaataagatgaggaagaggcagaggatcccaggtttaggaagtagcaagttcaaagaccctgatttgggattgtgtctgacatgttcaagagacaacatcaagaagccagtggggctgaaatgtatagagcctggggggagagtaacatgtcagagagaatgggggtgggggagctatggagctactggggactaacttgtagagaaaaccagtccccagaatgaagttaatacaaaaagaagggtgagcaggcaaaatgggggagggtatggatgagggagggagagagaaagagagagaaagagacagagagacaaagagaaagatgccagtctgaaaaggctacacactgtatgatttcattatttataggacattctggaaaggcaaaactatggaggcaacaaataaatcagacattactggggtttggggagagaggaaggttgaacaggtgaagcacaaaggatactctttgtaagtgatgaaaccattctgcatgataccataatggtgggtactcaacgccatgcatttatcaaaacccatagaactttacagtacagagtgaaacttaatgtatgaaaattgtaaaaaaaattatttctgaggtcagagggtcacagggtggaatatagaacatgactaaacaattaacaatgctacaaacatatgataaaacctcactgaagggactggcagaaaaagttgctagcctgaataactttagaaatgagcagagattgtaagactaaagggaaaaataattgtatgtaagcacggtaatctagttgataaagtctcccatgggggaacaggttaacaattctgaaaccatcatacatctaatctggaactgaagaattaagtaaatggaatgtggatagcaggaagcacgagccaggtttctcactgttgaagtgggagcttacaggaaagcatggggagaaggcaagaatgattcatatggttatggattagagttagagacatcagtatgaactcatgcttacattattataggtacagacgtttacatatagaaatatttatagatacgtatatatactgaagttagctacacacacacacacacacacacacacacacacacacattttgctctgtcagctgaagaggtcaagatacaaggatacacctaacaagtcagatctttgtttctaatactatttgttccaataaaaggaaccagggatccttagagagacggctgattctcaggaagcatacaatataagtctggagcatgttgtagtttcttaaaagaaagaagtacttaatacccacaatgatggagcacatcaaagggagactagagccaatgtaagcagttcctaatggcctacgctgggacgatttgagcaataagataaataaggtagcaatggattatgattcaggtatatatacaataaatattcctgtctacactgacataaataaacagtcgagtaagtaaacaaatagggaacaagatacatctcctgtgcaggagaatttcaaatagtttgtgaagctcttccatcctcaaggaggtagaacataactcctactctgtaagcatggatcgtgcatagtgatttccttccaaagagtaccatatggaaagcttagaaaagagtaactttaaagggtgaaacctgataaacactacctcagccaggtgatcaaggtcaatattaaagtggtaggtcatgttgatagtatgtactcttgtatgatgcaatggaaatgacacttaacttctgtggtcttcctctgcatgtaacaaacatcacactgcaatcctgagaaaagcattaagcaaatcacaattgaggggcattgtacaaaatatcagtacttcttaaaactgtcaaggccatcaaaaacaagaaaagtctgagaagttgtcatagccaagagcagtctacggtggcatgcgactgcaagtaatgcagcaccctggttgggatactggaacagaaaaatagtgtgaggttaataactactaaaatatgaataaagtatggacattaattaaaaattatgtaccaatattggttcattggttatgaccaatgcacctcacttatataggatagaaataataggggagattgggtgtgaagtatatgggaattctactatctttatcacttttctgagcatctaaatcttttaaaataaataaaaagtttattttaaaaaatctcattccaagttttaccccattccaattaaatcagaatttctagggtgtgagaagggatcagtattttttaaacatctcaagtgctgtcaacgtgcagcactggaaacctctgtagtagaagtccctgagctgtggtagctgttatattttggtactccttaattcatacaaaatgtcctgagctaaatgaaaatgttgtgtgttgcctccattttgtacctatgtgaagtcaaaattttaattatgagtatgataaaaataaagtactggaacatgttgcccatttgagcaccacttgatgttacactattggatattgagctcctaactgacaaatgtatcaagcatataattacaagcaatattacatcttaaaatgtctcgtaattttcctccaattgaaatgaaaaaaagaaaaaaggatatgacatgcatactctttcctctgtctgatccctatgctgtctgatcccacattaatatgctttggtggattccaccacgattccatttttctgccgttttttgaccttgtttgtactccaggaggctgactctatggactgcaatcctcaggcctccttgctctctgatttccagttaggtttaggcaagatggaggagacaggtatcatcgttttaacccaagtctttcccttcttcatcatggttctggcagtggctgcgtttgttgcaactccagctcccaccccctctggctcacacttggctctggaaacacagttgccttttctcaccccttcaaactaagagggagtaatggtttcctgctgttgctagtctctaggtaactcaccatcccttttttttttttttaactttactaatatctctgtaaattgtctctttactgaaatattttaactttttgagggtgtcatctgtttcctgataggctttctgactgatgcaattagtctatcattgtcaattctctggaaatgatgactctttctcccccacctctttttaagccaagataacgtcttgcctacttttctggccttaaaaatgttctttgttttgtgaaacaatgttgataatagcgaacattattttccctaaggccttatttggcaaaagtaagagctggcaaacatgctggttccccacatatttttgaaatttcattttcaaaactggagtctgggaaccattgacctaagtgagaattcaactttgaaacattaaggggattcagctatcattcactttaccacaagaatcttacaaatctgatgaaagttgccaatggctgtcacagtagacactcaagttaccgggattcagttgtttgcataacatattgtcccactcctggtaaagagggaagtagtatctgggaaaagtaggaggatcgataaaaattgaagtggttatttttgtatccactgacacagaaggagattttacagcacactatgttttgagtctcaaaaacacacgtattgcatttcactggagatctgatgggggaagggatggagaagaggaaaagagtgcatctgaaagttttagcaagaagttgcaaggactcttcaattaagtatggatgcagtgtgacagtgacttagaacttccatgttcacagatccagcgctgttaactttatactagtctaagtcttttttcttataaataattacaaaagctcattaagcaatacagactgggaactttttttttcctccaaattctagtttatttttaattgacaaatagtaattttataaatttatgggggtacaatatgatattctgatacatgtatactctgtgggatgatcaaatcaggctaattagcattatcagtcatttcaaatatttatcatttctttgtggtgagaacacttaaaatcctctcttagagattttgaaatatgcaatacattattattgcagtcagtatgctgtccaatagaacaccagaacttattcctaactgaaacttcgtatcagctgaacaatatctctcctttccctgtccacactctcacccactgccagcctttggttaccacctttttactctctgtttctatgagtttgactttttaagattccacataaaagtggggtatttgtctagccacgcctggcttatttcattttttttgagaccaagtcttgctctatcgcccaggctggagtgcagtggcgcaatcttggctcactgcaacctctgcctcctgggttcaaacgatcctcctgcttcagcctcccaagtagctgggattacaggcacccgccaccacgcctggttaatttttgtacttttagtagagacgggatttcaccatcttggccagggtagtctcgaactgctgaagtcaagtgatctgtctgcctcagcctcccaaagtgctgggatgataggtgtgagccaccatgcccaactgcttatttcacttaacataatgccctctaggttcattcatattgtcccaaatgacagagttttttaaaatgctgaatagtattccattgtgtgtgtgtgtgtgtgtgtgtatatatatatatacacatatatatgtatatatgtgtgtgtatatatatatacatatatatgtgtatatatatgtgtgtatatatatatatacacacacacacaacattaaaaaaaatccattcatttgttgatgaacacttaggttgtttccatatcttggctactgtgaataatgctgcaatgagcataggagtgcagacatctctttgacatatgatttcaattcttttgcatatacccagaggtagaatttctagatcataaggtaaatctatttttagttttcatatttttaaaacttcatactgtttttcaaaattgttttcaaaattgctgcacttaattgtaataccaccaacagtgtacaagggttccttctccacatacttgctaatacttatctttcgaaatagctgatctaacaggcatgaggtgatatcccattgtagttttaatatgcatttctctgataattagaaatgttgagcattttggtaaatgtatgtcttggccatttgtatgtcttctcctgagaaatgtctatggaaattctttgccagttttttcattgggttatttgttttcttgttattgagtagtttgagtttcttgtgtattttagatattagcctcttatccaatgtataacttaaaatactttttcccagtttatgggttgtttctttactcttttgagattttcctttattgtgcagagtttttagtttgacgcaatcccatctgtctatttttgcttttattgcctgtggttttggcattatagccaagaaatcattccccagaccaatgtcgtgaaacttttccctaggttttcttctagtagttttatagtttcaggtcctatgtttaagtctttaatccattttgagttgaatcttctataagggataaggtaatggtacattttgattattcttcatgtggatatccagttttcacaatatgatttattgaagagatgtcctttccccattgtgtgtgcttggtatctttgtcaaaaatcaattgactgtagatgtataggtttattcctgagctctctgtgctattctgttggtctatgtgtctgtttttatgccagtaccatgttgttttgattactataatttagtaatatattttgacatctgatagtgtgatgaccctggctttgacttttctttctggtcaagattgctttggctatttggggtcttttggacttcatacaaattttagaattttaaaaaatttctgtgaagaatgacattagcattttggtagggattgcaatgactctgtagattgctttgagtaatatggatgtttaaaaaatataaattcttccactccatgagcgcacaatatctttccatttatttgtataattttcaatttatttcatcaatgttttatagtttttggtatacagatcttccacttcctcggttaaattactcctaagtattttattttttttgatactaatgtaaatgggattgttttcctcgtttctttttcagttagtttatggtttgtctataggaatgctactgatttttgtaggttaattttgtatcctgcaactttactgagttagtttatgagttttattaatttttttggttaggtcttcaggattttccatctataagagcatgtcatcagcaaaaagagataattttacttctttctttccaatttggatgccttttacttcttttctcttgcctaattgctctggctaggacttcccgtactatgttgcataggagcggtgagagtggatatccttgccctgtttctgatcttagagaaaaatcttcagcgttcacaattgattgtgacattagctatgggtttggtgtgtatggcctttattgtgttgaggaacattctttctactctgaatttgttgagcgtttttatcatgaaaggatgtttaattctgtcaaacccttttctgcatctattatgatgatcatatgttttttgtccttcattctgtgggcatttttgtttattgatgttttcaattgaatgtgttttataatgtcaagtacatcaaatttagaacagaaagaaaaattttacagtatcttatgcttggatagggtacaagaaacagggcgtatgtttatcacagtttagtctccttgactttaaaattcttctgtgttgggaatatgaggtccttctttgttatgttatgttatatttaatattgagtgaaaaggaattaacacacaattgttttttaaatttttatctgtttaaaaacttcctttgtttttattctcattactttctgttttctgactttaccttaagaaaaacacagagcaatcttttccaattcatttttttcctttgtatacatttaaaagggagttttaaaagggctggatagcttggtcataaagaggagtttttctttaccattacaatccaaacacaagctgtcgtccacatggcatggaataattagagaactcaagaattttctttctcttgacatttctactacttaaacaaaataatggaaactgatttatttcttcctttatctggtgatggaaaccaccctatggaaaacctgggaatggtcagcactatgttttccactatgtggagagagttggtcagtaacaggaaatgaaactgactcatatggagaagcagagacaagagataggattactggtgattttagggttcccgaagaccatctacatatctcccattcctgttgcctgactgttgaaatttttctgattccatgaaataaaaattctcctttttggctaagctattattttgggtgggattctatagggtgcaagtggcaaaaatgtagctacaattagcttaagtaaaaagagggaattgaggagagatccttaggtaactcacagaattaaaggaagactggatcaattgagctttagcaaggcagaagcaagcactttagaagggactcagaacctagggccaagacttaggtaatgcagcagcacacttccctcacgtggcctttgctccttctttctggacactgtgctctctgtggaggaatactttgattaccttatgtgtttccaccagtactttatttaccccataaccctcatctattcattggcatttttatgtgcattgccacagaaggagacgttacagcacactgtgtttttgaatctcaaaagcgcagactaggattgaattcaggctctgaagattaagagagctatcccacgttagcgggaaaaggaaagccaaaagggaaagaaagacagctgagttggtaccactgggaaaggggccctgcacctagtagatgatactgtcactaggcaacacacagggggcatttgtgtttattgttttaaattgaatatgttttataatgtcaagtacagccaatctgtaattgaaacaaaaactttgaagtactctgtgaaattcatctctgaggactgaaccctctgggggaggagcaatagacactcccactgcaccccaccctgggtgacagagtgagaccctgtctcacaaaaaaaacaaaacaaaacacttattttagaattgttttagagctaaagaaaaattgcaaagatagtacagaaagttctcgtgtactgtacacccagtttcccctattattaacaatcttacattctttctgtcacatttctgacaaacagtaacatctgcttaaatacttccagtgactggcaacccagtgtgtcctaaagagccccattgtcagatgattctagagcagtgtgactagagatgtggttctaggaccaccaacatccacacaacctggaatctggttagaaatgaagagtctcagaccccaatccagacctgaatcagaatctacattcaataggatctccaggtaattcatgtggacatccaaatttgaaaagtattgctctagtgttcatatatatatgtatacacacacacacacacacacacacacacacacacacacacacgtgtatttttcccaaaagatggcaaccaaggtcttgcaatcacattgccccattcattaattcatctgtgtattcacaaaacattttttaagagcatatgtgctaagaactgatttaacttgaaactttttttagaagtaagatcttattcctacactaaaaaatttcacattccaattctgccatgcaagaggtagttgaatgaacagggtaatttttgttcagaaaagagaggactaagtttgaagagttgtccctgagagactagcaaatgcaggaaaatgccacaatctgtagaaaactatcacaacagctgagagaataacagagtagaaagagctactcccctttattccagatagagctaggggtggagagaaaacccctctgcaactcgggttagtgtattagtctgctctctaattgctgtaaagaaatacctgagactgggtaatttatagagaaaagaggttaaattgactcatggttctgcagactgtacaggaagcgtagtgacttctgcttctggggacgcctcaggaagcttccaatcatggcagaaggcaaacggggagcaagctgtttcacatggtgggagcaggaacaagagggtgaagggggagatgctacacacttttaaaccagcagatgttgtgagaactcactcattacagcgaggacagcaaagacccatgagagatttgcccccatgacccagacacctcccactcactaccacaagaacagcaccaaggggatggtgctaaactattcaatagaaactgcccccatgatccaatcacctccctccaggccccacctccaacactggggattacaactggacatgagatttgggcggggacacaaatctaaaccctatcaggtagcatggggcagtatgtaggaatagctgcgtgatgaaggtcctcagatctgaagcagcctcatggagttccaacttgcctcagcaaggtgtaggagcagtagactaattcctgagcctagcatagtcatgttgctgcgccttcacccaggtgcccagatcccagaatggtgctggagaacacttttcaatgcacttcagcagggcatcaggggccaggaaggagagtcattgatcctgaagtgacctttggcatggatccatgtagatcaacacttgaaaaacagacaggatgaggagggagatgccaaattcaacaaatgaccaaatatcagaacgtttgcttattctggccctgccttccttctgtcccgtgtcccttgcttaaaattagatgtgaactgaaggaaaagaaatgggagcctgaattcattgaggctgagtttctatcatctagtaaaacaggatctcattgaagaaattaagttcagttgcatgaaaaaattaagccacgctttctgatcatctgcttatgtgacctgaaatttaaattttgtcttctacttcagactgtgttcttatatgcggcagagaacctggctactagcagctgcagcttgcaactgcatatattcaccatctggaaggaaaaagctcttcacctccttgactcttacagcatggtgccctcatccaagctcctgtttgaaaagcttcagagaacaatcttgactggcctttttctagtcatgttctcatcctatttaccaattacagagttaggaatgtgagatactatgatggttccagcttggagctcttgctatgtggcctctgaagccagcatgctgtaactggtagctctgcctagatccatgtgcttggtgttagggaaggaacagtttctctgccaaaagggaataaatactttgatcagaggtagaggaggaggggaacaggctgataaaaacactgaactgcattatctaccttgtgtgcctatactaataaaggtttccttaatgtcacattgatatgatcaaagcaagaaactaaaattatgaacaagatactgactatgtcttttatgactcattagttcagaattagaacctgggctctggaaaaaaaataacacagccatttcattgtaaatttgtaaactttgcagcagtttaaccatgagagttggcatataggtcagggaataggcctggtgggttttgctgtcaaatcccattatactcctgcagagaataaagtgctttgtgcttcgtgaaaattggtttgtagtatgtgtgtaccaattatcaggattgtcagaaatgttggccaatttcctttcaggttcatagggacttaaatctgaaatacttctctacaaaaactttacttagctgcataattctgaaatagctttattctggccaactgcttatttataacagccttttcaggtaatattctaggagttatttctcaagatttattccctttatttttcttgatattctttcaggtgcaaggaaataaaaaataatttggcttatgtatacaatttggataattttgtagtttttcttacactgtgttgctcatttatgagaaataggcaaatagataaagaaaattcggttactgcatgaagtactgaaaaaatgtaaaaaaaattccttggggaagtcatattttagtccacgttctgttgttaattttaatcttggggttaagtaatttttgctcttggtatgagattataaacaaacaatccaattgacttgcctttcaactctgaacagtttcttgatcacagtgtaaatagctgcttgaatttcactgctgttacatagcttttcagatagtcaaggaaatatgattctgccatattcatgccagcagattccaaagggcaaggaaagatgtttcaacagatcaggagtctaaatgagttacacgttgagcaattggccagtgaagagccaccaacagtaactgggcagccccaggcctgtaggagcatctgaatggttctagttcccaggaagagcttccaaagaacacatggtcttacatagatattttcaaatagctgttttcctcccaattattttagtaaacctatgattgttgtagataaattagaaaagtaaatataaacaggaaaataaacttatgcattattccataatctgaagatgcctttgataacattttggtgtatagctcatcattttttcttatgcatatatattttaaaatccatttagattatgctgaatatataattcctataatatatgttctgtggtaatttagaataaaaatcccttcggtatgtgaatttaaaacaaattataggcatataatcattgtgaagtatctattcttcaaatcacttttttgttctttttagttatacaaatgggaaacagtaaaatttgccttttatacttgagtccaatatatattatttgagcaatttctaaatctaagatactgtcataaatactttaggaaatagcgaaacaacattaataagacataacatttgccctcagggcatttatatagggatacgcataagcaatcattagatgaatcagataatgtttcatgataaaatggaaaccaaataaatttataaacgatcatagaccttagatagcatggtcccaatctgggagattacaaggaatattttgttggatcttgacgtattggccaggatctcagccagcagatgatggtggtgggtgatggttgagggagggatgctgtggaatgaaggaataacattcaggatggcatagcatgaacaaaaccaggaagtgaaaataaatgcaaagatgctcttaagtcactgtgagttctctgctgaagcggaagaaaacactggtaaattaagttgacaatactctgagaacgaatttcagttccagacttagtttaaactttatcctgtaggcagtgcagagacacagatgcttttgagcaagtccgtaaaatggtcaaggctgtaccttaagaatatctcatggaaacttaaattcctagaaggaatgacaaaaccattttttgtgtaggtaagtgttcatataactgttctctaaacatctcatatttattttttaatataagttatagatacagttttatttttacttttgtaccccaagaataccttcttagaacttcttagaaaagcataaggatatcctgaagtattttaatgtctaaactttcttgttattagtatttgtttttctcaatttatggcttgacaatagagtgttcgtttgttctgtatgtatttgttcctcttgtctttctttcatagaatgcccctttcattcaaaaagcattaatggagcaactatatgagtagactatcgtattgtataatgagcactataaaaactgtgtgtcctggagaatttgggttaaattatctggctgggcctggagatagcactttagtaagatacattttgaatatcatgaaatttaaagaaaaaattgctagcacttaagatagtcaacttggttagttgatatcaattatcctgttaattaaggattttgaaactcagattctcctgatttgttgttcaatttcctttctaaaattttaaagtacttttcttttattgcttattagctatttggtttaactttaaattgctaaaactttttgaagaatgaaatgtattttacagttaccatttgcatttaatgtgtaaaattgattttaggctttcattaagtcaacttttatactcaaggtttagaattttccttgattacaggtggctcacacctgtaatctcagcactttgggaggctgaggcaggcggatcacaaggtcaggagattgagaccatcctggctaacatggtgaaaccctgtctctactaaaaatacaaaaaaattagccggattagcccggcgtggtggcacacacctgtaatcccagctacttgggaggctgaggcaggagaatcacttgaacccaggaggtggaggttgcagtgagccgagatcactccactgcactccagcctgggcgaaagagcgagactccgtctcaaaaaaaaacaaaccaaaccaaaccaaaccaaaaaaaactactttccattgctaaatgtgtttccggctcaagcagagatactggttgccatttactcaaataagcaagcctactaattatctgcaaatggcatgtcaagtgacccccaaaattaaacatctttatgtaaaaggttttctcttctaatgtttactttggtctcagaatccattatttaattaaacagttatattgtttatccagctaatgcaactcagtgcgtaagaaggcatttacttaaatctaagaatatacttgaatttttattgctattaattgtattggtgaattcttttgtaccatagcacctttcaagtttgaaaatgcagctcttttgctgttagatgtaagtgcctctgtacccatttcataaagactcatcacctattctgagaccttgattttgccaccccatcacccttttcccttccaaaggcaaggacaaaccagagcaattgtagcaacacgaaatcgcaaaagaaagacaaagcttcatggttctctttacaccataataaccgagcagtctcaaatctctcattaaattttagtgtttcgagtaatctcccatggtttttagatggtaatagtaatgtccttttacctctaccagtttgttccagacttctttgatattacaaatgggatacggtgtataaagctggtcaaagtcaagaaaactttggtaaatactcctgtaactatagatactggtggttcctgcagggtattggtattccagacctgaaagattcatacacaatcaatctgaaagtcagagcagagcaaatgcaccataagctgtgaagttacttagtggttctttgactgcttaactgagctggtgaaagtcagggcctgtgtatatatgtttaagtgataatctgcatcagttaattttcctgtttcagatttgccagttcaccctgaccatcttgaaaataagttatctctgatctctgtctgtatgttacttctctcccctcaccaacggagaacaaatgtgggcaaagtaagtaaagcaatcaccacctttggagggaagaattggtcatgttctatggatggtggatcaactctattgcggatactcagtaacatttttactctctaactcatcatttacacctcaaatcttttttatttaaatgctctgaagttgtagctttgaataatagtcttcgatgtggtaggggccttaatcaccatcattctagtctaactcgtctcccatcaaatcccatcctatgacattcctgatgaacataatttagcctctatttaaaaatatctatgatgaagagtgcattgtcttaccagaaagcccattccacttccaattgttgtgagagttagaaagttattcctcagttttggtttaaacctggctccctcttcattccacacattgacattagttcagtttacaggagctacatagaatagtctaccatattttcctcatgactgtctttccaatatgtgaagtgaactataattcttgccttcctcctaaatgtagttttctccaatttcatttggtatgcctattaaaatgcagagtcctgtttctccagaggtttttgttgattaggtttctggtaggcctaggatttctgtctgttttgtagtgtgatctgtgtttacatccgagtagttttatcaggctgtttcttgtctgtggaattttggaggtccaatagctttcttttgtcttgtactctatcctttaaatttcaaagtggcagtgtttccactggtttaaaattctcaagaatcttgtagttttcctgtgtatattagagaaattcactcctgaagaaaagaagcttgtttatagatttttcttagataatcttgtctctattttgggggtctgctgagaaggccgagggggtccatgagtcacctgtttaatctctttaaagagccttttgtgtgactgaatactgatttttatctttctgaggtaatagcaaaagtgttaccagccacacttctggctttttctctacaatgcacttttctggcagcgaatccttaatttttgctgataacattttaagtcatcaagtcctggccacttttggtttcaccgttctttccctaatttttatctttccttttacatcttactataagcagcgagaaaccaaaatgtgccttcaacactgcttgaaaatctcctcagctatatgcccaacttcattgtttacaaattctgctttccacataactgcaggacacaattctgccaagctttctatcactatgtaacaagtatcacccttcctccagtttccaataacacctttctcatttccacctgagtcctcactagcagccagcttttttcttttttctttttctcttttctttctttctttctttttctttctttctttctttctttctttctttctttctttctttctctctttctctgtttctttctttctctttcttctttcttctttttcttttctttttctctctctctttccttccttccttctttcttctttctttctctttctttctctttcttcttttcttttctttctttctctctctccttccttccttccttccttctctccttccttccatcctctgtgtctctctctccttccttccttccttccttccttccttccttccttccttcctttccttccttccttccttccgggtctcattttgtcacccagcctggagtgcagtggtgtgatctcagcctactgcaacctccacctcccaggctcaagaaattcccccacctcagtctcccaagtagctgggactacaggtgcacaccaccacaccctgctaatttttgtattttcagtagagactgggttttgccatgttgcccatgctggtctcaaacccctgggctcaagtgatccacctgcctgagcttcctaaaatgctgggatcacaggtgtgagccactgtgcctggtctccagcagccactttcatgtccgtatttctatcaatagcctgttaataatgatttaggtattctctagggtaatatatatttttctctaccttgcttctcacttccttctgaagaagcagagttgttaacatccatatttctactaaaagtctgtttaagatagccttctaactttctaacttagcagacttttagtagaaatatggattctaacaactctacttcctcagaaggaagtgagaaggtcttgatctgtcgcccaggctagaagtacagtggtgtgatcacagctcactgcagccttgacttttgagtttgagcaatcctcacacctcagcctcccaaatagctaaaattacaggtctgccccaccaagcctggctaatttacaaaaaaaaatgttttttttgttttgttttgtttttgttttttgagatggagtctcgctctgttgcccaggctggagtgagtggcatgatctcagctcactgcaacctccacctcctgggttcatgccattctcctgcctcagcctcccaagtagctgggactacaggggcctgccaccacgcccggctaattttttgtattttaagtagagacggggtttcaccgtgttagccagaatggtctcgatctcctgacctcgtgatctgccagccttggcctcccaaagtgctgagattacaggcatgagccacagcacctggccaaaaaaatgttttttaaatatagggtcttgctatgatgcccaggctggtcttgaactcctaggccttaagtgatgctcctgccttggactcccaaagtgttgggattacaggagtgagccaccatgcctggacttaaccggtttgcccagagaatacccaccagtggcgtctgtagctgtagcatttaccccaagataactttgccaagaaatatgcttttattattattttcgcatccctctggtatattgacttcagaaacaaaagacatcactctattgatcacattctgtttttagtagtgatatttccatttacaaaatatagtaattctcaatccctgaaaatgtcaaatcctagaaaatgtggcattcctatgaatgatgttaacatcattattgaagagttgtttgccaagaccagctcggctggggagaccctaacccagcggcgctagaagaattaaagacacacacacagaaatattgcatgtggagtggaaaatcaggggtctcagccttcagagctgagaacctcgaacagagatttacccacatacttattgacagcaagccagtgataagcattgtttctatagattatagattaactaaaagcatttcttatgggaaataaagggattggctgaagtaaagggatgggttgggctagttatctgcagcatgaatatgtccttaaggcacagatcgctcatgctattgcttgtggtttaagaacgcctttaagtggtttttggccctgggtgggccaggtgttccttgctctcattccggtaaacccacaaccttcagcatgggtgtcatggctatcacaaacatgtcacagtgctgcagagattttgcttatggccagttttggggccagtttatggccagatttgggggcctgttcccaacagttgttggccaaagattcatttgattaacctgatttttccgtaacagacgattccgatgattctggtgttagctctgtttagaaataactccaagaacagtttttatattttattttcacattgaaaatcagtcagatttgcttcagcctcaaagaatgtgtctaatgaaaattaaatgagcgctggcagtgagctgcacttttctttttctaaatggaaaaagggttaaggccttttgtctgatcgaaaacccttaaaacagccatctgactcaaaggcctgacagaaccaggcccaccatgattatctaggataatctcttgcatgtacagtcaactgattatggactttaatgacatctagcgactcctggattagtgtttgattatgtaattggggactgcagcctagccatactgatacatcaaaaagactgtcacggtgtcttctatcacttattccattaaccaaagctgccacctcacataacacaataatttattttcacttgaacatttaggttttaaagggacttattctcagagacatgttaggaatcaaaatagaaatagttccatatcattggctcattgaacacaatagttcttgaattagcagttacaacttacaagttgtaaattgtttttccatgaggacttaaaagtttcatgtacattaaatataaatttcttttggctggaaatggcattggtactatttaaatagtctattgctggctgggcacggtggctcacacctgtaatcccagcactttgggaggttgaggcgggcggatcaattgacgtcaggagtttgagaccagcctggtcaacattgtgaaaccccgtctctactaaaaatacaaaaattacgtgggtgtagtggtggacacctgtaatcccagctactcggaaggcttttatatgcatttttgaatgcaaatttttaagatctgtgtggtaattagacatataatcatagttataattattattttatactgaaaaactttccaaaagacatttagggtatcatggccaaagcgagtcactgttttatttaaaactacagtcagttcaaccacaagcttttctgagtgtctattgtagtggatatatgtgcttttctttgtcaacttccccatcagtaaaagcaccctaattttattttggggttccactttctccctgccctcagtaatttggttaggttaagactcaccctcctcatatcccccattttccaggtttacttggaaaatagtttccaggtttaccattttcccatttacttgggcagtcatcatattccaactctctggccacacgactggtgcggggatgggcctgtaacccatgtaagtcaatgaataagacccagcttggtagttattaagatataggttgattgcttaaaattgtaagagtggaagagtaagaaggaaagtcaaagagaaaacagttgagccggaaagaaaacggagtcattcaaatcattattcgtaaagagtttcaagaagtggcgtatcaatattctcaacttaatagttgggcaatatttatgtttttgaaactaacaactaaaatacttggataaaatatttctcctgatttaagtaactataatttcagtcatgattcattgttcccagcaggatctgtatctgtgtaagtgggcatagtattgattttttttcaaaagagaagataggtgatctcattaatttccttttcacatcaaagctttccttttagggttttttttttttccttctctcaaaaaaaatactgaatgagtcagggtgctaatctgctttgctctagtaaattctatcttctcattgtagagatgtttttcaccgtagtaataatttgcttagctgcttggtatttactcatgtattcattcacagttctttatcaggcttcaggtatgtacccaatattgtgccaggtgaaatgagattcaaaggtgtctcctagcctagaatgtaaattctataaggaccttctcactcggagcacagtattggcacattatcagaaatctatacagatgcatttaggatgcatttctgtaacaatggtcacttgtgaggtgccatgcttgaccttcaagtattgcctgaaactcaaacacaagttgagggtttgagcctttgtacttgtttcctacagggcagttattcttcaaaatgcccaggtttaatgatacttatttttattttttattatttatttacttttttgagacggagtctcactgtcaccaaggctggagtgcagtggtgtgatctcggttcaatgcaacctctgcctcctggattcaaccgattctcttgcctcaggcccccaagtagctgagattacaggtgtgcaccaccacacccagctaatttttgtatttttaatggagatggggtttcaccatgttggtcaggctggtcttgaactcctgggctcaagtagtctgcccacttcagtctcccaaagtgctgggattacaggcatgagccaccatgcccggcgatacttatttttagtagttcacaatgaaataattaattatatttagtgccaatacaatttcaaataatgatgctggaatgacacccgataccacagtaggcaatgattttgatctctattagtttactagttatagtgggttaaatagtgacttcccaccaaaaatgcccacatcctaattcctgtaacctgtgaatgtgaccttatttggaaaaagggtctttgcagatgtaactacgttaagaatctcgagatgagaccatcctgaattatctggttggtccctaaatccaaagacaaatgtcctttacaacaaaaagaagagaagagggcacagacacagaggagaaggcaagtgaagatgaaggcagagactggagttacgtggccacaagccaaagaattcctgaagccaccagaggcaaggaaggattttctcatagagccttgggagccagtacacacctgctgacaccttgattttggaattttagtctccagagcagtgagagaatacatctctgtttgagcattaagtttgtggtaatttgttacagcagacctaggaaactaatatgttagttcgtactgattatttaattaaaggctctttttgtattgttttgttttctaaatagtctgcagaaacctacctcaatttttgtctccatccaatagagacacctgtctgtctgttgagatttggtggaaatccaagggttagtgtttctgggttatttttcgcctaccacagatagtgctgaaagcccatttagtacacaaatatgacacttctgaataaagtggcttcaacaactggtctggagatccaagtgctattcaaaaaagtgacactcgttctgagaggcgattcctatgaaggagaagctccatttgcgaagttatagcaaggttccttccataatgcacagcagctgggccagggagccgggagtcgtcgcttctggcctacccatctctgggctacttcccgcaactcactttccctgtgtgcctggaatgcttcttcctatgaggccgttagtcaaattaagtagaggcctttaaaaattagccatccatccaatctagagaatgtccactacgcttcattctttctcccttaccctgttgatttcttccatatcacccagcgctgatggtaattgtatgaatacatgcttatctgtctgtcctcccacccctaactctaaattcaaggaactctataactgcacctagcatattgtctgacactcctcaataaagacgcatttaatacatagacaaataatgagtgaacattttgagtggagggccggaaaatgtctatttactttggagttggaatcagactgttcaagagtactttcaaaaaaaattttgctacgtcaaacatcattgaatttcaggattgaaagagtggtggtcatatagctcaatcccctccaaacacccccacccaccagatgcgcgaatgccctcttcagccttcctgataagcatgacgaagatgctggcggaagcatccctggtatcaggaaactcatgacctcactagttttgatcttttccatttagctttcttttcccactcctcccagttattgcaaccttaattgtagcattttacacaactgctgctgcagagttctggaagtctgggggtgggagggacgggggaaccccagtgcctatctcaagcctgcggtcaccgacgcgggtccggggtgggggggtactgccagggaactcgcggcaccgcgtgcttgctgagttcgcctgggctctcggcctccctgcgggcaggggtcctccctccccagcgccgggtctctcctcccgcaggcccgcggccacccgcagcggcattccccgccgccgcccccgccacctgcgcgaccgccctagccgctcgagtccgctcctcccgctcaggggcggctgcggagggcgcggggcgcacgcgggcggccacccgactcttccctcccttctccccaccccagcctgctcctgctcagccccacctccccacgcactcggctgccctcctcctctcctgagagttgccccgcaccttgggcgaggagttcggagcggccccatcgcagagcccacggccagccgagcgcgcgcgacgcaggtgcccgagccccggcgccgccgccatctctgccttcggtcgagttggacccccggatcaaggtgggacctgcttccctctccgacaccccctattgccacctcttcccgctctgggtaactcgagaatggggctttgggacgcgcgtggcagacgcggagccccgcgggccgcttagggactgggagtccggggcagcttagcgggaccaccagaggggccagcgcccggcgggcggcgggggtggggtgggtgcgacgccgggcgactctcggctcccgtggggcgaggaagatctggacacacggctgacagcagccggcagcgcctggagcgaacctgctcgggaccaccgagagagcatgccacccggccaacttcttttccaggcttcgtgcctactttggaaactgaagggactgccacctaaaacagtaaaccctggggtcctgaagagaatttgctggttcgaatgacaagagaaaaaataattgttctgtagggatggtttagacctcagcttttgtttcccacctccccccttccctgcaagcaaattaaacaacaacagtagcagcatcagcagcaaaaccccaaacccaatcctaaccaaaccacttactgaaagagatttgtagtggtgagaaaaagagacccaactgaggaatcatttgggaaccgcaggtatggtgccatttaaaaactggttctttctggtgttatttctagaacttgtgtttgcaaacagattagaattctgggctcttgtcagcctaatggagttctttatactgaagggtggcctggggtgtcctctgttaacatttatttctgtaagtattaaagtatattgaaacaaataccctttcacggctctggaattggaatcagaaaatctgagttttggtgtgatttccattttattacctatgacactgtggttcgtttaacctcagtgggcctcagtttcctcattttttcaagttggagggttggattaagataatttctgagggccttttgagaatatctaaggtatgccccagaataaaaaagtataattccttaactctctttaacttgttacaaacattgctagtttcataatttcatgaaataaaaacaatctgtattaatcttggcactagtttatatgcatttatgacttaggcttttaggattttcccaccaaaaggtatagagaaaaacatgtataaagagctcagaaacatatagatttatatgaatatttacacctctcatactaccttaaataatctttaagccagtatttgcaacactgcaacaaaaatacatggctttagcatagcacgtattctctttaagtattgtacatctggaggaaataaaaatgtgtttgaaggaaaacaaacattgcacctttcctatcaattattgttcttgaacagtgctggctactttttagcataaagttgtgggcagaatgttaaaaaattggtttcaggtcacttctgagccgctgtgaaattaagcacaatagcagagatgccaattttagtaatgcagttagttgccttggaatgaatcccagaaaatagcagagattaactaaacagataaaccagaaattaggaatggacacacgcacacacaaaagtgtctacagtgagtatgtactgtgaagggttagtgtacttcatactttctttttgattagaagaaaatgtcgggttgttttagcagacagagaatgttacagtagcttttgttgctacttctaatgttttatcagtagcattttcaagattatttgaaacttagttatcactagtaaggacaggtttaagaatatttctgcctcttttcggtggcttggattcaaaataataaaacaatcttttctcacccacatgtactttgtatgcagtttgggagagtgaaatggatttgaagtactcttttatgagtacattttaacttattttcagtgactttttgcctttgggctggaaatgtcgtaagttactcaggcatttatcttccctcatattctctggtgaagtagagatagtcatctccgttgaaacagatgctcagagatgtaagtaaattgcttgttgagtgaacagggaatcgtagaactcaaatataccctggttgctaagtcatttggaaaacaactgaaactggatggatccaacagctcacggtccacagccaactcattcatggcttgggagtgtcatcatgggtggcagaggctctgttcctcctttgtaatgtggggacttactctctcagcaatttactgagaaaaaagtaatctcttcacacttagatcactattataggaacaaatggtgtgtatttgtgaagtgcaatatttctgggaggtcttggaaataaatactaaaagtatccagaaaaaaaaaaaaaagaactctcttggcagatattgtactgcatttttcatactgagagccaaacacacccacttaaagagtatgtcctgtggagttaaaaatgaagaaaaaggcttatagtctgctctaattcttaagactttatgtgatttacaaattccagttttaattaaattagaaagttgcaaatgttcacctactggccacactcagtatgtacaaccttttggagttgctcttcaaatacgatctgcttatagtttggaatattccttctcaaacatgttttttggagtcttgctatgttgcccaggctgatttaatactttttgtgacttaatagtgatattacctgttatcatcacacataatcttattaatatttaaaatattttaaaactacaaatcttatataaatataaataaaatctttaaaacatttgaactgtaatgaatatagagagaagcatataaaacaaatttaatggttgacagataatatgataaatcattataataattgtaaggcaaatttctcattattcaccacccccaaaaaaagaacattgcaaatatcccaaaacttcttgtttgttccttcttcatcacaaatctaatttacctttttttaaaaaaagaaagttatttacttatttattttgagacggtgtcttgctctgtcgcccaggttggagtgcaatggctcgatcccagctcactgcaacctccgcctcccaggttcaagcgattctcctgcctcagcctcccaagtatctgggattacaggcgtgtgcctccacacctggctattttttttttttttttgtatttttagtagagatggggtttcaccgtgttagccaggatggtctcaatctcctgacctcatgatctgcccacttcggcctcccaaagtgctgggattacaggtgtgagccatcatgcctggcccaaaaaaagttttatatgattatggtaggcattaaatcatagattattttgcttaacattatgtttatgagattaagggatttcttctctctcctttaaaacaatattttttgaaagagttatctcggctgggcatggtgcctcacgcctgtaatcctagcattttcggaggctgagacgggtggatcacaaggtcaggagttcaagaccagcttggccaagatggtgaaatcccatctctactaaaaatataaaaaaatttatccagacctggtggcaggcgcctgtaatcccagctactccggaggctgaggcagagaattgcttgaacctgggagacggaggttgcagtgagccaagatcgcaccactgcactccagcctgggagacgagtgagactctgtctcaaaaagaaaaagaaaggaaggaagggaggaagggagggagggagggagggagggaggattgtctctattccctgtctccaattattctcttcacactgttaaaaaaaactcattcctattaatcttgttttcaatattctgctaaaactacgtcaaggtctactactgtcaagttcaccaatgatactacctttgctcatccagtagtcagttgtcagtgttcattttacttcactactggtagcattgtcacggttattactctgctccttgaaacagtcccttactgacttccaggacaccatgcattcttgattttcctccttcttcactggctgctcctttctgtctcctgtgctagcctctcctcttttcttagaggttttaaccttggaataccttaaggtttagctcttttttctccatgctttttgatgatttcatgcaatctctctatgtgtgtgtgttgatgattccgaaagtgatagctcaagccttgactgctccctctggacttcagatctttatattccagctgtctactgagcatttccatttggatgtctagtaggcatctccagttcaaattctccacatggaatcttcatctttcccaaacctgcactatctgcagtcttcctcatctccatctttcaagttagttaggccccaaaccttggagtcatcttcgattcctcctattctctcatacctcgtttgtaatgtgttggggaattctctgtgctctatcttcaaaacaaatccagaatataatgacttctcattacttccatggctctgttacaggaaaggggtcccaatccagaccccaagagagggttcttggatctcatgcaagaaagaattcagggcaattaggtagagtaaagtgaaaacaagtttatttggaaagtgaaggaataaaagaatggctactccatagagcagccccaaggtctgctggttgcccatttttatggctatttcttgatgatatgctgaacacggggtggattattcatgcctcccctttttagaccatattgggtaacttcctgacattgccatggcatttgtaaactttcatggcgctggtgggagtgtagtagtggggacaaccagacgtcactctcgtcatcatcttgattttggtgggttttggccatcttttttactgcaacctgttttatcagcaagatctttatgacctgtatcttgtcctgacctcctatctcatcctgtgacttagaatgtcttaactgtttgggaatgcagcccagtaggtctcagcctcattttacccagcccctactcaagatggagttgctctggttcagacgcctctgacagctcccaccctagtacaaggtgccatcaactctcacgtgagttattgcaaggacctccaaactggtctccctgcttttattttttgccctcttcaatacattctcaaaatagcaatcagagcactccttttataatgcatgtcggatcatgtcacttttctcctccaaactctccatggatttctggttcacacagagtaaaaaccaaagtccttaggataacctccaaggccctacctgatcattctgcttgccactttacctgtctggtctcatttcctactgttcttcctttcactttactcagttccagccacactgggctccttgctatttcttgactatattagaaaccatcttttcattttagcttttcctgccttgaatgcttgtcctccagatttccacatggttcgctttgttactgtcacttcttttaagtcttcgttcaaatgtctccttttcaatgaggcctactctgattacagtatttaaaattccatatcttcttaccttgtaatatattctttttcctttcctttcctttcctttcctcctttcctttcctttcctctcttctcctctcctctcctttgtgtctccctatagcattattttaccttataaaatactgtgtgactttctaattatcttttttttttctgtcccatttccactagaatgtgaactccacaagggcagaattttgtcctgttttgctcactgttgtgtccctagtgtgtgaaatagggcctaacatgtaagaggtgctcaatgctttttttggtgattgaatgctattgtttgttcatttttattcctggatatattcaattctataaatataacacgttaatttaaaacatgaattctgattatgcacatttagtttccttcctttcttcttccctcacccatcacttcttccttcctgccttcctcccttccttcttttttgccactataaataaagcagctatgatccatctacaagtgtgctagtatacgaagtttctttagagcgtaaaaccaatagacaaattacgggctagcaggacttgcagacttcaactttattagataatgaatgccacacatttttagtgtggattcaccaatttgcattcctgtttttattgctctacaccagatggacaaacttcgtattgccagaacatttaatttttcgccatctgatgggtattatctcattaatagttactactttaattactggtgagattaagcctggtgtctgtgaggataggttaggttatgctgcagtaacagataatcttcaaatctcatgggcttaatgcagttcttcactgatgcaaagtctcctatggactaagacaactctctggggcaacttctccatgtaataacttggaggtctaagttcagggaaactccatcattctgtaactgtaacaatctggaacatggaactttcccatttggtgtggtaggggaaaagacagcagggatggatactcgtgagccatcttcaaatgcttccatctgaaagtgacatgaattattttcaaatgctaaacgtaagtgtttaagatagtcatatggtaatatgacccagtaattctattcctaggcatatacctaagatggatgaaaatatacatccacacaaaaagttgtacagaagtgtcagtggcaacattcttcataataaccaaaaaacagaaactgcccaaatgtccatacactgatgaatggataaacaaactgaggtatatccatacaatggaatattattaggcaataaaagggaatgaagtgctgataaatgcttcaacacgatgatccttgaaaacatgatgctaacagaaggaagccagttactaaagaccccaggattttatttatatgaactgtccagaataggcaagtccataaacacagaaagcagatcagtggttgccggggatggaggaagctggtgaaaggggagcgactgctaatgaggaagaggtgcattgtggggtgatgataatattttgaaattagacagtggtgatgattgctctgttagatacattcactcaatgtactaaacctagtgaattgtatgctataaaagagtgaactttatgatatatgaataatagaccaataaaactgatattttaaaaaatactttaaaaataaagtatatttctatatgccatcaagaaacagaaaatgaaatattttagaaatgcatcatttaaaatgattccaaaaacatgaagttcctgtgaaaaacatctaacaagatgttcagggacttttatggaaaaaattagatgagatttacatctcatattagggaagaactcagtatatggagacagatagtcatacattttaggactgaatgattaaaggatatcaatttccttttcattgttatagactcaaaacagtctcaataggatctctattaaattcctaacaatttttttagaacttgacaagctgattctaagatgtatatggaaagtcaaaacccaaagaatgctaaagcactcttgaaaaagatgcaaaatgggagaatttgtgctatcggatagcaagactcgttttaaatctgtagtaatcaagacaatgtttctttattatttctttttcccttctactttctttgattttttctgttctaactgcttaagtgaatgttcgattaaatgttttattctaacagattataaaggaatgatagcacattaattttcagcctttcttctttttgaaaagtattatttatggctttgagctgccttctacatacttctttatctgtgtgaaataaattttgagatactgttttcactaagatcagtttaaaataggttctgattttcatatttctttttgcccagttattaacttaaaagtatttttctggttaattgaaactttagtcaatttggagtaagcttcttgatttctaatgtttctttttgcattaaagcctattttgtatgatattgatataactccaccagctttcttttgttccgtatgtgcatgttaaatcttttttccatcctttgctttcagatttctacatacttattttaaatgtgtctctgtatcctatatcatttttctgtcattctgcattcaacctttctatattcttatgttttagatgtgtctgtagtaaacagcatttatttcttaaggtattttaaattcaatgtctttccactggagaattttgtcagtttacatttaatacaattactgatatattgaggcttgtatttactttctgctttctttatttgcccataattctggttattttcttttttattgccacattttaggttgattatttttatcacttcaaattttctttcattactttaagagttatacactctatttctattgttcagtaactactgtggaagttaccatatgaatccttaagttatcgaagttgaaaatgaatacactttgagcactaatgagtacaggaaaatacagaggccttagcttactttaacttcatttaatactctcttgccatatattgtgagcatcttgaattccatttatttattcaaatatttattgagagcttactcggggctaagcattattctagatactgaacaaaatagatgagcatccctgtgcttgtaagacataacagagtgcaaacaataaacttaatagagtaaattataccatatactagaaggtagtaagtatatggaaaaaaaactagagcaaggcgaaagagattaggagtgccgagagagggagaaagagaatgaatgagagtgagtgcacataagtacaagtgaaagtgagtgagtgtgccctagctttggaccaatactgtctataaagtttgtggggacatataaatgttttatctattttcactagataacagctgaaaggtttgagccaaatagagagtctcaggtgcttctataatggtattataataggctttaaaaacgtgaaaaactcatgtttaagaacagctgttaccaactatctgttttgtgagggtggaggacaacttagtttttctcagaattaattatactttcttattgtaactttagccgctgttatttgggtctctaaacctatacaaattaagaagctatgaacatgagagaatcaaacaattagatttctgtgcacaccaacagaatttctgaaccaaagtggtttgtgtttaggagatgaaagagatgataaatcatacacacacacatagataaacacacatattatatgcatgtgtgtgcatgtgtgtgtgtgtataaacacagagagaaaacatactggcatacacataagcacctgttaattgtagttgctgttatagtagtaagatgttatctcttagaattatggtatacttatcatattagacctatccaggaggtagctgggtatctagtgtggtgatactatctagtgtggtgtcttgcaacaacactgctagtcataggtctgatttgggggagaaaatatttttttaagacagtgtctcgctctatcacccaggctgaagtgcagtggcatgatcatagctcattgcagcctcagtctctgggttcaagctaccctcctgcctcagtgtccccactgcatgctaccacacctggctaattttttcaaatttttagtagggacgaagtcttgctatgttacacagggtggtctcaaactcctgaactcaagtgatcctcccgctttggcctcccaaagcgcagggattacaggtgtggaccatcgtgccaggctgggagaaaagttttgttgacacaacaaacaggatgcaaagaaacaatctataaaaacagtaatttaggtaagtggcttcttggtcttttgattaataggattctaaacttgcaaatcaattcttatgcaggagttcttattggcatttaccgatgctctttggctgatgtttgtttttactgaccagaggttctgtgggaatctcatttattaatacttacaatgtgcttcatattcctctgcatctttgagggacaattaaatgtccactctatggaatcttttataatttcccaatcataagtaattactctgatttctcctaattacccttttttctaggtagttgtgattctttaagtctaagacagcatggatttttaagctacaccactgatatagtttggataatagtcccctccaaatctcatgttgaaacttgattcccagtgttagaggtgagtcctgaagtgggaggtgtttaggtcatggagcagatccccaaagagtggcttggtgacatcatcacagtaatgagcatgttcttactctattagttcctgtgagcactgatttttaaaaagagcttggcttgtccctcctctctcttgcttccatgctgtcactatgtgatctctgcatgctggcttcctttcccctctcctttgcctgcactatgagtggaagcaactcgaggccctcaccagatgcagtacaggtgccggtgccatgcttcttgtatcgcctgtggaaccatgagccaagaaaccttttttcttcataaattacccagtctcaggttttcctttgttacaacatgaatgaattaagataaccatcatttttgtatcagtaaaaagaaaaagctctgcgtatttaactattatacagtattttttatcatttaaaaatttatacttattcagatagctcactaagaattatatatataaacatttttatttaaatcatgccattctcataaggaaagtataaatcaaagatttcggttaagggattcttattcatattcaaagtctgtttttttcaagttgcttttcatctcagaactgttgatgtaaatattttcccaaacagtatcatactctgggctatcaagaatatttgtgatacagcaattcaaaaaagaatgcctcactattgtttctgggattttcttccaagctggttcattttgctaattttgatgcggcttttaactgatcttgtaagatgtcaatatcgggttttttggagttcatattctttcctcaaatggtctttaaatagtttgttgaccaaaatattgataggttaaaattgtccagttggtcattaagaaagtgtccagttttgatgtatgcaatcaataacaaccagatcacagctgctaccaggccatcgggaattgtaagatgctataaatttaaacaatgatgctgatgccagaggtgttaaaatgttgtgaatcttaaaacagaagacatacaatactactctcttcctttgtatttcctgtagttcaactaaaaatctcacctttcgttggcccctaggactttgtgagtagctattttctctgaaatcccatagtactttatttaatgaaaggaactaagtaataatttggggtgaaaataatccatgtacatggttaaaaaaaacttacttatgtataaaccagtagccctctgctctactacctacactaaagggtataacctgaccctaggaacaactagtttgaaccatttctggttttagtccttcttcctctagggctaaattgtatgtttatactgtctgcttttctttttttttcatttatcatttaagcagataccatagtagaagataatttagcctactcatttcacctccttttcttttttgctcctccacatatattaattttatgagctcctttattggttacatttgtcatttccaccacgatatttgttccattaactacagacagtttctcttgaacccctgcttcatgagtttgggatatttcaccctttctcctctcaccatctctccttgtatattataacacctaaatctgacaactgtgtggtgagagtattgataatattttaggtttagtatttgttattaaattttgtatttttgtctattggttgaccctaaaagttgaaaaattaataaatagcattaaagttattatgaccctgtaaatgttgtttactgcagaatcaagaagtattctacagttacatttcattcagtatggctcctgagccacccaaagaatgttcctagaatcaaagttaaggagattctttctttcaaatggattatttaattctagcatttgctaaaaatttgccatattttcttttcattcatatttacattgtgaatttctgtgacgctttttcaaattacctttattttttcttattgggaaagcatatgtgggccttcctggtttcatccttaataattttcagctttttactttctttatttttttgaatgcattttcttccttttttttttgaagtccactgactcatattctagtggcttcaattttgaattatgacttcctttttccctggtgtttattctgtttttattttattttcaagtttttttctggcttcaggattatattatgtgtcaggttgccttccatctccaccttcctccttgccatctccttttgggggccatctatactacagctgctatctggactagtcatttgaaagtttgcagagccagcaaacttgtttgtaaccacgatttcctgaatgtgtatgtttttgtcgtttttggttttctcctcattttgctggaatactttataaaattacttctggcaaataaatttatactatataaattttgtaagccattacattactaaaagtatatttgtttctctcggatacttctttgactggatgtaaaattctaaactgaaaagaattttctataagtcagttgctggattattttctagtattcggtgttttgggatgaaacatttgttttccattctctttcttactcctttagtgatttttttcttctctggaatcttttcttatattctttttttctttgttgtttggtaatttcttaattatatgtttaggaatgaatctgtttccattcttctttcttggagcctggtagccatatttttcactttgaacacttgtgccttttatctctgggaaatgtgccttttatctcttgtgccttttatctctggaaacacttgtgccttttatcgctgggaaattttcttgtattttttttgtgtgattattttctcctttctattctttttttctggaagtactgttggttggatttgggtctcttggatttatttttaagtgacttctttttcttaaacatttatttcctggttttttttttttgcctttggggggaaatgttaattatgcattttttttaaaaccattgaaattttttttttgtactatgcatgtaattttcaaaagctctttcttgctctcattattcctttgttattttatggatccaaaactttctgaaatgtctctgccaatactcattaaagatttgttaaagcttttttttttttctttaatttatccctgtgtccctggtggttagtttcctttttactttctttttataaaagaaaaatttaacacaatgctaaagactttcttcatgtctttgtgtctccattcagcatggctgttaaatgaagaaacaggaagaatgtgacttctgtgcatatgggcagtgttttatcaactgataggcttcatgttaggcactcaatcaaagagctgccatttatgctaaaggcctgttgcctaaatgtcagggctttaccataccggtgccaagtttacatgaaaagctcaagttctcaaacaacttgtactttttcctcctttaacacataggagtgtatactataatttttaaattgtctttggccatttgacacctttgaatactttgctcgtgtttgaggaatttccacttaataagcccctgttttcccaagcttcctggcagtctgcctgtagagtgtgaagtaggctccatcagttagaggcatttgtgccagattttagatcagaagtgtgggacatgaaagggcagatgagctccccggagctcagaggtagtaggcattgaggtttcagtcataacatgcagtatcctggtatggtgcagggctgtcttctctagagcaattctgcatgggattttgggtgtggtcttggctgtgtgcttttctagcttggttctctggcactcactgaggttcggagagctacccagtaaactttaataaatttctttcctgcttagactagtcaaagttcatttcagttgtttgttagtcactctcctgacagttacatggagctagtttagctgctgtgcaatgtttgtgaggaggtgaattacatacgcagatattacatgtgcagaccaaaatggcctctccttttagccccacctcaccctcctgcccttatcatttagaacatctgcaggtttgttttctcattgttgacagcctattctccaaatatcctatgtagttactacctttgttatacctcattagtctttgctaattgatatggtttggatatttgtcccctccaaatctcacgttgaaatgtaatctccagtgttggtggtggggcctggtgggagatatttgggtcatggggtgggtccctcacgaatggcttggtgccctccctgtggtaatgagtgagttcttgctctgagttcatgcaagatctggttgttaaaggagcctggcatcttcttccaccctctcttgctcccccttgccatgtgatgcacctgctccccattcactttccaccatgactgtaagcttcttgaggccctcaccagaagcagatgctggcctcatgcttcctttatagtctacaggaccatgaaccaaaataaaacacttttctttataaattacccagtctcagatattcctttttaacaatgcaagaatggactaacacactaatgttttagaaatttgtttttctcttttgctgctgatcgctctctcattcactcttgtagtgggttgatattatttactttactataattttcaaggtatctcaggagggaaagatcagtttgttcagtttaccatttttttttgagacagcatctcactctgtcacccaggctagagtacaatggtgcaattttggctcactgtaatctctgcctttcaggctcaagcgattctcatgcctcagcctcttgagtagctgggattacaggcatacgccaccatgcatggctaatttttatatttttagtagagatggggtttttccaggctggtctcgaactcctggcctcaagtgatccgcctgccttggggttccagagtgctgggattacaagcatgagccaccgtgcctagtcccagtttaccatcttgaacctgaagtcccactggtattatcgtgctttgacatgtaaaaaaattaataaaatgttatttcttaaagtaaataaattttaattattttctacatttctagcatcacatgtggtagcttgcattttattgaatatctggttaatatttaaatgagtcaatttatgtagagcttttagattacaccgtaggtaagatgcctactctgactcaactttgttgactttatggtacccacatctgtgaatcatagcttatccttatgcattttttaggaattaatatgtgacaagttcacacagagtaatatcaggaattaaagtacttgaaattatgttttccaagtgacaaatatttatgccaggatgttggaaggttttttttttaattaaaaaataatttaagtctttaacagctacttgatgggaataacatgaccaatttatattccaagtgaataaataaaagttaacatacttaaaatgacaaggctactggaaatagatcaggctatatttattttgttaaatttttgatacttgaagaaatagtgtttttcagttgcatttaaattaaatgtttaaatgcttatttaagtgagagatagacagatgcttctctaacaaaaagtaaaagcaaaaattagtggcatttggagctcattgagttaactcatcaaagcaacattattgtcagaattgcttttcttactcataaactttcctacacactcagagattttttgagatcaatggagcaagttgtaaataattttatttctgctcaaacactgattgagactgttctgttttatatttaagtagaatttgataggtaaaaataacacaaataatcctttacaatagaaattaaacagtctgatcttcctttgaaagcccaaattatgcttattcagtagaatatagatttggattttttcttcatagtaataactgaagagtaagcatgattaatatgcttactgtgctgggcatattatgcaaattaaattactgcttgcatacccatacatcatggatgtatcatttagatcagactgtggatttgtctttgtatactttatacagatttcttcaaatatttgtatatttcaacataggcttttttttcttttcatttctttctaaattcctaagggctgtttttctttttaaacgtgagaataaatatctacattaattatttattatatactttaattgattcaacaactatttatgagtacttacgatgttccagagaatatattaaaatacttgtttttcagaagtctaatatggatgagaaacattgtgcctattctttttttttttttaaattgtactttaagttctgtgatacatgtgcagaatgtgcaggtttgttacataggtatacacatgccacggtggtttgctgcacccatcaacccgtcacctacattagatatttctcctggtgctatccctcccctagccagccaccccccgacaggccctggtgtgtgatgtttctctccctgtgtccatgtgttctcattgttcaactcccacttgtgagtgagaacatgcagtgtttggttttctgttcctgtgttagtttgctgagaatgatggtttccagcttcattcatgtccctgcaaaggatatgaactcatccttttttatggctgcatagtattccatggtgtatatgtgccacattttctttatccagtctatcattgatggccatttgggttggttccaagtctttgctgttgtgaatagtgctgcaataaacatgtgtgcatgtgtctttatagtagaatgatttataatcctttgggtatatacccagtaatgggattgctgggtcaaatggtatttctggttctagatccctgaagaattgtcatactgtcttccacaatggttgaactaatttacactcccaccaacagtgtaaaagcgttcctatttctccgcatcctctccagcatcttttgtttcctgaatttttaatgatcgccattctaactgacatcagatggtatctcattgttgttttgatttgcatttctcaaatgaccagtgatgatgagcttttttttcatatgtttgttggacacataaatgtcttcttctgagtagtgtctgttcatatcctttgcccaccttttgatggggttgtttgtttttttcttataaatttgtttaagttctttgtagattctggatattagccctttgtcagatggttagattgcaaaaattttctcctattccgtaggttgcctgttcactgtgatgatagtttcttttgctgtgcagaagctgagctgtttagtttaattatatcccatttgtcaattttggcttttgttgccattgcttttgatgttttagtcatgaagactttgctcatgcctatgccctgaatggtgttgcctaggttttcttctagggcttttatgggtttaggtcttacatttaagtctttaatccatcttgagttaatttttgtataagttgtaaagaaggggtccagtctcagttttctgcatatggctagccagctttcccaacaccatttattaaatagggaatcctttccccattgcttgtttttgtcaggattgtcaaagatcagatggttgtagatgtgtggcattatttctgaggcctcttttggttccattggcctatatatctgttttggtacagtaccatgctgtcttggttactgtagccttgtagtatagtttgaagtcagttagtgtgatgcctccagttttgttctttttgcttaggattgtcttggctgtgcaggctctcttttggttccatatgaaatttaaagtagtttttaaaattctttaaagaaagtcaatggtggcttgatggggatagcactgaatctataaattactttgggcagtatagctgttttcacaatattgattcttcctatccatgtgcatggaatgtttttccatttgtttgtgtcctctcttatttccttgagaagtggtttgtagttttccttgaagaggtcattaggtattttattctctttgtagcaattgtgaatgggagttcactcatgatttggtgctctgtttgcctattattggtgtataggaatgcttgtgattttcacacattgattttgtatcctgagactttgctgaagttgcttatcagcttaaggagattttgggctgagacgatggggttttctaaatacacaatcatgtcctctgcaaacagagacaatttgatttcctctcttcctatttgaatacccttaatttctttctcttgcctgatttccctggctagaacttccaatactatgttgaacaggagtggtgagagagggcattcttgtcttgtgccagttttcaaagggaatgcttccagcttttgcccattcagtatgatattggctatgggtcataaatagctcttattatttttagatatgttccatcaatacctagtttattgagcgtttttagcatgaagcagtgttgaatattatcgaaggccttttctgcatctattgagacaatcatgcggtttttttttgcatataaatataatagaatattattcagccttaaaacggggtgaaattttgatacgtggtacaacattgataaactttattttattttattttatttattattattattatactttaagttttagggtacatgtgcacaatgtgcaggttagttacatatgtatacatgtgccatgctggtgtgctgcacccattaactcgtcatttagcattaggtatatctcctaatgctatccctccccactccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatacacccagtaatgggatggcggggtcaaatggtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctacataaatgtcttcttttgagaagtgtctgttcatatcctttgcccactttttgatggggttgtctgtcttcttcttgtaaattagtttgagttcattgtagattctggatattagccctttgtcagatgagtagtttgtgaaaattttctcccattttgtaggttgcctgttcactctgatggtagtttctttggctgtgcagaagctctttagtttaatgagatctcatttgtcaattttggcttttgttgccattgcttttggtgttttagacatgaagtccttgcccatgcctatgtcctgagtggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcagtgttatttctgagggctctgttctattccattgatctatatctctgttttggtaccagtaccgtgctgttttggttactgtagccttgtagtatagtttgaagtcaggtagagtgatgcctccagctttgttcttttggcttaggattgacttggcgatgcgggctcttttttggttccatgtgaactttaaagtagttttttccaattctgtgaagaaagtcattggcagcttgatgcggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagctggattcctaagtattttattctctttgaagcaattttgaatgggagttcactcatgatttggctctctgtttgtctgttattggtgtataagaatgcttgcgatttttgtacattgattttgtatcctgagactttgccgaagttgcttatcagcttaaggagattttgggctgagacaatggggttttctagatatacaatcatgtcatctgcaaacagggacaatttgacttcctgttttcctagttgaataccctttatttccttctcctgcctaattgtcctggccagaacttccaacactatgttgaataggagtggtgagagagggcatccctgtcttgtgccagttttcaaagggaatgcttccagtttttgcccattcagtatgatattggctgtggatttgtcatagatagctcattattttgagatatgtcccatgaatacctaatttattgagagtttttagcatgaagggttgttgaattttgtcaaaggccttttctgcatctattgagataatcatgtggtttttgtctttggttctgtttatatgctggattacatttattgatttgtgtatattgaaccagccttgcatcccagggatgaagcccacttgatcatggcggataagctttttgatgtgctgctggattcggtttgccagtattttattgaggatttttgcagcaatgttcttcaaggatattggtctaaaattctcttttttggttgtgtctctgcctggctttggtatcaggatgatgctggcctcataaaatgagttagggaggattccctctttttctattgattggagttgtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctgatttagtcttgggagagtgtatgtgtcgaggaatttatccatttcttctagattttctagtttatttgcatagaggtgtttgtagtattctctgatggtagtttgtatttctgtgagatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttacatatttcttgccttctgctggcttttgaatgtgtttgctcttgcttttctagttcttttaattgtgatgttagggtgtcaattttggatctttcctgctttctcctgtgggcatttagtgctataaatttctctctacacactgctttgaatgtgtcccagagattctggtatgttgtgtctttgttctcgttggtttcaaagaacatctttatttctgccttcatttcgttatgtacccagtagtcattcaggagcaggttgttcagttaccatgtagttgagtgtctttgagagagtttctgaatcctcagttctagtttgactgcactgtggtctgagagacagtttgttataatttctgttcttttacatttgctgaggagagctttacttccaaccatgtggtcaattttggaataggtgtggtgtggtgctgaaaaaaatgtatattctgttgatttggggtggagagttctgtagatgtctattaggtctgcttggtgcagaggtgagttcaattcctgggtatccttgttaactttctctgtcgttgatctgtctaatgttgacagtggggtgttaaagtctcccattattattgtgtgggagtctaagtctctttgtaggtcactcaggacttgctttatgaatctgggtgctcctgtattgggtgcatatatatttaagatagttagctcttcttgttgaattgatccctttaccattatgtaatggccttctttgtctcttttgatctttgttggtttaaagtctgttttatcagagactaggattgcaaccccggtctttttttgttttccatttgcttggtagatcctcctccgtccttttattttgagcctatgtgtgtctctgcatgtgagatgggtttcctgaatacagcacactgatgggtcttgactctttatccaattttccagtctgtgtcttttaattggagcatttagtccatttacatttaaagttaatatcgttatgtgtgaatttggtcctgtcattatgatgttagctggttattttgttcattagttgatgcagtttcttcctagcctcgaaggtctttacaatttggcatgattttgcagtggctggtaccagttgttcctttccatgtttagtgcttccttcaggagctctttcagggcaggcctggtggtgacaaaatctctcagcatttgcttgtctgtaaagtattttatttctccttcacttatgaagcttagtttggctggatatgaaattctgggttgaaaattcttttctttaagaatgttgaatattggtccccactctcttctggcttgtagagtttctgccgtgagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccaagttggtcactttcaggtacaccaatcagacgcagatttggtcttttcacatagtcccatatttcttggaggctttgttcgtttctttttattcttttttctctaaacttcccttctcgcttcatttcattcatttcatcttccatcactgataccctttcttccagttgatcgcattggctcctgaggcttctgcattcttcacgtagttctcgagccttggctttcagctctatcagctcctttaagcacttctctgtattggttattctagttatacatttgtctaaatttttttcaaagttttcaacttctttgcctttggtttgaatttcctcctgtagctcggagtagtttgatcgtctgaagctttcttctctcacctcgtcaaagtcattctccatccagctttgttctgttgctggtgaggaactgcgttcctttggaggaggagaggcgctctgctttttagagtttccagtttttctgctctgttttttccccatctttgtggttttatctacttttggtctttgctgatggtgatgtacagattggtttttggtgtggatgtcctttctgtttgttagttttccttttaacagacaggaccctcagctgcaggtctgttggagtttgctagaggtccactccagaccctgtttgcctgggtatcagcagcagtgtctgcagaaccgcggattttcgtgaaccgcgaatgctgctgtctgatccttcctctggaagttttgtctcagaggagtacccggccgtgggaggtgtcggtctgcccctactggggggtgcctcccagttaggctgctcgggggtcaggggtcagggacccacttgaggaggcagtctgcccgttctcaggtctccagctgcgtgctgggagaaccactgctctcttcaacgctgtcagacaggaacatttaagtctgcagaggttactgctgtctttttgtttgtctgtgccctgcccccagaggtggagcctacagaggcaggcaggcctccttgagctgtggtgggctccacccagttcgagcttcctggctgttttgtttacctaagggagcctgggccatggcgggtgcccctgccccagcctcgctgccgccttgaagtttgatctcagactgctgtgctagcaatcagcgagactccgtgggcgtaggaccctccgaaccaagtgcgggctataattctcctggtgcgccctttcctaagcctgtcggaaaagctcagtattcaggtgggagtgacccgattttccaggtgccgtctgtcacctctttccttgaccgggaaagggaactccctgaccccttgcgcttcctgagtgaggcaatgccttgccctgctttggctcgcgcacagcgcgctgcacccactgtcctgcacccactgtctggcactccctagtgagatgaacccggtacctcagatggaaatgcagaaatcacccgtcttctgcgtggctcacactgggagctgtagaccagagctgttcctattcggccaccttggctcctccccccatcatgtggtttttgtcattggttctgtttatgtgatagattatgtttattgatttgtgtatgttgaagcagccttgcatcctagagatgaagccgacttcatcgtggtggatgagctttttgatgtgctgctggattctttttgccagtattttattgaggatctttgcaccaatgttcatcagggatattggcctgaaattttctttttttgttttgtctatgccaggttttagtatcaggatgatgcgggcctcataaacgagttatggaggaatccctcttttcctgttgtttagaataatttcagaaggaatggtaccagctcctctttgtacctctggtagaattcggctgtgaatctgtctggtcctgggccttttttggttggtaggctattaattactggctcaatttcagaccctgtttttggtctattcagggatttgacttcttcctagtcttgggaggtgtatgggtctaggaatttatccatttcttctagattttctagtttatttgcatagaggtgtttatagtattttctggtggtagtttgtatttctgtgggatcagtggtgatataccctttatcattttttattgtgtctatttgattcttctctcttttcttctttattagtctggctagtggtctattttgttgatcttttcaaaaatccagctcctggattcactgagtttttgaagggtttttcgtgtctctatctccttcagttctgccctgatcttagttatttcttgtcttctgctagcttttgaatttgtctgctcttgcttctctagttcttttaattgtgatgatagggtgtcaattttagatctttcctgctttctcttgtgggcatttagtgctataaatttccctctaaacaccgctttatatatgtcccagagattctggtacgttgtgtctttgttctcactggtttcaaagaacatctttatttctgcattaatttcattatttacccagtagtcattcaggagcaggttgttcagtttccatgcagttgtgcagttctgagtgagtttcttaatcctcagttataatttgattacactgtggtctgagagacagtttgttatgatttctgttcttttgcatttgctgaggagtgttttacttccaattatgtggtcaattttagaataagcgcgatgtggtgctgagaagaatgtatattctgttgatttggggtggagagttctgtagatgcctattaggtcttcttggtccagagctgagttcaagtcctgaatatgcttgttaattttctttcttgttgatctgtctaacattgacagtggggtgctaaagtttcccactattatcatgtggcagtttaagtctctttgtaggtcattaagaacttgctttatgagtctgggtgctcctgtattgggtgcatatatttaggatagttagctcttcttgttgcattgatccctttaccattatgtcatgctcttttttgtcttttttggtctttgttggtttaaagtctgttttatcggagactaggattgcaacccctgctttttcttttttgctttccatttgcttgataaatattcctccatccctttattttgagcctatgtgtctcacatgcaaaggcatgtgagactggtctcctgaatacagcacactgatgggtcgtgactgtttttccaatttggcagtctgtgtcttttaattggggcatttagcccatttacatttaaagttaatattgttatgtgtgaatttgatcctgtcattatgatgctagctggttgttttgcccattagttgatgcagtttcttcatagtgttgatggtctttactatttggtatgtttttacagtggctggtactggtttttcctttccatgtttagtgcttccttcaggagctcttttaaggcaggcctggtggtgacagaatctctcagcatttgcttgtctgtaaaggattttatttctccttcacttatgaagcttaatttggctggatatgaaatcctgggttgaaagttcttttctttaagaatgttgaatattggcccccactctcttctggcttgtagagtttctgcagacatatccactgttagtctgatgggcttccctttgtgggtaacttgacctttctctctggctgcccttgacgttttttccttcatttcaaccttggtgaatttgacgattatatgtcttcaggttgctcttctcgaggagtatctttgtggtgttctcgtatttcttgaatttgaatgttggcctgtcttactaggttggggaagttctcctggataatatcctgcagagtgttttccaacttggttctgttctccccatcactttcaggtacaccaatcaaacataggtttggtcttttcacatagtcccatatttcttggaggcttagttcatttctttgcattctttttttttaatcttgtcttcatgctttatttcattaagttgatcttcaatctctgacatcctttcttccgcttgttcaatttggctattgatacctgtgtatgctttacaaagttctcatgctgtgtttttcagctccatcaggtcatttatgttcttctatatactggtttttctagttcgcaattcctctaaccttttttcaacattcttagcttccttgcattgggttagaacatgcttctttagctcaaaggagtttgttattacccaccttctgaagcctacttctgtcaattcatcaaactcattctgttcccttcctggtgaggagttgtgatcctttaaatgagaagcggcattctggtttttggaattttaagcctctttgtgctcgtttttcctcatcttcatggatttatctaactttggtctttgatgttggtgacctttgaatggcgtttttctgtggaatcctttttgctgatgttgatgctattcctttctgtgtgttagttttccttctaccagtcaggcccttctgctgcaggtctgatggagtttgcttgaggttcactccagaccctgtttgcctgggtatcaccagcggaggctgcagaccagcaaagattcctgcctgttcctttctctggcagcttcgtcccagaggggtacccaccagatgccagctggagctctcctgtatgaggtgtctgttgacccctgctgggaggtgtctctcagtcaagaggcagggtggttaggaacccatttgaggaggcagcctgtcctttagtaaagctgaagcgctgtgctgggggatccactgctctcttcagagccatcaggcaggaatgtttaagtctgctgaagctgtgtccacagccacattcttcccccagggagaatgctgtgtcccagggagatgggagttttatctataagcccctgactggggctgctgcctttctttcagagatgccctgcccagagaggaggaatctagagaggcagtctggctacagaggctttgtgtgcagcagtgggctccacccagttcaaacttcccagagaccttgtttacactgtgaggggaaaactgcctattcaagcctcagtaatgacggacattccttcccccaccaagcttgagtgtcccaggtcgatttctgctgtgctggcagggagaatttcaagccagtggatcttagcttgctgggctccatgggggtggtatccgctgagctagaccatttgactccctggcttcagcctttccggggaagtgaacggttctgtctgtcttgctggcattccaggcactgctggggtatgaaaaaaaaaactcctgcaactagtttggtgtctgcccaaatggctgaccacttttgtgcttgaaacccagggccctggtggtgtaggcacccgagggaatctcctggtctgtgggttgggaaggccatgggaaaagcataatatctgggccagagtgcactgtccctcacggcacagtccttcatggcttcccttggctaggggagggagtttcttgatcccttgcacttcctggatgagccaacgccccatcctgcttcagctcaccctccgtgggcggcacccactgtctaaccagtaggaatgagatgagccgggtacctcagttggaaatgcagaaatcacctgcctcctgcgttgatctccctgggagctacagaccagagctgttcctattcagccatcttgccagccacccccgcctgttctttttttgtgttcttcttgctaaatttatttagcatgagaacagcaatagcatgttctcacataagaagctgactaacagaatgcacagcatataaaaaatgtgctatttgtatagaaataatttgtcaacttcagcaatcagtttgagacccacatatcacctggatgaatggttctcctgcagaatctgattcagaggaaagagtcatgtggtgcggtgacttgaaagagctgtggtgaataattgaattctaagaatggccacagtagactccctgttaatatttctgaaaagtagggttatggagcacatattattaaactgttatttttaatagacatcttatacttgtatctggtctgtaagaccagtcatattagtgtacatttttcaattagtttactttggaagtgggcacaggggtctacactgctcaaatctgtaattataattaccttatgataatttattatggcaataatgggaatttgcttatttttctttgaaaaatgttttcaagctatacttgtttctgccatgatagagaacttttgcaacattcatttttgttgtgagagtagagccacaatgattttctaatgagaattgattaagccctttccttaccctagcccagttctaagtattgtcagtggtgattgggatagagggtagtctgtttggcatgtttccatgtcatgtgaggatgtcaaccctccgtctttttgaatgactgctaaggcacattactccttttaactgtcaacagagaatgactactactgtggtctgaatgtttgtgccaccacagaattcatatgttgaaacctaattaccaatgcaatagcattaagaggtggggcctttaggaggttattaggtcatgagggtggagccctcatgaatgggattagtgcccttataaaagaggctgcagcggagcttgttcaccccttctgccatgtgaagacatggcaagaaggcaccatctatgagaagtagtccttcaccagagattgaatctgctggcatgttgatcttggactttccagcctccagaattgtgagcaatacatttcctttctttataagccactgagttcgtggtattttgttatagcagcccaaatgaatgaagaaaactgcattccaggggaatgttaggcagtattatctcacctcttcatagtgtgatgtctgtgactggctcagttcatgcagctctacttgtggaatgtgcattacatttatttatctatatcaggaattcttaatcctggagaaatttcaagggattgttaaccccttgaaattatagccctaattttagttgtatgtgcttcctcatggcgttgatacacttctttcaccaaattctcagtcaggtccatgttccaaaaaatggttaagaatcaccattttgaaatccttcttgctattatgccagattctcaaacagctgtatctggatgataggagaatgcctctttgaaggttgcttttgtgcatgttggcatgggggaggtgctaaaatttcagatgggatggccagggcaggctcctttagaaggtgagttgagtggtggggagagcagtggatgacgagtgggatctgggaccttgtagtcctgttcaggacttggacttttactacaagtgacaggagagggctgtagtgctttgagaaagagagacatgatctggtcaatgtgttaataagatcactgtgactactgtgttagagagacatgatctgatctgtgttaagaagatcactttaactgctatgttgataactgactgaactggggagcaaggacagaagtagagagcctcttctgatagttccgggaagaaataattgtggcatagaacagggtattggtagtggagagggtgacaaattattaaattttgaaattgctttgaaactctggtattattaggatgttcatgaggatgttagctgttattttataaaattaatcaataattttcttagtgttaggattatttgtactcttctcctaaactgttcatttcattttaactactcagaatttataattgaacaatacaaccataagaaaagttagaacaaattaatggttcatccttaggaagtgtcttcatattaatggtgtttggtgtattaggcttattttggtcatcctatctttaattttccctttgcttcattcttttttcaccaatttaaaaaatttctgtcactttttctgtcttttatttagacagagtctcactttgtcatccaggctggagtgcagtggtgtgatctcagctcactgcaaccttcacctcccgggttcaagtgattctcttgcttcagcctcccaagtagctgggattacaggaacacgccaccacacccagctactttttgtatttttagtagagacagtgtttcactatgttggccaggctggtcttgaactcccgacctcaagtgatccacccgccttggcctcccaaagtgctgggattgcaggtttgagccactgcacccagcctctttttctgtattatttgtgttttaaaaaacttctttatattcctttttgtacagtttagggtgcatgtttctctcattgaatctatgtcagataccacctttcactgtctcttcaaggttgtgtctatgtcctttttacacttgtgattgtttctctgttatttaagaatgaaacctgattccacgaatccaaaccatcagaatagtttgtgttttgcatggaacattaaataaagaagtggttgttttatgtaaggaaaactgctgatctatttgatcacttaactgaggagaccaggtgagttaaaaacaagccaaatcatttgttgaactgaattactatagtcactagtaagtttcatcaaagcaatccagtgatatgttgtatctgtgacacatcttgactataaaacttgcccttgagtttattttatgagaacatcttatatcaagaacaggtagcataaaaagcagggaggaatttgtactcatttaatataattaaatcatgagggttccaaacagtgtactgatttctagaaatcctaaagaaccattgtgatatcagtgtataaagaacaaaaattctgatgacaaacttgtagtgtgaaaaacaaatttactggactacccactgtttatactcatttattttcttcctgatagtaagttgtaaaataaacaaacacttttttccatttacttatcatgtggtgccaattctcacttatcatatggtgccaattctcagatatgagtcatgagacatgtttcttaatgtttttttttttttttgaatcagaagtttttttttttgttttttttttgtttttttttttttttatactttaagttttagggtacatgtgcacattgtgcaggttagttacatatgtatacatgtgccatgctggtgcgctgcacccactaacttgtcatctagcattaggtatatctcccaatgctatccctcccccctccccccaccccacaacagtccccagagtgtgatattccccttcctgtgtccatgtgatctcattgttcagttcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattatggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtgtaaggtgtaaggaagggatccagtttcagcttcctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtaccagtaccatgctgttttggttactgtagccttgtagtacagtttgaagtcaggtagtgtaatgcctccagctttgttcttttggcttaggattgacttggtgatgcgggctcttttttggttccatatgaacttgaaagtagttttttccaattctgtgaagaaagtcattggtagcttgatggggatggcattgaatctgtaaatgaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatagaatcatgtcatctgcaaacagggacaatttgacttcctcttttcctaattggataccctttatttccttctcttgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagggttgttgaattttgtcaaaggctttttctgcatctattgagataatcatgtggtttttgtctttggctctgtttatatgctggattacatttattgatttgtgtatattgaaccagccttgcatcacagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcctccttgtacctctggtagaattcagctgtgaatccatctggtcctggactctttttggttggtaaactatcgattattgccacaatttcagctcctgttactggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcctttcaaaaaaccagctcctggattcattgattttttgaagggttttttgtgtctctatttccttcagttctgctctgattttacatatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttgggttggagagttctgtagatgtctattaggtccgcttggtgcagagctgagttcaattcctgggtatccttgttgactttctatctcgttgatctgtctaatgttgacagtggggtgttaaagtctcccattattaatgcgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttcattggagcatttagtccatttacatttaaagttaatattgttatgtgtgcatttgatcctgtcattatgatgttagctggtgattttgctcgttagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctgtaaaggattttatttctccttcacctatgaagcttagtttggctggatatgaaattctgggttgaaaattcttttctttaagaatgttgaatattggcccccactctcttctggcttgtagggtttctgatgagagatccgctgttagtctgatgggcttccctttgagggtaacccgacctttctctctggctgcctttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagttttttccaacttggttccattctccccatcactttcaggtacaccaatcagacgtagatttggtcttttcacatagtcccatatttcttggaggctttgctcatttctttttattcgtttttctctaaacttcccttctcgcttcatttcattcatttcatcttccatcgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagagacgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccgtgtgaggtgtcagggtgctcctgctggggggtgcctcccagttaggctgctcgggggtcaggggtcaggaacccacttgaggaggcagtctgccggttctcagatctccagctgcgtgctgggagagccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttggagcttcccgctgctttgtttacctgatcaagcctgggcaatggtgggcgcccctcccccagcctcgctgccgccttgcagtttgatctcagactgctgtgctagcaatcagcgagattccgtgggcgtaggaccctccgagccaggtgtgggatataatctcgtggtgcgccgttttttaagtcagtcagaaaagcgcagtattcgggtgggagtgacccgattttccaggtgcgtccgtcacccctttctttgactcggaaagggaactccctgaccccttgcgcttcccaggtgaggcaatgcctcgccctgcttcggctcgcacacggtgcgtgcacccactggcctgcgcccactgtctggcactccctagtgagatgaacccggtacctcagatggaaatgcagaaatcacccgtcttctgcgttgctcatgctgggagctgtagaccggagctgttcctattcggccatcttggctcctccgtgaatccgtttcttaatgttttacactattctttgtggtaaagtgtggtttccattttaaattacatctctcagaataataggcagctctgaaaggggttgtagagaccatctaacagtctgatttgtagatgaggaacctgaggtctagagtgttgaaaacccaagtcccacagctgattaccggaagagcttagcctggcacccaacactcctgatgcctaattcaggtaggttttcatccaaagtccaagccacatatattaaaattatactactatttggatttatgacatagtagtacaaataatcatatttgtgatactccaacttgagtagaactcataggaaatcttgtctctgaagtcggacttcatgtgggtatattaagccaccagacttttaattattctaactctccaatattacctcatctgcaaataaacaataggtttccaaaggtctactggtaaaatttctcctctttattggaaataaataggcagttgttacctatgcaataattatttggccttacaatatcatagtaaagataaagactttagaaaacagggaaattttaagacctgagcatgaaagaaattgaagacggtgatattaatgatgttaaattagctgttacatattttatcaacattgtgagcacttgcatttagttaaaatttcagtcttatcccgtgatacctgtcctggtttgttatggcataaaggaacattcagtttaaattttttcgacttgtatttttaatgatgtaagataggatgcgtacaggaataaatctgtagcctaattttacgtgagatatttctcagatattgatctagagtatcacatgtaaatttagagacttatctataatccctttccttttatgttttccacagacaacttatatatatgtgtttttgtttttgtgtgtgttctgattttagatttaccttttccaggtgtacttctctgaagtaagatgatttgtcaaaaattctgtgtggttttgttacattggggtaagttatttgctcatttgctgttttaatgcccttaaacatggtagagattttgcctttagagatgctgttttatttattagctaacagaatttcctatttctagttaggaattctcatacatgcttatgattaaaaatgcaaaccatagtataggtgtatcagtgtgaaaacgaaaacccttcccaacctcctaaagacaacctgatggtgtatccttccagaatcctctctctctctcacacacacacacacacagactcacacacacagactcacacacacacatacacagacacactcatatctatagctgcaaaaatagcactggtctgtacatgttgttctggatgtttatttttccatttaacaggtttccaatttatcatgatggctttttacctttatcagtatttaccgggatacttattagtttaatggttgcatgacaatgcactgtatgaatatatataaaattattagtctatttgaccaattcctgattgatagacatttctttttctgtaacaaataatactgcattgaaacttcatgtgtctttgtatatttggaaaaatatttctgtagattaattcttttttttttttttttttttgagacgcagtcttgctctgccgccagactggagtgcagtggcatgatctcagcccactgcaacctctgcctcctggattcaagcaattctcctgcctcagcctctcgagtagctgggactacaggcacgcgccaccatgcccagataatttttgtatttttagtagagacggggtttcactgcgttggccagatggtctcaatctcttgacctcgtgatctgcccgcctcggcctcccaaagtgctgggattacaggcgtgagccaccgtgcccagccgatacattgccaataacttttgagcatactgttctcacgtgtttcttaccacattctggtgacattctgatttccttaaaccaaatcatctaagttagattgtgttccaagtttttgaaattaaagttagagtatctttaacaaaacttatgtgatttggcaattgtttatctagctttctttaacaaaacttatgttgtggcaactttatctggcagctgttacctgtgtgtcaactgattctgagcatctccttggctaccccaatctaaaggggctcttctaagcttccctataggtcttccttgtggtacatacttctctttcattgcagccatctgtatatttccagaaaataacctagatagctccaccattacagatttccaaaaaattatgccacaagggactatcaaagagaaataactcattctctttttatattctctaattttattagatatatttaagggaactgttcattctcttttataattctctattaattttcgttagactctagtgttttacattgactttctggaaggtttctggtttgatcaagtttttgaatcaaaagaattcctgggatattgttacctgataagatatgccttcagatgaaaattctagaccatctttagagtttaggattcatttggagggaaagaaatatcatttgcaaagttgcatgtggataaaatagactcatcttttaatttaactgcatcaatagttgctatgtttttaaagttcatcattacattttacatttaaatacttctgtgaggattttaggctaattcatttcaagcaactgaatcctctatgtagacctagaatatataatgctgtaaattagtaatattacatattcttggttttgtaaacctcctccctcaaaaaactattctgttttctttgaggtgttctgattttagaaacatgttagaaggagtgaagtccaaaggaacataattgtaatatggatttacttttggtaatgttgtgatacctaattgttatcagtatggccatagtcacatttgtcacattaatcactttggcctcaatttttgcatctatacctatttatattaatttatatctatagaaatctttagaaaccaaactattaacagtcattacctatgtattgtttgaatattttcactgataattgcttttgtaatgaaaaaatacatttgtgaattgattaaaaattttattttcttacatttttaaaaagcctttattttttagagcagttttaggttcacagcaaaattgagaggaaggtacagagattttccgtagactccctgccccacacatttataaccccccattatcaactatcccccctcagagtggtacatttgtcacaattgatgaacccatactgacatatcattgtcactcaaagtccatagtttacattatggttcactcttggtgttgtatattgtatgaatgttgactgatgtatgtatagtgacctttatctgcagctttagaaacatacagaagaatttcactgccctacccatcctttgtggccttcctattcctccctccttcttacctaactcctgggaactgccgatctttttactgtttccatagttgtgcgttttatagaatgtcataatgtcatatagttggaataacatagtatatagtcttttcatactggtttctttcccttagtaatatgcatttatgtttcctccatgtcttttttttcctctttaaatttttatttttttagattcagaggttacaagtatggttttgttacatggatatgttgcgtagtatgtacatcacctgaatagtgaactttgtgtacaatactacttataagtgagaacatgtggtattggattttctgtttctgagttatttcacttagaataatggcctttagctccatccacgttgttgcaaagtacatgcttttattcttttttatggctgcatagtattccatggtgtgtgagtgtgtgtgtgtgtgtgtgtgtgtgcatgtgcatgtgtgtgaatatgccactttttttaatgcagtcattcattgagggacacttaggttgattccatgactttgctattgtgaatagtgctgtgacaaacatatgaccgcaggtgtctttttgttacaatgatttcttttcctttgagtagatacttagtagtgggattgctggattgaatgatagttctacttttagttctttgagaaatctacacattgttttccatagaggttgtacaaatttacattgccaccaacagtgaataagcatttccttttctctgcatcctcaccaacatctattattttttgactttttaataatggccattcttactggtataagatggtatctcattgtagttttaatttgcatttttctaatgattagtgatattgggcatttttttcatgttcattggctgcttgtatgtcttcttttgagaaatgtcttcatttcttttgccttctttttaatgggattatttgtttttttcttgttgagttgtttgagttccttctaaattctggatattagtcctttgttggatgcatagttctggaagagtgctggaacctctgtatcttttcgtgacttgatgtctcatttctttttagccctgaataatatttaattgtctggatgtaccacaatttacccattcacctactgatgaacatcatgtttacttctatttccttacattattacatttgccaaactcttcaaaattctcatttcatacaaatccatacaagattctcagaattcgtattctgcattagtgtctatataagccaacacaattgttgcatcatttgggtaacttactgaaaaaacaattatggagaattattttattttcaaacaaatatttaaaaataagtttggctgggtgcagtggctcatgcctgtaatcccagcactttgggagaccaaggtgggcggatcacctgaggtcaggagttcgagaccagcctggccaacatggcaaaaccccgtctctactaaaagtacaaaaattaaccgggtgtggtgggaggtgcctgtaatcccagctactcaggaggctgaggcaggagaattgcttgaacccgggaagcagaggttgcagtgagtcgagatcatgccactgcactccagcctgagcaacaagagcgaaattccatcttaaaaaaaaaaaaaaaaaaaaaaaaaaaagacaaggtttaacttttgcagatcttttggtacaggattatataattgttcttaatttttatatttaaacagtgataatttaatcagcagtgggcatttcccataagaagtctattcttttgcatcattttttgtgtaatgtgctaagggcatgtcttatatgatgatgttttgtatttggaggatcatgggaaaattcaggagatcatcaagccatcatcatgttgaagacaaattctttctaaaagtgctcagcgaaagcagtgttaatattttggtgttactctcttaaatacatattaaaatagcactttaatgtttgtttatataattgcacatccagatatttatttatcatttatactggatattatatttatcatttataatggaagctagaataatatgctttagaaaggaaaaataaaatattcagtgtttgtttccttttattaaaacataaatataaaatgtcagcttaaagagaaaacatgaagtgtgagtcttcaaaaagaaaagagatgtcagaaagtggagtaatttctacaaatgaatgcatcctcttgaatgtaacacattgtacaatggaagcacaaagttattcattagacactcactgaggacttagaaagttaaataattattgagcactacatggtttaatctcagatactttctattcatgtcttagtcaaaatgattacttttttctatgtgtctttttaatatcctaacagaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaataggtaagcattagctatgttttaaatgtattgaacaatgttttttaattctttgatacctgtatgaaatagatgtcttatggctatgattttaacatacataatcatttttatatggataataaaattaggattcattatgtgaacaaactaataaataatttccaaattatcttgtatcccataaaaatataatgagggaattattttacttttaagtacattccttgtagtcttctaaatttgctttgaaatagaaaaacacaccttatttttgttaaatgtataaaatatcaaatgactgataatattgttgaattggttaaattttaaaatattcatgaataataataattcttcaggcaaggaatatctctgaaagaatatacgttttaaagatgggtttttcagaaagaatagctaatggatgctgggcttaacacctaggtgatgtgatgatctgtgtaacaaactgctatggtacatgtttacctatttaactaacctgcacatcctgcacatgtacccctgaactaaaaataaaagttggaaaaacaaaaaaagaaaagaaaaaaattctttttttttgtttaagtataatgcatactgattgtagctagtgtagttaaaaattctgcatctggaaatataaacaacaaaattatcccaagtcttttggaaaagctaggaagagtggagtcaattgactcatccatgtagagagacctccagtatgaaaatacaggcatatcttttcctcccttaaaagcgtgatgattgggttttcacatgtatgagtgagatgtgcctccctcagaccttgttatgatgttggcacattacctgtctaatgttaaaaaaaaaaaaaaaaggctgggcacagtggcttaactgcctgcaatcctagcatttaggaggcctaggcgggcggatcacttgagctcaggagttagagaccagcctgggcaacataatgaaaccccatctctaccaaaaaaaaaaaaaaaaaaaaaaaaaaaaattaactgggcatggtggtgcatgcctctagtcccatctacttaggagactgaggtgggaagattgcttgagagatggaggctgcagtgagccatgatcacatgatcatgccactgcactccagcctgggtgacagagtgacaccccatctcaaaaaaaaaaaaaaaaaaggaaagaaaaagaaaagtgagaactgagctaggtgagttttgagctcttttgtcctatttaagtggtttgaaattaaagaaaatttgagaagcaataattgaatttaattctattactttagaaaaaaggaaactgagggccagagggactaagtgatgggcaaacgcatgccactagttaaagcttgttctttttctctcagaataggcaatggaagttgtatcagaacactggtaaatttgatttagctcttctctttcactgagttgttcagatggtttttgagatttcatgtagttgtttttttttttttttttttttttttttaaattcagatgcaaactggaacatacagtgctggctaaaaggagacttaaaattattcatctgttatgtggagtcattatttaagaatctattcaggaattataactataaggtccatcttttatatgttctgtaagtaccaaataattaatttggcatttctaatacacagtttttttaaaagagctttcatatacggaagtagattataaacctcttgcatccctacatttcctattatatgttttattttttaatatagcattctgctctgttaggtttcctcttttctcctcctgctaattgaggtagcaagacagtcaggtttagggtcacgattgtcaggtccatgagtataccaaatgttcagttcaagttcaggttctagctcacactgaggtccgaagggagtgggtggatgggcaatagctgaacgaacactctgggggccttaaacaggtgaaacgtagttttattcagcagctctctatcagcagcttactcaaactaggtctctcattagcagctctcttagcagcagctttctctcactgtctgctctgttttgactgcttgggccagctgctcctatgcacagctgcacggctggctctctcttgccttcagggtcagcagcttaactctttctctctctgggcatgaacatgaaccatgctgtgccatgttgtgccatgctgagccatgccctggctcccctcgtcagagcaagactgacagctctggtactctctctctgggtacaagagcgcctgtacaagaacatctgtagagtgtcagcagggcaattataccttttacagacaacagtggcatatggccaagggatggccttcccatgttatggctacatggctgtgataacagatggagttatatgcctgcgcactactcgctgagtcatgcaggcctggacatctgccttggcctgattcttgaccgaagcacatccatgtaccttacaaagatattgcaggtataggtgggcatgtagtctgaaagaagagtgaactcagttcaggagtgctagatatttgagtggaaaaggaaaaaaggtgcgttttatatttctttttcagatgatttttcgtattcgatctctttataaacttaaaaatatgggtggctaatatttgtgctagaaagagaacaaagatattgttttcaaatagccatatacttataactcaaacagcgaatatgtcattaagttttctaattactctagtgatgatatacaccatttttatgtcaattttaactctttaaaattctttctcattaattcttctatttgatgcttaaagtctcgcttccttcagttctgcagttattgagataataccgttgaggagcaatgtgctagaaactgtccctatacaaatgaatagagacagaaagtaaagcggggctgagaggagggggaattggggagttactgtttaatggatataaagtttcaatttgggaaaatgaaaaatgttctggagttggggagtggtgatggttgcataataacgtgaatgtatttcatgtcattgcactgtacacttaaaatggttgaaatgttaaattttatatacattttattacagtaaaaatttaaaaagaaacttaaagacatgtaaaaaaggatgaatggttacgatcactgtcctttaggtgctcaaaggctagcagttgggacctgtatgtacagagtttcagtttaagtggttaccgatatgtatttggtaggtacataatgtcatgggagcccatcattgttgtgagatcttagatgggggttatctagttaagctggtgagagaagagaggaggaaaggtttcctaaggaagtagatagctgagttgagtcattagagataaataagagctaatgagaaaatatgtgggcagtatagtgttgggaagagatcagtatcacctggaaccttgttagaaatttaaatttgcatgctaaatgacgagttaatggttgcagcacaccaacatggcacatgtatacatatgtaacaaacctgcacgttgtgcacatgtaccctaaaacttaaagtataataataataaaaaaaatttaaatttgctagctcacccctgtgaataaaaaattagggggggtggagctcattaatatatgttttgccaagtcctttgggtgattctgatggaactcaagtttgaaaattcctgctgtagaggttaatatgacagattttagagtcagactacctggctgtaccacttactaaatgcactcacaaagcacttgctatgtttaacagttgttctacctctagaaattaacacaatggaaatatttacacaatgtttaaaaattatttgttgaatgaatacatattgccaaaatgctttctaaaatattttccaatttaccctccagaaatgtcttaatgagccaaaaagttaataaaaaaataatattgtctgaaggtgtgagtagtgagtagtcaacggtcagatatagcaggaagatataataaggtctgaatgatatgtacggatttggcagtgtgaaagtaatgggtctttaggcagagctcattcgggggagcggaaggagaggttgccagaacaaagggaaacttgaagaaaggacccggaagagctgatctttatgctagttcctcattcagttgatggggggacactgcagagctggaattcatatatccaaggcatactatggctggtgctgagaatatgaaaaaaacctggttactgggaccaactgctgctgcccaggtgaggaacctttggctggagtgatatttcaagaatggtaggcaaaacaggaaggatcaactcccttgtcactccattattctagtctctttctagctcccccacaggtagaatttaacaagaatttaggtagcagaggagaactatggtttgcagagttccagccccagcatggtgaaacagagcatagggtgcatttgaagatggcagtcaatagcttaaccaccagcaaaattcacttcattggctcattggctacttagaacattcacacacacctttctacgcatacctacctttccctacaacttccttataacttcatgctttcacttaattaagtgcaactatactttaaaaaaaaaatcaaaaagatcctttatttcatgtgtatgtagtatcataattcatcaaaataatttataatagttaactgcccctcaaatattgttttataaatgatgccttctgaagttaaacataatgtagattcattttttaaaaattgtctgtttagaacatactaaacaaatgataagttaaaaaaaaatataattctctcctgtgaagtcttctaagaaaatcatggcaagttcctgataagataaaaaccattccatcattaaaggggattaaaaagaggcataaataaatttgaataggaacatctgtttgctgagttttgtcattgtgtacaaatgaaactctagagttaaaattatattctgatttccttctataagcaagaaattccttaatagaagctcagaaatgacctcagtgccttggtgaaacatacttcttcatctgcggacactcagtgctcccatctctatcagatctgctgtgttacctctgttaacattcccaggcatctccaggaagacgggagatgtcatcctctccaagatggctctaccaaaccaaggctttcctggcaccaacaacgttctttctaaagccctacacttcacagaggaggcaaagcccgacgaagcaccatttctgccacggtgtccaccttaagcttccaactgccactgttgtgaggaggagccatcacagattgccatagccacagagtcttcctgaccctgtggagccactgctctcaggcactgtccagctgacgtctggtgtagccaattattttccccaaaggtccatgtctgcctgacccatggcactccacgagttgtggtgggtctgatgagctagtttctgtcatacctagacaaagaagatggtttaaaaccaattcatgctcttcattataaatccagatctgatttgggtccccatgctcacaagtcttaagcactagtaggcctcctttccaacttgggcagccctgagccaccagacatttgttggtctggaggtgatagagccttccaagttgaaggactttggggcattttggccctctactgataaaagtgggttgctgggatttgtcatgggtcccagatatctgcatctttgggtaaatattacccaaataccattcaaatgatttgcatcctaacttctttctcaattcaacatgctcactgatggttccaaagcttttcctctccagattaagtcttaaggaaaaatactgcgcctttattcatccagccagacatgtgccagctgcaaaaagttgtgttcatggcatcccggccttcaggagatccatatggtcccctttttttggaaaatgtgtcctactgtagagcaaggcatgatgaagaacttacctccacacacccagatctgaaatgttatttccaagttttctcctctccagatatccatgccagtatcatactgtccaagttcctggaaatactgtctgttcctggcaaacaatcctccagccattatcggtgactttgttggtgctgtggctttttctgctcatcctagctcagaaaggggaacaagctcctatttgaagtgcagccctcagttgaatcctccacggacaacagaggatgagctgtaggctagcgtgttggcactaatgatatcaatcactgagaacatcatggtctgctagtccacacagatgacagccagcaagggctgctgccacatcacattcacttcaattggctgtctaggaacacaaggacttctgttgtgtggactgctacactcattcttccttgaatcaatccctcacactttatgtttcttataccttaatttttccaaggaggtatttttggacatattcatctcgtcctcctttcaagtcatcaaggtcgctaacaacatccataaagatgatttcatgaagcaggtttgctggcatgcaatttgtgacaatgtgcagcatctggagacagggcagaaaaagcttcattgtggaaacagataacaattatgtaagcaactggcaggtcaggaggtaggactttacatgctgtattctttgtccctggcacatctctgtggtagcctgcagttactgataagcatattaaaagcacatttctgatagcccgtctctcaactcctgagcacgttaattaaaaatcatgcctagttcagaagacaatttcaagtggcctttttctggatcttcaatatgaccatcacatcatcaattttgtttgcttcgaactgtggctctagtaatagacttggaccttgagtgaatcaggaatagaattgttttggaaatggtccatggggtccaggccccttgagcacattctttttttttttaatatagtttaagttctgggatacacgtgcagaaagtgcaggtttgttacataggtatgcgtgtgccatggtggtttgctgcacccatcaacccgtcatctacattaggtatttctcctaatgctatccctcctctagcctcccacccccctacaggccccagtgtgtgatgttcccctccctgtgtccatgtgttctcattgttcaactcccacttatgagtgagaacgtagtgtttgtttttcggttcctgtgttagtctgctgagaatgatggttttcagctttatccatgtccttgcaaaggacatgaacttatccttttttatggctgcatagtattccatgatgtgtatgtgccacattttccttatccagtccatcactgaggggtatgtgggttggttccaagtctttgctattatgaatagtggatgagcacattcttaagtggctgagtcacttcaccgaagttgaaatgaacaaaaaccaaaactgcacaggtcacagatgtaaaaatgtacccataacagaaatattgaactgtgacacttcccataatagacttagcataactaatgggccattttcaatttctgcagcactggcagtggccttccaggactcaggctgtggcatctttcctcctgccacagcccctgtctgagccacaggagctgcccagggggtgaggagtggtgggctacactttgaacaaaaggagacagtcttattctctctcccaaatgggatgatgctatgtcacagttgtcattatgttttctgtgcaacatgtacagtattgctctctgggcagtattaattgctcctcacattcaatcactgtttcacctgaatgaatattgtggaagctaaatataaaattgtaaatttaataattccaggaatccttatataaaataatagggggaaggaaaagattgagaagaaattagttaatatatagaaacacacacacacacaagcatactgtaagggaggaaatatgcacagctgccactgctcttctttctgtattgattaccaggctgtagttaatatttattactagtgttagaccactggactaattctttaagtcacccagaggaggaacccagatatagtgccactgccatcatatctggacattgaatgtccctgtggtcatcatttccacatggaggtcacctgatgccacgactgatgaacctacaagcccctgcatctttgtgcaatcgtcatgagggctagtgtctcagatgtagttatctagttggtgagaaggtgctctagctgccagtgtttcagccttgtatgatggtagattcttcagtcagatattgggcaaccagcaagtagacaaatgtccttaacaaaagtgactgagttataaatctctagaggcctgagaagcctggctggggttggaaagtggaggtggaagactaatggataatgaatgtcccagggtggataattaaaggatgaaatcatgagtttgtttctagtctatagaaagtgacccagcagggagagaaaagttgataatcgaaggggagccattgaagatattttattgagagtgaataatggaataggccaattccatgaaaagagcacagggttggtcttaaagaaggtttacctcaacttctgagtattgagagaagaaaggaagccctatggtggatgaagatatatttgaagctcagggcagtttcctgctttattgagcaaaataggctttagctcagagaaaagtattcctttgcatagtagtaccttcttgcaatgacctaaatgctttggatgtgattaaaaattctcacttgggtgcctactctagacaatttctgatcttatcagcaggttaaggcaaaatgctcagttttaaagccccgtgaatatgtgtaaggtcttaaattctattatgtatatattataattatgatgaggtatttttctgaaaaagataagtatatgtgtaatatatagatatatataatttcagagcattataaatttgaatagttacttagttatagctgagaattttagcttcagtttagtcagccaaacagtcattggtctattcttctaaacaataggacccagaagaatgagaaaattaggtaaattaggtagattttcaaactttcttacaagatgatttttaatttggtcttcttttacttggaacctaggtttctaaaaatattagcacagtaaaacctgtcataatttcaaggaatttgagaaacagtctcccatttttttcctgccacattatatacctctatgatttggttaatatgttcattgcaccaactatcacatgctgtttctgcctttaattgtatttttgtttggctcttaaggcaatgtatctccaaacaattaaataggactctaattcaatgggtagagctggtcaatataggaagagctggtcaatataaccaatgagaactccatggaagagaaaatccataatggtgattactatagaaaagctttgaatcagactcacctattttggacatcagagaattcacaagagaaattttcaaatgcttccatgtgtaaaaaagtatattttaaaagggataaaatctaatgtttgtaagggatttaaaaccatataaatatgtcccttaagggaaagctttgtttgggctcagatattaatgtttgtcagagagtctgaaggacagatactctagaaatgtaatattttgaaactgctctgagattttctcttagatctaggaaggaaattctctttctttattaggtgcctactgtgtgttccaggcacggagctgagcatggggaacaaggttctacaacacagactcagcccttgccctcctggagctaacattctgtggtaaaaacagaagacataacagcaaagtttggaaaggctgtgctgtaataaatacagtgccttgtggaaacaagtactagggatatccagcccaggtgaagagggggcagaggagaatgagccagagagtgaagaacatttgcaaaggcccagaggcacagataccacatggcaggacttgaaaagttgagtgtggtgggactgggaagctggggaatgaagagaaatcaggatggagggatacacaagggtcagattatgaagggccctccaggtcatgcttggagtttgggcttctataactactaacacctactttactttgttttcacaattactcctgccagcattcttgatgatttcagcatccatgtgattaatcttcagtttcttgaatgcttattttcaatattcttgtattttcacaccactttgttcaccccttgtcatggacatgctcgagactttgtcatcaccaataagcatgctttttctataatctccatgtcaagaatcctgctctttgaccatctccccttgcacccttcatgttagtttattccctctactactcaacttcaggaataattctccatggttcttggctcccccttctgggtgccaggttctggcctgagtaaccctctcttcttcatgaaaagcagcccatatgcgcatctaagttgttttcacagcctgctttcctaccagcacaatttttaatggttgaaaggctttttttttttttccattttgttctgtctctgtctctttctgtctctatattagcactatttctgctaatacacttctctcacaaaactacctggacctccagtggatctctctggtgttcactccattagatatgataaaagcctgcaaatctcctagagatcttttctctgtcttctctttgatctttgctcagaaggcatttcttaattttaacagtgtttgctatctggagaggctagacacttcaagactatgaagtcctctttccttttgtttaagggccctttcttcaatgtatatctctcctcttacagcaagaagaaaccaagagacatccgcaacacttgctggaaatctccttaaatatatcattcagttcaataggcacattctatactttccacataactacagatggtaatgttaatgagctctctgctactacacaagaaggaccactgttctccagtttccaataaattatctctcacttccttttgtgccctcactggcagagtctttgaagtccgccagatttctactaacagcctgttcgaggcaatttaggttttcttcaccatgcttctccaaatccttctagcctctgtctgtccgctggttccaaagccactcacacattttcaggttttcattatggcagcaccccactttcaagttccagtatctgcattagtgatctaatgtcatataataaattaacccaaaacttagtggcttaaaacagtaatcatttattatctcacaatttctgtttttaaggaattcagctgcagcttagtgtggggtggaatgggaaaggagtatctgcttcagggtctcttacaaatactgcactgaaggtgtcagccaccaggactgcagtcatttcaaggttcaacttcaggaggagctagttttgagataaattcttggggttccaagttcttcatgggatgttggactgagggcctcagttcctccctggctatcggctggagacctccttcagttccttgttatgtggatctccccataggacagcctgcaccattgcagctggctttcctgagagtgagccagagagactcactgatgatcttgctttttattttcactgagacaacagaagcaggtggagtttctctaatgattgcttttctcacccaaatctaccaggctgcctgtatcagtgcccatgcacttttcctctcttcttttattgtgaataaattctttgagttctgatctaaggcaaaccctttgttacgtgttctgagtcccatctcttattgtcaactcaaggactttcttgccattatcctctattttctgcaccatcatgtttctctctcagctaatagacacgatataataactcccatttaaaaaaataaattttctctgttacacatttctgtcaagtaaccaccccatttcactacttcttttaaagaaaacaaagttttgaattgtatgaatacattatatcttcaaaagttaataaaaaagtcaacaagtgactctggccacgagggaataagagggtctggattactctcctgtgataaacaactagaaaactggaaaaaatgtaggaaataattattttcagacattggacaaagacagacagaactgtgattcctaagagaaggaaacaaaatgagtactcctagtacttaggctttctgaactgtagaaaattcccagaacatggcacagagctgaggaactcaagctgagcccaacaatcttgcagagataagagttcagagagggtaaggggctcaagttcatggggcagagtactttgaaagcaggagcatacagaaaaacttacagtggggccactttaactctttggctgaatatcaatctggccacaatgttgggtaagaaaaacttctagtaagagaacagttatcagggagctataagctaaacaattcacagaattcatagaggtctgggaatcgttcaagttcccacaaacgagattggagagaccttaatgggtatcagtgacatttcataggaactccagaagagctatactttaaaggtggggccaaattagccttagagtcaaggctacactatactattccccaaaatgcttaaaggatgccctaaaagattcaaattagtgctcaagtaacttaactgactttcagaacaaaatccaacactcttcaaggcaaaataaaacaatgtaatattcaaaaatgaaataatcacagtgtctggcagccagtaaacacatgctagatatatgaaaagataggaaaatgtgacccataaccaagagaaaaagaaaaaatagtcaatagaaacagacccggaaatgacagagatgatagaattggtagacaaagacagctatcattaatatgctctacatgttcaagaatgtaaaggaaaatatgaatataatgagacaggaaattgaagatgtaaaaaagaacccagtgacatttttaaagatgcaaaatgcattttttgtaaacaaaaatgctaaatattaatttgggcatttagaataatgttattcaataaaatagtatttatggtgtgcagcccatagtgctaggctctgtaaggggtgcacttttcattctccttcccttctttcctttctatcaggatggactcatggattcttattttagtttgtgggctacaaaagttacatcatttattttattactgaaatcgtctttctttctagcagtataagatgtaccaggttgatcttatacttttcctgatataacactggaattagccatttctccaaggagccatcgttccttttgttgaagaatggtatttacaaaccagtgtctggaggatagttgttcgttgttattgtttctagccctctctgtgtgcagagctagttagtgcacacaatatatacacaatgtgtgtacataatatacacaaatctatatatctatatatctctgtatgtacatgtattaaagggtgtgtgttcatactaatatgtcccattctaggccaaaactgcacagtccgttctaaacttcttttctttctgttttgtaactttcttctccagcagtgagaaagaaacctggcttccctttcccacagtgtgttacttatttgctcagtgctagaatacacacaaagcagttttagcattgctatcccatactgctgtgaaaaatgaaaacaagcgtactaactgaagtgcaatattgtttacactcattttgcctttactaaggctaatgggtacatggtcaaatattatgttccaaagttaaataggataggtcttccctctcccttcaggtggttatattattaacttggtagacattaagttctgtttgtttcagtttgcattcttctttttttcccactttctcttctctttgttgattttccatttatttggtgatatcttacatctgaagagtactttgcattttacaaaatgcttcttaaactttcctccttgataagatttatctaggtcagcactacttacttggcattcaataggtctgggtggaactagattgcttgcatttattcagaacatagattgcttagctctggaccttctgaattcctcatggggtctaggaatctattttttcacaagttctccaggtgatttttatgatgagtctagtctgggacaataactcagtctcaaattattttggattggcaagagaaaattttgaggtaatgtttttatagattaccaatctgaaatttaaaataagtgacttgattaaatgatttacaaaactaatactaaattttctaattccacttcattggtttgttcactattttgctgtcagtttacattacaatcagaaaattaggtggcaccaatttggtgttattcctgtaataatttagcatagaatttgcttggagaagctttaatatattcacattttctgggaagaaaaattggaccaaaagtcagaggacagaatgtgctttctttctaaaccatgtatggctaccaaaaatgaaattccaatactaaagaattatatctctaccttttgtgtaaaaatattaccaaaaaggcaaaaatggtaaagagacaaaattttaagttcatttgacaactgttttcatactattttcactttcaagtaaagtttatttacatgtagaggtattaaataaatagtggcactgagtttgtatatgtgtatgtatactggtaaggcataaaatattttgttgcatataaaattttcaagaattccagaaattcttaatgtttgcttgttttaagccaagtatatctcctgttacttttaaaatttgatgatccttttattctcatactttaaaattatcaaatttgttagagtatgttttgatattagtaaaaacagagttcttaacttcttatactgactttggcatgtaacaaggttggtggattccaggtttcacacaaacttgggaaactcctctcacaaatacaggaaatagctaatgtttttccttaaagaaaagaatcatttgaagtaattatataattctctaattttccatttataaaaatattgacatgattcaggttataattattttttagtcatggttactatggtctttattgatctctaaataaaatggtgatgataacagtgaaatttatcttgtgacaataaggcacgttgggtgtaatgaaatgaatattgaacatgatgcacaagacttcagttgagttccaggtctaccttctctccaaatctcagttttcttacctgtaaagtagatgatgttagttccctcaaagggtgctttgaaaaactggattagataatattactaaaggtgtttcatgtaaattgtaataatgaaatttgatgatatatttaatgtgctttctctatttttgtgtcctttgcccatcaaatacccaccagtagggagtacaaaatacttttggcttatacctggggagggagaattttcttttttcttaaagggccaaatagtaaacattttggggtttgtggaccatcctgtcttggtcacagctattcaactctgtgcttgcagaaaaacaattatagttagtatgtaaattgaattaatgttactacatttatgggcactgaaatttgaatttcatgtatcatgaaacagtcttttttttttttaattgaaaatgtaagtaaccattcttagctcacaggctgtacaaaaacaggcagatggctggatttggcctgtgggccagagtttgctgatcccaagcttagaacattttgaaattagttttagattgatgctgatagtgtcatgatggggttagctgttggcatggttacagaaagcttttttaaaaaccaacaaacaatgaattactataatgcatattttataatgtagatactatatagtcattattaaggatatatactctatatgatgttttgcatgtgtattacaattattaacaaaatgaaaaagagattgaataaatagaaaatacatcagtgaagggatgaggaaaccatagagttaatctgattttaaattcgcccttttttacaaatattcagtgtatttagaaaaggatggctttggcaagaccatctaaagtaagatgatgtgattctaacttttctttttgtcttaaaatatgactaaaattttctatcatttaaaatgttagcagagaatatatttgttgttttgtgctcaacttaggcaaatattcttgctttaaaattctgaagtttttcagccaaagcataataccttgcaagaatgtttccgacataaaacaccacaatttattcaatttgttcacagactttttgtaaaagcttttattttaatatttgaaaaacacctaaaaggtctggcttgatatttttaaaaattacattttgtttgctttgcttaaagatttagataaaatcgaaagtgctaaatcaggctacctctaattcaaaacaatattttatgggtggatagcattttacagttctcaaaaatacttttatgtgattattgtctttgatattcacacccttgtaaacatagatggttcggggattgtcttggttttattgattcaggaacctgaggctcacaaatataaacttacttgtccatgatcctatggctaataagcaaacagaagtacttgattttagatctcaatgttaatttagtgtgcttttgacactaatatcccctatacagttcccagtagattccttggcacattaaagccatgcaaatgttgtttcagggttgattttttttagtagtaaagtaataataaattctattacttgaaaatatatcataattcaaaacatttcatattagtggggtatgcagagaaagactagggtctatttttcatgttttttatatctggatgctcatatatatgctagtttattatagcttctaaagcaacacttttccatactgatttttaaattattacatttgttaattacagtgttttccctctacaaggactgcaagatttctgaaggcagtgatcatgcactatctccctatccccaggttctttgaaaaacagtgtggtttcgatatgaggtagcagatattaatggatagaatggggcagcacaggtgagatgggtagacagagacactgttactccacactcttctccccactgctcttattctatagtcacttcatttacaccaagacttagactccctaaaggatgaggcagatttataaaaaatctagtaagtaagaaataacaactgtctgttcttggttgcatgctattattttttatgccctgtatttggtaaccctacccagctaattataattttttttttaagattgacctacttatttgaaggtttaaaatgataggcaaggtattgcttacaaaaatttcctggattttctttctttttgtaaatagttttattgaggtatagttgatatataataagctgtacatatttaaattataaatttgacaaatattgatctgagaaatcactcataaaaccatcagtataataaagaaagtgaatatatcatcaattagaaaatttcttcctgctcctttgtaatcccaccctcatgctcctaccattggtacttcctcctcccaccccacctctgtccccagggaatggctgatctgatttctagcacatagcctactattactctagcattttttagaactttatataaatgcaatcatacagtactttgttgtgctttcatatacatgattatcttgagattcattaatgttgtttatatcagtatttcattcgttttgattgctgaatagcattccactaaatggttatattgcaatttgttcatccattcacctgttgataggcatttaaattgtttatagtttttgactgttacaaatgaagttgtcacaagtgttagaattgaaatatgttttcatgtctcttggataaatgcctgggcatggaatgggtacatcatgtggtaggtgtgtgtttaacaacttaagaaagtgccaaactgttttccaaaattgtatcattttacattcccatcagcagtgtaagagttccagttcctccacatcttcaccaatacttggtgtagtcagtctttttttaaaattttaaccattctagtatgtggatagtgatatctcattgtgattttagtttgtgtttcttgagtgactaatgatgttgagcatcctttcatatgcttatttgccataactatgatttatatggtgaagtgactgtgtaacattttgcctatctttttaactgggttgtttgtattattattatttagttttgagtattgtagataccttatgtatacaaatcttttatcagatagataattggcaaatatgttctctgtgtatggtttgtctttttgttatctttcatagtgcttctcagaaaacaacttttcaattttgataaagtctaatttatcagtttgttcttttatggatcatgctttttgtgtcatatataagaaatttttaattaacacaaggtcacaaaattttttacttatgttttcttctagaagtttcatagctttaggttttacatttagatttatgattcatttggaattaatttttgtatctgatgtgaggtatggattaaagttcttttcttttattgcatatagatattccattgttccagcacaatttatcagaaagattatcatttttccacagaatttcttttgtgcctttgtagaaaatcagttgtccatgtaagtgttagtctattctagactctattctggtccattcatttacttttttttgtttttacatgaatacttcattggcctgattattgcagctttataatacattttgaagttaggtattgttattcttcaaaatatgttcttcagtttcaaagttgttttggctattctagattctttgcatttccatatgaatttttagattcatcttgtcaatttgtgtaaaatagcctgttgagattgtgagtagcattgcattaaatctgtagataaatttgaggagagctggcatattaaccatattgagtcttctgacccataagcacagtacatctctcattttagttaggtcttaataatttccgtcaacagcatttcatagttttcaatgtgcagatcctaaacatcttttgtcaaatacattacaaagtatttctatttttgatgttattgtaaatgatattttaaaataatttctgtttcatcagttatccaatataaattcagtatcataaaattattcatatttccttattatccttttaatatctgtagactgtgtagcaatatcgtgctttcagtttttatattcttaatttgtgacttctgtggtttttcctggtcagtctgtgatatggtttggccatgttcccacctaaatctcatcttgtagttcccataatccccaagtgtcatgggaggaacccagtgggaggtaatcatgggggtggttacctccatgctgttcttcactattatggcggttacctccatgataatgagtgagttctcatgagagctgatggttttataaggggcttttccccacattcactctgtacttcttgctgccaccatgtttgcatgtccttccaccatgattctaagtttcctgaggcctcctcagccctgaggaactgtgaatcaattaaacctcttccctttataaattacccagtcttgggtatttcttcctagcagcataagaatggactaatacagtctggttaaagcttctttcatgttttaaaatcttttaaccagcttttggctttcttgatctttgtgtattatttttctgtattctatttcattatattctgatttgatatttatgatttctcatctgttttaaagtttggttgaatttgctcttttttttttttcctagtttgttaagacggaagctgaggtcattgatctgagacttttctttttttctcatataggcagttagtgcctatatttagtgttaaacacatttccctggaattattgctgtaagcaatatcctaccttaaagaatatgttgtattttaattttcatgtacttaaaaaatccttctaattttttttgatatgttttttgacccaggaattatttagttgtgttcagtttccaactatttagggcctttccaaatatctttctgttattgatttctgttattaatcctatttttgtgtgactggaatcctttaaaatttattgagacttgttttatggaccagaatatggtcttccttggtaaatgcttttgcaaagaatgtgcattctgctattgttgcatggagtgttcttgaaatgtctattaggtcaagtcagttgatgcgttgttcacgtttttatccttactaatttctgtctatttgttatatcaatggagaagaatgttacatcaatgatgaaatgaaattaatcaataattgtggattagtctatttctccttaaggttctctcaatcttttgcttcatgtattttgaaactctgttattgggttcataaatgttttggattgttatgttctcttggtaaattgatccctttttcattatgaaatgatcatctttatcccatggaatattcactgctttgaaatctactttctctgatgttaatataaccattacaactttcttttgactaatcttataatggtatatcttttcccgttcatttccttttatttgtgtttatagttaaaattgatttcttgtaggttgtttataattgggtctttttaatccagcatgataatctttgccttctaaatgggatgttaaggctgtttgcatttagtgtgaaaattgatatgtttaggtttaaatctttttatttcttttcttatcctattttattatttgtttccctttcctctttttatgccttctttttgattttttaaatgattctacttaatatcctttgttgcttattaattatattttcttgttttattattttagtggttgctttagcatttataatatttgtcttcaatttattatagtccaagagatagtatacctctaagtgatatcataccacttcgtgtaagaacattacaaatttctcccctcccaagcttggtactaatgccatacattttacttttacctacgttgtaaactccacaccacggatctattatttttgctttaaacaatcaataaatatttatcattttagttaaatttaatttctttgtgtgaaaccacatttctatctgctgtcatttttttttttttttttttgcctgatggattgcctttagcattttttatagtgcaagtctgatggtgacgaattatttttgctttggtatgtctgaaaaaaaaagcctttatttcatcattattttgaaagctgttttcgctgggtataggattttagaattgcagtttttcttttattttagtacttcacttttacgtcattatctttttgcttatgttattcctgatgattaacctgctgtaatctttatctttgtttttctaatgtagggtttttttttttcagataccctttaagctgggtgtcccaaatagtttacttcaattagtatttagtatcctgctttaaaagcctatccagtattttcatatctgttttaatatttagctcttatttttcaatataggcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccagtcacctctaatgtcagttcagcccataaatatgggtaagttatgcactaaaatgatgataataggtctaaacatcagtcatatataaaggttaaaaattgcttacaaaaatatttgctagcttatctcactttgcttaacactgtaatgatggtagatgtagtactgggggtattaagagtggcttctagaatgatttaacaatggtatgtatatctctgccattgtcacttaaattctgttttgaaaactgttttctttcaatcctggatctatgtaatggatgtatattgattggatatcactttttcacatctcagataactatttttgaaaatagtagcatgtttcttgcctgaatttattccttcaataaatatttcttagaggctcatgtttgtcagagactgctccaggagctggaaaaagagtgggacattagacatagttcccacctcagagagcagggacaaacaatagtaggcagagacaatgataaaagagtaaatgagtaatttactgtacaaacatgattacaaaaaacttcaaataatagacaacactctgttttctttgtgcaaagatcccccaaatctctttttatcaatttaaatatacaattacaaatgtgaataatacaggaaaatgttagcgctatgtatttaatttattaatttcatttaattatgtataatttagcagtttttctccacttatatttcctgaaacaattatatgcaaactctttatgtctgattttgcatcattggttttgacatcactagagctgcttttccaagtatctgatacaattttccatacaactcaagctttacttctttctaagttactcgagatatagcactttttgaaactgtgtatgacatcatattttaacatgaagactttcaaataatttgtcctgtagggatatagttgtgatctccacaacataattacaatggcatacaagcaattcaatcgtgaagttataccatagagaaaaaagttacaaaatctttattcaatatcattttcttttctttgaaaactaattctacctgatgattttttagtagcatttagagtcaacattgagtgcattgtttttcaaaatgaagtaggtaagggaaagtgctgtggaattttaaagaacttgaaagctttcttaattttgtctttatgcagagataattttggggaaaagtatttccttctatttgaatatatattataatatccccaaattatatgttccatgaaaaaaataaaactggtgtgatggagtgtcagggactattatttctactatgtagatcaaagaagatctcctttaggacatagcatttgagctgaatgaagaagagatatccatgcaaaaatccagagcaaaaggtgctccaagcaggaagaacaatattcacaaaatccctaagatacaatgaacttggtaatttgaggaacaaaacagaagacctttgtgctaggagtgaaagagatatgagagtattaagggatgaggtcagagttacctggtccagagcatattgtaggccagggtggagaagtaaagaactgttttggtttggatctgtttgtgagatggtgctgactggactgtctagtggatggagttgtagagtgtgaaggacagaggggtatcaaggataacctttaaatttagacctgagcatctaggtgaacagagacaccagatactgagatacggaaactcagggaagattaggtgtgtgtacagaaatcaagagctctattttggacacattgtatttgagatgtctattggaaacctaagagacgttgaataagaggttggacatatgagtctaaagtttaggggagatatatatatttgggagttgttagcgtatcaaggtttatagtattgtatgagatcacctatttagagttcaggaagagaaagactgaggggttatcagtaagaatgaaggagtaaaagagtatgttgttgtagaagccaagtgaaaaaaatatttcaagaaggagggaataagcatctatggagtgctgctgaaaggccgagtaaggtgaacaggaaattgacattgggtttatttttgtatttctaatattaatgcatattaatattgtcaacctaaaatgtatgacagataccaactctataaagcaaaaagttgatttgggagtagtaggggattgcagttctagacatgcatgctatggaatgactatgacacatccacaggggattggagtaaaggggaagcttgaaaagacatataggagacctccatgtaagctgttttgaacaaagattattggttacaagagcttgctgcaggggtggcattagctcattggtggagacagccgtagttaggcaagtgtctctgtgcaagcggcttttatggaatactgtggttttgaggaattctttacgttgttccaatgtaggcatacatatacataaggggactccttcatggcctcccaactccattgtgttagggtttcacactagtaactccagtttgatactgataacttttacagtatgcagataggaaatgtacaatagcttgtaatattgtaattttacttttctttggtatatattgttttctctttggtcatggaaacacagtaaatttcacctgctgtttccagacttttgtgtttagctgtctctgctttaaagtaactgaaatttataatacgtctcataaagtaaaacctcattgattttgactaaaagaggaaaattgtgaccaaattcttgaaaatatagaatgtgaaaattatcttatgctctttatttattgaaaataaaattcaaatcagtgtttcaatttaatgataatttctatatatatgaataattcctgttaattgtaaaaaccttgctaatatagagatgaacaaacaagaaaatgcatcgattttctatcactttggcgatctttatattttaactatatcaggaatccaagtataaatgtgtgttaaactttcaaaatttaaacattaaacatttttaatattctgagaaacttcatccctacttctgatgacaagccagggactgctgatgctgcatttattgcatgggaatatttatgctgtcagttatttgagtaggtttgtctagattatagtgatctaaaattaatagacaagctgaattttgggtagttttgtgtatttccaaatagtgttctgcaaaatgcttttttcctttttaaccactaaaataattgaagtgggtgaggttcaggggagacttcagataagttttaggatgctgggtttaataaagttaagtgggattcttacaaggggaaatcacatttagcaaaataatctcatttactgattcatagtctttaccacttaaggggagggtaatgaatatacatggattgctatgataaggtacaaggacgagacccagtattcaagcttgtttcggttctataattagtccttggataaagtcaccttttaagtacttgaaaggcaagatatgatgaaaatttatcttgactttattttattcagctataattgtcatgaaaattacttgacttaaaagtattctcttttttttccttaagtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagtaagtatattttagtaagtaaaaggaaaagttgagaagtaaataaagaccctcttaagtcccatagcaattaccctctgcatactaaatatatacatttcttctaaagcagaatgaattataattcaacatttcatattatatatcatatatagatagatatacgtatgtatatatatggctataggaaatctagttacagaaacttgaattcataattacaattattttccaccaacagaccactgatttcatcttttttttaattgctcaatctatttgaatgtttttctgaatgtggcaacagaaagatttttgcttggctaatcattagtcgagcttctgaatcttctgctagcccgatctgtgcacattcctgtaaaatccagttttagcaaagaactctgctaggtcattttagcaggaacacccccaccctggatatctgatgaatatttgatcagatttctcatcctccaccattccccaaatgatgtttgatcaccatggcctgtcttcagcaagaattctgttaggtcagtttagccagaatccctcttaccatgatgtttttgcttagtaattttctatctactccctccttcttggctataaattccctgttgtccatgctgtgtttggacttagcccacataccccgacccaccacaagaccccattgcagtgctccatatacctattgtgatgattccaaataaagtcttccttacttcctttctctttttctttaacagttcgttccgtaagtatttattgaacacctgctacatgcctggaactgttctgcttgcatcaggatacactgagatagcaggacaggataagaggaatctgggggtgctggtagggaatggaaggttgcaataataaatggaggttggggagggtgacatttgagcaaggatgtgaaggagatggtaatgtagatatctgggtagttgggttctaaacagggagaacagcagtgcaaaggatggtgtggctgagggcagtgaaggtgacagcagtagtggttgaattcagaggccagcaggggaagagaatgtggagctcaatgaaaggcctcttgggccatgtgaatactttggcactttactttgtgaaactaagtttcatataatttagaagtaaaaatcagtctttttagaactggcaaaaaaatttaaaacattttattttcacaaagagaatgatgggaatcctcagtgtcacatatggagaaaacagagttaaggcttctgtgggtttcagctttcttatctgtaaactggagataatttgtgaacttgaggattttaaataggagttattaatatctgatgttgttttatgcattcctgatgcttttcataatttttagtctgtgacatgctccccttaccccaagagcagtcattagagccagagaatttattaactttggagtacatttttgggaagctgaattttgatctcctaggctcaagtgatcctcctgcctcttttttttttttttttttttaagagatgaggtatcactatgttgctcaggctggtcttgaactcctgggctcaagtggtctacccacttcggtctcccaaagtgttgggattacaggcatgagccaccatgcctgaccaggctcaggttcttaagacttttcatgctcttctgtacagggacacttgtagttctttgtctacccctgcacagcattttctaccaggtgtgtgttataggtgtcagtagtggcttaaagcttcccacagattttagctgcatttcttaaaattctaaaggtcatatattcatcatgattcaattaacagtatttgttaattatcattatgattttttcttggacccatgggctatttaaaattttattgactaatgtgcaaactttttttttggttattgatgtttgttttaattccgctgtggccagataactactgtgtaagatattaattctttgaaatttgatgagattagcttatcctcacttttagtaaaggttccacatcaacttgatgttctgatgttttaatataatatttaacaggctgacaagattgtctcagctacatccctgctagtagacagtatacttcctgggtcttcgtatgaggttcaggtgaggggcaagagactggatggcccaggaatctggagtgactggagtactcctcgtgtctttaccacacaaggtaggttatgtaatagccacttctactgggagggaaatatatttcctgaacttgcctttgtatagtataagcatcttacattttgaggccttaaaatgaaaggaggaacacagtatcaacttccttgtttaaactttgaacaggccaatttgtgaattaaaattctgtcagagcctctaggcttgtgtgtttctattgcagtatattgtaggatcacttttcctattaaaaagaaaaaattaatataacagctccaaattaacaaactcagaaagccatttgtattgataattccttaatttacattttaaaaccaagcatatttatttgacataaaattcaaatattaacattttactttatattatataataaatgaattatttttactccagatgcttgcttttgagagttttcagtgccaatgttcatattttaaaggttatttttagcatcggaacatctacagttcattcacagcttcttcatgcagctgatgcgcaaagttttgcatagaggctccagaggcttggaatggtcctagacctgttgcatgcaaagttgggactatagaaagacaatagtcctttggctggttgtccgatctgtcaaaagggcaaaatttttcttgttcagacttactgagattgattatggcctgtacagagataacaggtaccatgcaaatatcaatccatttaacaagtttacttgttgattgcttactattttaaaagcattgattcgtcaaaaggcaagtagcaatagtagtttaagacattgacttcggagtccaacagaagtttataggagttctggctccaccacttatttggaaagtttcttaacctttctatgccttaatttccttatctgtaaaatagggatgttttacatggatatgaaatatccatataaaattaaataatgaaatgaaataattaacattggtcatgtgaagaaaaccattattgttttcttattctgcaaattaaaaattgcatagtatgtcatatgcagataaaatgtgtatctatattattaaaattttgcaaattaaatattcaatatctcatatcaatttcaataaatttatccagtgtaaatttcacaaattgtcaggtttttattaacttagttttcttattttaagctaatattttagcatctaatcatgtaaaaatactatgactttaatcttatttctcagttaagccttactatatgtatttgatttcaaagtgaaatgctttgaattttcttgtcatctttaaaatgaaaaacttcagcttaatccatgaaaactcaattatattttttatttttaaataagaattattctgagacttttgaggcagttgagtaaggaggttgtggcgcatactgaaggtaggttaagataggttaatgtactaggtacttgtccacagtaagtaatgtacaagtgaagcttgagtgccacctcggctaggattatactcagtcacgctcataaatctaatggtctggctcctgtgcagtaattttatgctactaagttttttcctgtttctatttgattatggacatacaaaacacaaatgttttgtatgaattgtaaatatatagacattgacgtttaccatgctattacagaataaagaaaacttaataaaaaccaattaaagtatttttgtttctgtttttaagggtaatcccaagatatgtgtgaaaacaaattttcatagtctatcaacagaaaatggtttaccttaactttacaactgaaatgtactgacgtttttgcagtgcactgtggtggaaataatttcttcctatgtaaaccatcatttacttgtatctcgcatgtctttgaaaatgataggcaaatgaaatttacaacaacagaggactttaaaaatagtatagaatcatgtgtaggcattaaaaaaatcatgttttaggaaaatatcgcttccctttaccctcatccataggatattggcattaaataactcaaaatgatagtacaaaccagtatttcccattttctctgctttgtatattgctgcattatcattcatacgacattcctattttttaatttatatctcgtatctttacctacttacttgaaatttttatgtatccaaacaagacaatagcggcaatcatttttacttcaggatttggcttcatagtgatttgctttaagaacttgtcctagtttcactgattcccaaagcagggtctgttggaaaatatgtcattgttgaattaagctatattttgttttagtcactttcctgcctatcagttagcaagtgacaattactggctaaaacatattttatgatgaataagcctctgtgtttagaagatagtaaagacattcatggaagctcaactcactttagaatgagagcactcgggacactagataactgtacacaaacaggtaatttcagcattatccagtttttaaattacactcattttatttttggcagtgtaactctggaatgtgttgtgaatatttttcgatgtggtacaaattacttacagaatgttttgtcttcatctgatatcctttcttccctcattacagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattggtaagaaaacagaggttttgttcattttgttccacaacttgaattttcattatggaccctccttatattagagtcctgttaaagatgtaagaaaaaatttttttcattgaattttttggagtttttgctttatattaatattttaatatgtttcaaatagatgtcaatatcaatatctcatgtgaaactgatgggtacttaactaaaatgacttgcagatggtcaaccagtacaatccagtcacttgcggaaagcactttgcaattgaggtatcataggtacgtattatttttgctgttttgtttttctgtgggcacagtgagataaaaattttctttagaaatattacaacagtagtcttacagattatttgcttcctgaaagaggaaagtataatataatgaatcaggaaatttttgagggattatataaattggtgattcttgaaaaatattcacacctgagattaaaaaattgtaatttgtttttacttcaaattatcttttctgaaaatcaatcaattctgaaaaatttgtattttaactcttgaatgaaatgcaagaaaatgtagtttatatatattttaatttgacttagttgactagaggagaatgtgaaagattataaaagtttcgtatcatttggctaaagattaatgttttggaaaaaagaggtaaaaacagattataagagataatatgaatggtttttagaactgagtgagattacttaggaaataaatacttatggttaataaagggtaatgtgttctaatgagaagtaatttgtgcttgtttatttttactcttctatgttttaaaaagaattcaaggcatcgtcttatagtggtccctttctttctaaaatcattttatctaaaatgatacaacccttgattatataatagatttttatttttaaaaatatcccatagtagtagtcaagtaaatatatactgctgttaaacactgtgtcccaatttatatttttatttgtagtggagactttcaatttgtataacatgctcatttattcttaaaatataaattttcaactagaaaaataaatcccttctctcaaatactgtgatctgaagtctattcctaatgctgccagtctcttcttatgtagcgttaggaaaaaaatgtggcaattcgtacatttctcaaatagctgccttcatcctacctaatatgagtattttaaaatcagtagaattgttcatgatatgaaattttacttttataatctgtctttacattcttttcatggcattttcacattagaaaaggtgtttatggaaaactattatgttaagccccatgccttgtttctcttattaacatttacagaataactatgaaactacatttacttgggtgagtttcttaacttccctaagcctcaatttccttgtctgtaaaacagagagaataataggacttacagtgtttctgcgagagttaatgacatatttcatctaattataatcacatggtataatttctccttgtaaatattcaatatatggtttttgctgtcatgataatgatgccaacttttcgatttcaagtgtactagtactgtgcttctactttgttcttattttctacccccagatgacccctcactcctcattttcatttttgcccacgcaccaccatttattcacacacacacacacacacacattcatgattgtaattttgagaagacaagaaaaagaagtggtatagaaaatagaaaatgacagaagaatatagattttttagcttcttctaacttcctcactcccatctctttggaaagagtaattgctacttcagctatttaaatatagtattcagagcaaacattggcccaagaggttatttcaaagaagaggaaaaagactttatgtcaagtttgtccaacccatggcctggggcccccatgtggactaggatagctttgaatgcagcccaacacaaatttataaactgtctgaaaacattaggagattttttttgcaactggtttttttttttttttttgattcatcagctatcgttagtatattttatgtgtggcccaagacagttcttcttccagtgtggcctagggaagccaaaagattggacacccctgctttatgggttctgaggtggagtgttggctaggactcacttataaaattttttttaaattttcttttctgagaaaatgaggaatatacatggttatataattcacatacatatctgaaattggtattatattaacttatattaatttgaactagaaaattatattcaccactcatttgtggtgaaatttaattctttcttcaaagtgtgaggaatttgccttccttgccatctcaggaatgctccatgactactttcatctatattttaaatattctatcactaatacataatgtttgtttaattttcaaattattgtaggttctgtctctaactggatcattttcttctttttagagtatttatttcatttgcatccctgcttagtgtctaatgaaatatttaataagagttactgtcagtttctgtggaaagatatagaattgggaaaaattaaaaaatgcctttctaataagaatgtctttttttagatggagtgaaattgtctgtattttatttattttaatttaatttaatttaattttattttgtttttgagacagtctccctctgtcgcccaggctgcagtgcagtggtaccatctccgttcactgcaacctccgcctccccagttcaagcgattctcctgcctcagcctccctagtagccaggactacagatgtgcatttgtagagacagggtttccccatgttgcccaggctggtctggaactcctgggctcaagtgatcagcccgcctcagcctcccaaagtgctgggattacaggcatgagccaccgcaccgggccttctgcctgtcttttaaacttggggtccccagtccctgggccacggaccggtacctgtctgtggcctcttaggaacccggccacaaagcgggaggtgagagagcagcattaccacctgcgctccacctcctgtcagatcagcgcagcattagattcttagaggagcagaaccctattgtgaactgggcatgcgctcctcatgagaatctaatgcctggtgatctgaagtggaacagtttcatcccgaaatcctgaaccatctcccatcccccattagtggaaaaattgtcttccatgaaaccggtccctggtgccaaaaaggttggggactgctgttttaaacaacaaatcagaattctcagatatcttcttgttgcttttattaatgtatactaattgactatttttgtatcttttaaaggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtgggtatgtcaagctgcgttgtgtcttcatttgtgttagcagatttgtatgcagattgatgcagatttaatgttatattttgccattttctgatcacattagattttgaaaaaaaaattgttcctgtttacagtggtattgagaaaatcagccttaggaagttttacagttttgaattcatttcaaattatttatagcagactttttttagcaataggaatattttctgcacactattagatgaaatacatgggtcattatgaatgaattttagtagtgtttttctaaataaggcattattttatgtttttgttccaatgtagttatgaaaacatgtaatatttgtaatccaaacgtttaatttgaatattctgaggttctcaataatctgagtactcataactcaagcctttaatttgtgaggctatgtagggcacagaagcatttaaaatagctaaattgaagtggaggaaatagacaacaatgacatacattatattttaaacattcttttcaaaaaacttttgatttcaaagatattaagagagcccttggaaaatgtgatatattctttccggttcattgtgaaatctctgagaaatgattgtgcaacaggaatgcaaaaatatcttttggtgctgttacatatgtataactaaggaagcttttgtagatcttttctaaatgtttgttttcaagataagatgtctaaaaacaaaacaaaaatgggattttcagtgaattttcccctcaaataaaatattcctcagtaggaaacatgttagaataatgttccataaaaatattaatatatactattttgttgggggattatgtcaaaaatcaatatttgagtcattatttttcaattaattaatacacatttgaattaaaacctataaccaaaaaatacacgataagattgtcttaattataagatttctttttcaatgtaaagtcccaatgaattctctccccactgtttaattccattttaagtgatttttactgcagtgatacttaatatcccaggatagcaaggaaccctcctacactcccccaaacatgcacagataataacacactcacttataagatatgacaaatgaagcctggattcagtaacatatgttacttgaataacctatggtgttatccttttcaaaactaaaataacgagtttaggttgggcttatattgcctacttagtactagaaagtaactcaacgttgggatccaaataccatctccacttattactagcctttaaatccggactagccacacaggcactatgtgtctgttttgtcatccataaaatgtagacagctcctcataccttcccagcatgggtattgagggaatcacgtaaactattgaacttcaagcatatcctttctgcagactggatattcactgccagtctgcagaaaggatatgattcatatgattcagttaattgcaaacacagatttaacctcttacagtctcttgaatattgatacttcctttcctgacaagaaattatcaagaggtgaaatacagtatatatcatcttcctgggttggtggagaatgtctttttgttctatgaagaattgaataatcatgataaactttacatgacggaaaaagtttaggtatttttgttatcaacagtcaaaagtattattgttgattgcttaaaaatgattttaaaataccatatgaaagggagactatacctttacacagtgttggtttttggcaagtgagacttggagcaagagaataataaacacccatattgtgccaatccaggtattaagttttccctgtgaatcataacagtagcatgatttataagacatggggaaataaatcaagaaggtaaaccctggaactctatcgtcagttctctcttaatttttcttacacagagtgtctacatttggccttagttatggtttgggttatttaggtttctttttgttggtggtggtttgttggttggatggtttcatacattagcccttcagcttccctttttgctactgcagttgtttcctgcatattccagccaagggccatctctcactttagattgtccactggcaggggtgactgtcaaaataatgaccaagaggagggccattccagctgcaatcccagaggcctctgctgtaccaggcattgaccttttaggttctgagccgtgggcaggtgtggagggcatccaacctgagcagttctggaggagatattcctcaggagagcacctctttaccagttggtatggatgtacttaatatttttaacaactgttttgacataccaactgaatatatgtcctctaaatggaatcttctagtcttagtgcagataatcaagacatgactatgtaaatgtagtgtgtatcataaagttgatgcttggagtcataacagagttagggcttcagagacgcactgttatgcttgggctttcaggcttttagtttaaaatatgccacatttccatattgcctgttattgtcaggaagattggccctcaaagttaaaaattaagaacttgggggaaaacttatgtagtgaatctaagcctaaggtagtttttactttagctctgaaagcagcatcataaaaaggtgataggaaaacagggaagataacctttttctttgcatttctatgatttttacattacacctttaaacatgtcttgttatgtacatatacgtatctattttaaaaatcacttgctattcagaccatctttgcctctattactgcccattaaaagcctgttttcctcagattatagaaaaccaaggctttgctctgagagactatctctgaccttgacctagaaatatttaatgatacacagcagcataagagtttcacactcacacatatggaaattgatgcagtccatgggttttttttttttttgcctttaattaaagttcaatggagaacagtttgttattgatatttagcatgtgttcagcatggtatctttttttttttttttgagacggagtctggctctgtcgcccaggctggagtgcagtggcgcaatctcggctcactgcaagcttcacctcccgggttcatgccattctcctgcctcagcctcctgagtagctgggactacaggcgcccgccaccacgcgtggctaattttttgtattttttagtagagacggggtttcaccgtgttagccaggatcggcatgttatcttttgcttgcagagccaatggttcaatttctaatcaggtactactactagctttcagagtaacatgaataatgtattgacttttttcagtcaagtctatatttgcgaaaaagagataaatccctcttttaatatatcacataaagtaatagggaaacaaatgagataatgagtgagaaagttatgaagaagatattgcttgatgaatacagatgtatgaaaatataacacaatgtttttaggcattattactatttaaattaccatcacttaatactattgtaaaaatttctagtgaagccactgcctccatccagtgtgaaagcagaaattactataaacattggattattgaaaatatcttgggaaaagccagtctttccagagaataaccttcaattccagattcgctatggtttaagtggaaaagaagtacaatggaaggtaccttttacttagaacttcagctttcctcattaaatgctatttttataatatgtaagagtttaattgcattagattaattttattggcataaaagtacattctcctgtattgtgtagctattttcattaaatagatttatctaagtctaacttttttaaagaacaaagtttcctgaaatccatcattccctgaagtgtgttttatagaacgttggttgcatattatgttccttggaaaaagattaaatggctaaatcagtttaggaaaccctgtatcactgtatcttccttgtgtagtcacggtatacatattacatattcaaggtttggagaggtccttcattaaagaaaaatttgtgaccttatttcatctcatgttccccaaactaatttttccaaggaactgttgtttctctaacatctgttgatatcttttagtacatacatgtttagtggaatgcattttggaagaagctgcttttcaaacaaacagagtcattcccgtagtggcaagtgtgcctatcatggcattccacatcagctttgtgacggcagcctgcaaagacctagaaatatcagaaacccttattgtatcattagatcacaatgatatcaactaaaacaaatgtgacagtttagctgctattgaagaatactgaatatcagcgatttgctacagtaggtcctatctaaccaatacgtttaaattctttttaaattcttaaaacatctttgtgggtagaggattagtggacagggattagtaggagggtaagagagtgtttgggaaacaaggttgcaagtaaaccagttcaaaatcttgtcatcatcagcaagggagtgacaagataaataagaaaatccttgacttgaaggagtttacaatccaagcctaattgtgactatttctgaaggcagagaacacagaatcagttctcttaattttggaatagtgttaaggtttaaaataaaatgtacttcagggccctttagatacatatgtgttggtaatgatcaatctaatgctttgacttattttacagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaaggtctgcagagattttgtaaatgtgttttgaaagtgcataagtgtgtgcttcaaatatggctgaaaagtatttcttcaaaaacatatacacaacttgtcattttgcagttcctatgagaggacctgaattttggagaataattaatggagatactatgaaaaaggagaaaaatgtcactttactttggaaggtattcccaattttaatattaatcttaaattgtatttttatactcttaaaaatttacttcatggtccataatcctgttattaatcttcggaaagctcaacaatcctgtattttcattgcatttatgagatgtatttaaagagagctaagatgtacagtggctgaagcactggcatagtgttaggagactttcattctcttcttagcttcacatattatagttacgtcagtactatttgggcaaagttacttagactctttgggcctcagttttctcatctgtgtaaatgtaatattgaactagatgataggcagtgtttcttggagtctaaaaattgtattcatatttaatcctgaacaatgtaaatgtcaccttccccgcacaccccaagggcatctaacacatgacagagtattccatttatgtgatggcataaaaacagtggatagtcccatatatgatggctgtttagcctagtaattttcaaagcatcctctcccaaatgaactgatttctatttcaagtgaatagtttatttggtcagtaaatgccaaatttaagattgacttgggaatacaacacatgaagtcaaagagtatttctgtcactccaaatgtgaattgtaagtttaatacccaaggttgaatgagcacatgtttgaaaatggtttcctgatgtaagaccaaagcctctgtaaaagttgtggtatataagaatttatgttcatttggtttctaaatccagttactctataatttcatttggtgaataatcaatgcaatttctaaagtcttccatttcaatatttcttaaaataattttttattcttttatttcatttcttttatcattgctctccttaaaaaatttagtttcttttgttattgctctcttttctttttctagcaaaccattccttcaacacattttaatatttccaacttaaagttagcattagaactgacagacatttatgagccatttattgtattctgaacacttcatacagatctccacctcccggggaattcaggacctgtattctgagagattgagtgggcggttgaacccaccgcggaagggggcactgctgaataagaaacaagagtcttgcccgacagattatttttctcatatttttggttttatctccatgggcactgttccagatacctgcaaacttctacagtgaaggacaggcagtgatgttcccatgtttgtggtagggccagctatgagcagaatttaagtagcttttctttttctttgatttgtcctctcagagctgtagtcaacagccctttggcctaggctacagctaccctctcccattgcaatatactctagaacaaaacagttgtctttctccagacagttcttatgttttcctcatatcatggattccacatttcctcagcaatgctgccaatagaagtttctgtaatgatgaaaatggtttatatctgcattgtccaatatggtagcaaccagccacatgtggttattaagcacttgaaatgtgcctagtgtgactcagcaactgaattttaaattgtatttaattttgattaatttaaatttaaatggctgcaagtggccagtggctatctttttggacaacaaagctctatgggttctttaggggtgatttgtgggagggagacaggacccttgctaatctaccatctttgcagaaccttgaatgccttttattagtcaatttgcctttcattaattttgttttgtgctgttttgttgtgttttcctaaactgagataatagttcaatgattacggttctccaagcctatgcctcttaaaccgggataagatttgcttaaggagtaagccacaaggccacaggataagtatggcactttttaaaaaatatcatttctctggcatttttaaaataataaactttacgttaaggcagttttagagttacaaaaagacggcaaagatagtacagagaattcctatgtattcccacaccaagttttctctagtattaacatcttaggctagtatgatacatttgttacaatgaattaaacaatattgatatgtcatcattaactcatctgtaatttatttcaaatccaaatttccttagcttttacccaatgttctttttctggttcaggattccatccaggatagcagatttcatttagtagtcatacctccttatgcttctcttggttgcaaaagtttcttagatcttctttgtttttatgaacttgacacaattgagaagtactggtcgggtattttgtagaatctccatcaaatgggttttgtctaatgttttctcatgattaatttagggttatgtgtcatacctccttatgcttctcttggttgcaaaagtttcttagatcttctttgtttttatgaacttgacacaattgagaagtactggttgggtattttgtagaatctccatcaaatgggttttgtctaatgttttctcatgattaatttagggttatgggtttgggggaggaagatcacagatgtaaaatgccattccatcacatcatattaaggatacattctaccaatgtgacttaccatagttgatgttaaccttgctcgtctggctgaggtagtgttgtctggctgaggtagtgttgtctggcttcccactggaaagttactcttttttctcctttctccattttagttttaaaaatgaagtccccatgcttaaggagtaggagtcatgttccacctacttgaaggtagaggacctacatatattatttagtgttcttctgcatgggagatttgtctgttctcccacattaactattttatttattcaatcatttatttatattagtatggacaatgaacatttattttagacttggtttgtaatccaatactactttattttgttgctgaaaatattcctgcttcagtcattgggagctcttttaattgactcatgttcctttgacatgcccccgtcattgtggggttttttattttaatttttgagtactggtaagttcgactttattaaaattaaaaacttctgatctgggaaagactgtcaagaggatgaaaagttaaggcacagactgggtgaaaatatttgcaaaaacacacatctgataaaggacttataaccaaattacacaaagaaatctttaagattcaacaggggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaaaaaaaaccaagtatctgaacaaaaacctagccaaagtagatatacagatgacaaatatgaatattaaaagatgttcaacatcattcatcactaaagagttgcaaattaaaacaagataccactccacatctattagaatggctaaaatccaaaaaaaaaacctgacaatacaaattgctggtgaggatgcagggcagcaagaacttttattcattgctgtggaaatgcaaaatggtacagccactttggaagccagtttggtaatttcttacaaatttaaacatagccttaccaaccacatgatgcaacattgcatcctaggtatttactcagctgatttgaaaacttaagtctacatagaaacttgcacatgaatgtttaagcagctttagttatattcaccccaaactagaggcaactaagatatccttcaaaaatgaaacgattctgtatacttctgaaatggtgggtatatagcactatgcatttgccaaaactcctcgaacttcatagcacaaagagtgaatcttaatgcatgtagattaaaaagaaaatcatttaggaggttgaaggatcccaggattgactgtaaactgtgacaaaggaatctacctgtattacaagtgtatgaagcaacttcactgaaggtggtgggagaaaaggccactttggaacttgagtggagttgttggaaatgtgtggaatcttaagactaaaggcaaaagaaactgtacataagcactgtactctagttgatacagttctcacagggctatgggctaacaattatggtactgctctacatgtactctggaaggggacaagcaagtaaatggatggtggatggtgggacccagatttctcactgttggattgggaggttacacacaagcacaggatgatccatgtggcaatgaattagagttggggatataggtatgaacttatatctagcttaatatagatatagctagattctggtttaggatacatgtacattttcttgatttgtaaggtaagagggcctaaaagtaatgacatccagtagtaagacatgtgcccagacttgtttctaattaccatcgttcaataatagaaacaagggctattggaagaaatggctaattttagggttggggcagaaaatatacgagattagcctggaggatcttgtagtaccagaaagtaaggaagcttaacattctcttacttgatggttaccaaaaaagtattcattaaaactgacatgtttttttttcaaataaaatgcaacatttgcatgactttgaaacatttctttcttgcggtggctgctaaaatcttactttcaacctatccagatgattccaagttttgcagggatacatgtatatgtgtttatttttctctgccatttctaacttagaggcatctcaccggcaagaaattgagatgtactgttctagtctatgatatacagtccagccttctctgtctttataagggattgccagcatttaatcttacctgccataggtgaagttgattggggaaatggggtacactgttaacctctgtggaatataagaatagaattgaactagacacttattttacattcggatctttaatgacctgatattattatttttaattatatgacagaaattctggggtgccatagacactgttttgatggcctctgttactcattaacctttgcagacattcttacattctagataatcttccaagagtatcagaggaaaggaaaatgaatgacaaatcttactatgatcaatatatgatgattaacaccttcacagctcttgttgttgcttttcattttctgagggttattccttgtttgctttttagatgaggaaactctctactccttatgtctttcatttctctaaaattagagtgaaacttcttggtagaaaagtgtcttgatcatatccctactttattatcttcaagtgatttattctctgggccttaagaaaaaaacctcaaaaaggggaaaataagtttgctatgctccataacgatccagacaccttcatggagactgtggcagaggcaaactctatcccacccatctccccagcctctcagccttgtaatagtacctgccctgatctggcccctgcctcctaataagaaatgtagaatgagagttatgtgagctcagttagtataaaaagcactgcagcccttaaactaatcaatttctatatttactacagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaaggtaagaagaggtacagagtggtaatccattgcctcttttaatatttaacttttgcaaactctcctattttaaattatctttcaagcagcctgcaattctctgcatctgaaagtctctctttcacctttcatttcctttgtctggaaaaataacaaagtacattgtacaatgatcacataatacagtccttgagctttcatttgggagaacattgttgtaatggtgttataatatatgagaatgttttagtgaatctaatacttaaatcttttggaccaatggagatctttaggtcaataattctctctccctatgtacatatacatgtatatatttatattcatacatacacacatataaatatgtaaaaataagtatatatcatattaaatatatatttaacactatgtaaaatagtaatagcatgacatgttatatggatgcaggttaattgctgagacttaaaattactatggacttcattgaatgtgagtagcaaaccttcttgcattaattttgatatatctgattaatcggagaattgagacccactttcaataggaatttctagtctagattacatattcaaagtgtaaatttttaatggaaaatacaaattttctgtgtctctaccaatctataaaggcctttccaactgttacctcctttatgaaatctttgcttattgctttaattgaatatgccctatctcttctttaaatctcagagtgcttcctgtctttcttattttatgtcctgtttacattatgattacctttgtatttatagtgttaagcatcgagttccatagcacccagctcagtgttttatgcttaacatttcctaagtatatatattctagaaatatctgtagaatgcgtcagtggggtaggtagtgggaattgtaatgtgagaaaaactataatggttggagtgtccagagcctaataggtaagacaggtattaatgaaataatcatacaagtgaatgtctatttgcaaactgagagataagggcctgcaggaaaggaatataattttatgaaaggaatgaaaaaaaggaacctgacctggcattgagattcagagaagccaccttgaggaagtggtactgaactgaaatctgaaatgtgagtaggaattaaacttccccaaaagatgtaggggagggcaggaaaagcattggctcctaacaagagcagccagatcaaaagtctatggcacaggatagaaaatgaagaaagaccagggtggctttggtgtgggaaatcatggaaggcagagaggtgcgttgagacttggccctcagggccttgcaggcatgataggaattttaccctcaaatgtagaaatccgctggaggcttttaagtgggatgctgtgcagatggtgttaaaatgaacagatttgtgctttgagagtatcactccatcagtgggagaggatggttaataggcttgtgcagtattccatatgagaatgcctttttgaatatatcaaaaaattgctttttaaggttttagggagtatcatgtttctcttcaatgtcatctattcccatatctctctgtttaaatgactctcatgatgcaaaagtaattgtcatgtatcatatttatttgtgtaaattgtctgtcttctcttccttattccctttagtaggttataagttcctcaagagtattagtagatttttattaatttttaatttaaaaattaatttccttcttttcccctcagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatggtaagtttactatactttagtaagttgctctcatggattaatatgacactacagattattaattctattaatatagccagttaatgaaaacttcaaaaatatagaggatactaccatcctaatacatataatcctataacctttatcaaaacatttaattctcttcctcttctcttctcttctcttttcttttcttttcggcagggtctctctgtgttgcccaggctaaagtgcagtggaacaaacatggctcactgcagcctcaaccttctgggctcaagctatctttccacctcagcttcctgagtagctgagactatagacacacaccatcacacccagctaattaaaattttttttttttggtagagacaaggtctcactatgttgctcaggctggtcttgaactcctaagctcaagtgatcctcctgccttggcctcccaaagtgttgggattacaggcatgggccaccacacccagcctaattctgtttcctttgacattttctcattttaacattttatacaggggttatcatatcatatcatatcatatatcctatcctatcatatcatatcaattttctcctcatttctttctaccattatttttaatgatatagcattttattccaaagtccacttaaactgtttgagattctttatgttgcttccagctttatcttttcttaaatcattttttaacagcttctgatatcttctgccaaattgtttcctcaaactgtgtaccaacttataatgccactaacaatgagtgggaatgctagcctgaaggtctgaggagctaggactgggtgacctagaccagggtattctcccaaagttagaccagttattccaggaggtgagtcaagcacaaagtataagtgcacaagacagcatttctaagtctgagtaaggattgaggaaagttaactagggaagctaaggattgctatgatcttattatacaatatcattctaaggactcataccattattttattccagggacctagaatttagcatcagggtaaatttatttacaaattgttgaactgaatttagttcatcaccactgatgcgcaggtagtttctctctgtgcttttctttaaaccatgaggatataaaatttaggcttcacagagatctctcttcttctggatatattcttctagaagaatattcatatattattagcatttgtgaaaatcatgatggatccatctggagctttgctatagggttggtcattttccatggatcaaaatcccagatcttgcaaggggtctcgtggtctccaccaccattttgtttgcataggatttcacaagactttagtctcccagctaccttgaatggaatggggaaactaagtaagctgaattcctattaaaaaaaggagtattgcccactttgggggtaagggagaggtagtagaacatattgctctggaaaaggaaatgaaggaaagaaaaagctcatacaccctgcacttgaacaaattggctatcactggaacatgcctttgaaaaattgcaatcttctgtctctggctaagatttttagaaaaatatttggaaaactattgtcatgactagataattagaagtgcttaagtttgttttgaaactcccttgataatttaatccacaaataataagtaatttctatgtttggaaatatatgatagtcactttaattcttttttaaaatgtatgttccactcattactattaattttgtataaatgagccttttacgtatttttctcctcagatcattttatccccattgagaagtaccagttcagtctttacccaatatttatggaaggagtgggaaaaccaaagataattaatagtttcactcaaggtaaaaattataattttagtttccttttacaccaatgtgtgtgcctaatttgtttgcagtaatattgccatctgattattctttttctgatagaatcatggaagagtccaaagtcttctgtagatttttcatggtgaggttccaaaggaaatatttttttcctctaaaaataaaactggagctatagaaatagagtcactgggcctcttatatttctgattcatcttactgtacttggaataccaacattttgattttgttattactttttaaattgtcttcaaatctaagcaacctagcaatgatatttcaagagataaacatttcatttgttgttagaataaaaatcattaaaaaaattcatacatgtattatccaacagatattaattgagcattgttctaagcactgtggattgaatagtgaacataagtttctgcccttatggatcttaaataccagtgctctaattgagagtgatgggcaaaaaataattatataatgtcagatagaaataagtgccatgaaggaaaacaaaagcaagataaagggatggcattaaatgtggcactttagttgatagccagaaatggtctttctatggaggtggatgatattcgagtaaaaccttgcaagtacagtaagaccctacttgatatagtcaatagattcttggaaactgcaactttatgcaacatgaactacaggaggtccttgaataacatcattttgttcaaggtagtttcattataatgttgatgagaaaaaaaaggttttgttatacattgccatttcacttaacattgcagtttccaagagcctatcaatgatgttcagtgaagacataactgtacaaatagcaaaagcattccaggcaaagggacagtgtgtgaagagcccctaaagagtggggatgcttggtggttcaagaaacagcaaggaaatcagtgtgtgtggagtgaacaagatagagattggcaggtgtggaaggttgggtcctccaggagtagatactgagacagtcatcataacaagtttgacactttggcccattataatgtaaaaatgatcaggtagagaggaatggcaaataaataaatttgaaaaaatattttgctaatttacagtagatatgatgctgaacaaaataataagtattttattaatgtgatcacaacatatttttatcttcattttttatttttatatttttgaaggtaataagagatttgtgatgaattcagaaaatgtctactataatttttgatacagaaagaaattaatatttcctcaagtttctgagttgtgtaaattgtatttctttttcagatgatattgaaaaacaccagagtgatgcaggtttatatgtaattgtgccagtaattatttcctcttccatcttattgcttggaacattattaatatcacaccaaaggtattgtacttgaggttaagaatctttacggcaaaagtccttacgcgtattcaaaccctgatttaaaaccttctaaattaggaatattaaagtcttctaagtgcttttatatgtagtctgtatacaattaagatagcataaaaaggaaaggcctgttgtgaggaaatggcattccattttgctaggactgtaagagttaaagaatgaggaaagaaacacgaaacacagcttaacagttaaagacaggttttctttagataaaacctgaggggcttctggccaattttgttcaggagcccctttctcttacagactaagagtatgtattggttttagggtgagggggcttatcacaagcttggaatgtttatgtgtgagggagaagtttatggcggggttggaatgtctctgggaggaggggaggttatcttggggctgacatctttccagctggatggggagggttatcttggggctggcatgtgcctggtcagggaggatggaatgtttctggttggagatgttatttgtggtttatggtaatgctgaccttagccattaggctgatgccctttggatttaggtggtttttgattaaggggaattttaatatgaggtgcttgtccatgatggtgatgctcctgctctgtcaaggacaacataacttcaaggaagaatttagttttttaaaaaaaatgtacatacattcaggaaacaacaagcttataacaggaaatcctaagcagtatgttcttggaggtggcaaaaatggctttcagagttctgcagtttgggttaaggacgttttgtggtgaagtgggtggtaaaagtagccttttagtggtgacctggagcagtcagttcatttatgatcagcaggcactctgctttttagagatcagcactgtgtggctccagtctgcttggcttgtcaggcaaatgcctgagttccgtggatggtggcatgggtgccatgatactctctgtgctgagaagtccagtgtggttattttacacatgccaaatctctgtagaaaccatcgtcttcaggcaaaaaagagagagaggagattttagaatctgaatttatcttgtagttaagtgagttgatggggccacatcaaatggaattttttctggtacccactttgtgaccatttttaatatttcaatttctttgagagaaatctatccagtgtttagcatggtgcttggcacacagctttcaataagtattggctatttctattattacagtgattttcagcttgggtctagataaaagtttggtagaaatcttcatgggctagcatgtgaaaatgcatctgaccctacggaggcatagttgatctggtggactaatttctagcttgtctgttcactaactgttcacattttcaatatggatgtttttctctaattttgatgccctgtttatcctttgtagaatgaaaaagctattttgggaagatgttccgaaccccaagaattgttcctgggcacaaggacttaattttcagaaggttgctttttcaattttttttaacccagaatatatacgattgcaatctagacgccatatgacttatagagcattaagcatttttaagatttaaaaggtcatattttattcaattcatcttaatatatctgttattatatactttcaagaatagcaggatgcagggatttgaaatcaggaagaaacaaatttcagcgcatagtttatcgtatgagagttcacaatatacatatgttgcttctgtgtcacagtacataataaaataaatattagaaagttaagggtcaatctgatggagaacagatatttggatacactttttttggtataaactgtatttaggcaaaaggctggaatcaatatttttaatgtctataattatctccataattatttaaataaattagaaaattatataatcctcaaacattacaatctgaaaaatgcagtgatcataataaaacttatatttatgcagaagttccattcaagtacaagtactttatgagagttagtcaactataataaaataatttgtatttacttctatagtaggatttttcagaaagctctaaatttagtgactgttttattaattctcataatgtcccttgaagcaaagctagctttccactcataaaactggaaaaatagaattcagtcaagtcaaaatatacagatttttaaacaatacttatttggaggttattatccaggtttggtgattgcatctttatcattagtcacttgttaaaagttttcaatggtttccttttgaatacaagatataaactaaagccccctgaagctattaatagtactcaaggacctctttctacaatctgttatcaacctacctatacgactttttctatccctgggccttgatgatacctttactgttcccatccaccttcacagagccttccttgtacatgaagatcttgctctaggcccttctttcctcaagccttcctttaaccagtgtaattcaaaagaatttctaccccctttaagttcctagatcattgtactgtttttttaattgtggatagtgctctgaattcaaagactgtattttatccatcacaaatatttgtagtactcctcctgctgttctttatgtgcaaagcactgagatacatattcttacatttattaagatttttacttacattctcaatgtttcagtttcctcttctgtgaaataggctgcttaccttattaggttgtttgcgggactaaagaagatggtacttgtgacatagtaaggtctcaacaaatattaattattattgtacatatttatgtattttatattactattattattctttcagttaccctatgggacaagtgttattctctctattttgcaaaagagaaagctgaagctcatagtggttcggtaacttgttttagaggcaagattagcttaccagtttgtctggctttggagcctgttctaatagcagctgttctctatagcagtggcttctttttctttctttcttcttcgccatgacccacagtgaaaaaaacttaggttggtgcaaaagtaattgcagttttggcatttttaatgtataaatacgttttaccttccaacctagtacaccatagatacagatatgcaagaccgaaatgaaagatacgcaaagcagctttacttcttgcttgaaatagaatgttttaaaattctattttatttgttaaaaatgctggttgcaagacactaaattgatttcacaacattcgaatggcctatgatttgcagttagaaaaacactgttctacagcttatcaatgaataagtaaacaactaatattgtagacataatgaacaaagaaaaagattgaattgtaatttttcagcaggagaaagaatgccctgtcttcagaagcagcagtagtgttgttttatatacgaacaattctttttatagaaacttcgctttgcctgagtctaatcagccacactcctatatactcctcacctgtgctgttgctcactaagccagagtcttctttcattaaaacagtgttgccgagtttttcaagtaaatattttttctctcatttatcttttactaagaatttatacagtgacattttgtgtagttgtgatgatatttcagagagagatatatatatgtcgttcattcatttgttcaacaagcacatggtgagtatttatatgtaaggcttggctgttgctagggtctgggagaacagatttttcttaccatatgagaaataagacagtgaggtcagagaagagtggctgggttgaaagtagaataggaagagcttgtctccttttgcctctctaaaatagttcttttctattcatttcatccatatattcaatatgattgaatacttaccctataccagtcactatagtatgccctggcattataaggataagaaaaacactatgtgctcctgagtatacagtttaatggggatgataatcattaatacatttatcatggaaatagcattactttttttttgtacaaatttatggggcacatgagaaattttgttacatgtatataacatataatgatccaatcacaaccttatagttgtaaactacatgttgtgaaagaaggggttccattgtgctgagcgcttataatgtgggaacctggcttagtgtatccgtgggggtgagtggataaagttaagcaaattacatttgggccaagatctggtagatgaacaatcattaactaggttttgaggcagagatgtggtgtccagctaagtacctgcaaacactaagtcatgtggaaggcagtacctagcatattcacaaactggaaataggaagactataagactttttcttaaatatgagggttttatgtcaaaaaacctatatacttatctaagtaaaattgccaaattttcagtatataggtatatattaattcagggaatgatcatcttactttttaatgtcacttaaaaagaggctgaaacactctctcttcagcatttaagctctgaaatcttacctatggaccaccatgaagtggtttctcagtgttcaggagggccatgaaatgatcaggcccacatcagcaaaatgcagtttaaacctgcagcaaattatttttcccttttccagaaaatgcctggcacaaaggaactactgggtggaggttggttgacttaggaaatgcttgtagactacgtcctacctcgctgccgcacctgctctccctgaggtgtgcacaatgctgccacaggtcatctgacagaccttatatacaagtagattgaaatattgccacattttttcaagttctggtaaattaaagaaatgtgaagaatttttataatacagtgggtgtgaatgttcttatttgtaggactgattttttaaaaatctctggaaatatttgactttctaatcttataaattattttttaagcacagctaacccacaagatgcttagtttattactagggctgaccaggcgcataaataacactattaggaataaattaggttttggaatataatagaacatttaaagagtaaaggagaatataacttcaaagattttattaatgataaaaatcttctaaaattcattaacttttttctctttagcctgttgttttaatctcctaaacaattaaaatgtacccttttctttttgagacagggtctcgctctgtcacccaggctggagcgcagcggtgagatctcagctcactgcagcctcgacgtccttgggctcaactgatcctcccacctcatcccctttagtagctgggaccataggcgcgtgccaccacgcccggctaatttttgtagatatggggttttgtcatgttgcccaggctggtctcgaactcccaggctcaagtgatccacccacctcagcctcccaaaatgctggacttaacagatgtgagccaccacaccctgcctaaaatatgctttttaaaggaaaaataatatagtgtaactcactttatattactaaacaggaaaaggcaaatttaccatccaccctatgtttcatattcatgttatttaaattatttcatagggctaatagccttatattttctgatgataaaactgaggcccagagtggttcagtagcttgtcttgctcacccagcctgtccatgtaacatctgtggttcaaatccagatctatctgactcaaattgatacccgtgccatcagttccatattaacaatgtatttcttaatatgcttaatgccactaaattatacacttaaaaatagttcaaatggtaaatattgttacgtatattttaacatcataaaaatgggcaaatgatgtgaataggcatttctccaaagaagatacacaaatagccaagaagcacaaatgaaaatatcctcagtgtcattagataatagggaaacacaaataaaaaccacaagatgcccagtaggatggctataataagagacagatagtaagtgttggtgagaatagagagaaattagaattatcatatactgacagtgggaatggaatagcaactctttcggtaaatagtctgacaattcttcaaaaggttaaacatagaattattatatgatccagtaattccattcctaggtatgtactcaatagaaatgaaatagcaaatccacatgggaagttttataagaatactcatagcagtattattcataatagccaaaatgtgaaagtaacccaaatgatgaataaataagcaaacaaacaaaaaactcacactatattgcaaagaaagcagaccagaggagcctattgtttttaaaaataattcaaatacaaatatagtattttttaaaggaagtaataatttctatatcaagtgtttcctttaatttgttctccaaattcagatattttgaatattgattattatgaaagtactcttaacctgaaatttctagacatctaacatgattttcaaaatcttccctaaaattaatctattccacttttgaagctgtcattttccttccccttggtttatattaaatctaaatcctgaacctataattatgttaatcaaatgtgtttttaaaaatccaatattttgaatgtatttctaaaagaaaaatgaaaagaaaacatttatttaaaaccactatatgccagacattgctaacaataggataataccatatgtgattaaaaataattttgccaatataatttcctgccagatcttttttcttttgtatgttccacttccttttctcttttaaaattagtttttctggataatataaagatgaaaatataggacaatatgaaaacagctctatattaacacaatattttaaaactttctgcattttcttcatttttaaaataaataaaaactacaggtaaagtttgtcctgcttgttccactatttccggtccctcctcttcctggaggaacccatgatttcaagaatgctgtagcctgtgtttgtctagtttgtgcatttatactttcctactttcacatgtgtgtatccatgaccaatgaagagtaatcctttgaagtactgaaaatgttaatgtacctttcatattattccaaaaatatctctgaacattgtgttttgagctctctccaagttgatgtagttaatttagttcacacatttggactggtctgtagtattccattatacaaacatagcacaattcatttattcctctactggtggatgtttaaggtgtttgaacacttttttatatttattacaaaaagtgctgcaggaagtatggttgtatatgtctctttgttctctcatgtatatgatatttctcaatatttaaaattttttgaaaaaatatatgtgaatgacttaataatgaaatgttacagttaaatatttgagtttggaagaccacttcatgaaaaggacagtccccttttccacccctccgtacccttagtcttgctctccaaatgcctctttagttaactgtctgacttttggtttttctggtatgtcacctttttatttctaaaaaccatatgcttatgccactatgaaatgtagacggtatctattgatttctggctacaacgaggatttactcccacacattattccctccttgtgtttctacccatattgtcttgtcacttttttcaattccttaagtaatcatttctccaacctcagaaaaatctacttaaacttccatttcttgttcttttaaacagaagactatttcttggagctcccctgctatttttttttttaaataaaaacattagcactcttacgcttccctccatttctccctctactttccaatctctaaatctaagtttatgtttttccttaagtcagggttgatatgatgttctgtgttgtaatttgtctgtggtttatttttaaaaatagaaaaactaataaactgaatttgcattgttatgattatgtaaatattgtgacttactgaaccaagtatttaataatatgtgattacacttctcagtggttccgatgtcaaaggggaattttttaaaaaatatattagatatattccacctgttgatcaaaattgtgccgaattttagttagcttcatttttagtttttatcttttttcttttccttaagtttctaattgtcccttccttcctcttcctccctccattctttcatccattcatccctctctccctccctctctttctttcttttcatgctgtctttctttctccttccccttctcttccctcccctcccattatataatctatgctgttatgttacctattttatccactaccccatctttactggaggtgttgttctagtggactctccaggaactcctctatcctcctacttcaatcaggactaggctttctctaaaattactataagccatcactctaaactttcccttaactggtttctggttagtactgtttcctggattcctttccttcatctttcttaactacacccttaagtaacctcctaagaagtatgcgataagtctccatctctccatgcctgaactgccttttattctgccctcctcgattgttagtttggtggagtatcaattcttagaaatagcctttccaagagaacattgagataattcctgccttaacatatagtatccagtgttgcttctgagcagtcagatactattgtgatttttactcctcactgtttacttataatttcctttttaaacagatgcttgaaggcagcatgttcgttaagagtcatcaccactccctaatctcaagtacccagggacacaaacactgcggaaggccacagggtcctctgcataggaaaaccagagacctttgttcacttgtttatctgctgaccctccctccactattgtcctatgaccctgccaaatccccctctgtgagaaacacccaagaatgatcaataaaaaaaaaaaagaaagaaaaaaaaattctcctcatttttgttgttttgaattttcagtgatgaatctggagtggttctttttttatttaatgtggttattttttgaagagactttcaattccatgtctcctgtcaattctaagaaattatattatttctttgataatttcctctcctcttgtttctttgtttctctttctagaatctgtatgttggatgatggaccctctgcgtagatcttccacatctcttaccttttatctcatattttcggtttctttgttttgtgtgtgtgtgtgtgtgtgttatattctgagaccttgccataccctcttcttccagtgcttctgttggatttttatatactattatttttgtaaatttccaagtattctttctcagagtattctgttctggttttatgcatattttcttaaatgttgctagaaataccaattcgaggatttttgttcttttattttaaaaattcttttttcttctattccctgaattctgtgttccttctaggtcgtgtgttcctgttgtttatcttggcctctcttttattatctcagactttcctcctaatatctggtaatcctttgttttcctttcatgtttaggaatgaaacagtagacaggctgactgggagcccagtgtatataggcagggattgttgccctgggtgagtaggcagggttctggccagatgaggaaagatgtgctctcagctagcaatattccatggctgctgtcttcctccccagacagttccttagttgcttttgagaacaaaccctcagtctggttgtgaagggtagttcttacatggaggctcttccatgttcagcagaggagtagaagagccctattccatatacagaacttccattaggccccagtttccagccacagttctcttgtcttcatgtgtttttacgtgccatttcttcacgcactgtctccgctgtatacggcagggctaattttctttctcctgagctgcagctggatatattctggtcttcagctttctttgctcaccttctttgatctatactcttccaattgttttctatcttttagcaatgaatgaaaattacccacttctcattagccctctcagatcatcttctttgtggtgggtctgtatttgactcatttacatactgccattccaacagaatctctatagagacaagagagaaacctgttcagtcagccatcttgaatcagaataccatttctgtttataccttaaaaatcagaatcttaaacatatattgaatttttgttgtaagaaaatgtgttatgataactcattagccttgcttttcttccaattcaaattttagagtgtaaaagaactattacctttcttactttgttttgcacctttttaccttagcatttctgcctaatttgttaaatttcttctaaatccaaatcacctgggtttttcccttaaagatattttaagcctctttaattcattttcaatttgttccactcctttttattctttattttacaatatttttctcattctctgttttttgtttgtttttatccagccatgctcctgtgtctacatttatgccagctttcacaagagtttactccatttaacaacttcctttagcggggctaaagctagaaacaaatagatttttccttgggatctaaaaactatcttagattccccagtcagccctaggcctccaaataaagcagctcaataacccgtggcctcccagaacaccatcctcacagatctgaatcagaagcatccctaaagttgctagatggccttccaaatgtgtggaagagctggtgcattttcgagttagaagttctgtttagaagtagccatctcccctatgcccagaaatgcacattactgggcctagaagtgtgtatttcactcccctaaaaatgtaacctcagttttgtttattttcttgttccttatagccctcaggttatgaggaaccaggagagagtataaattaatcagctgaactttgtcacagcgagtagtaaaagggaaacaaagaacatgttcttctgcctatttgtgtttgggacaacctttcatcttctgttgtgttatagaaagattgttggactagaaaaaaagaactaagtcagggtcctccctctactctaattagccatgtaacctttagcaaataatcttggcagcctcaattgctttgtcagaaaaaagggagacacttggaccatataatttctgagatcttatttctagattttaaaaacccatggtaatgaatggttctgtgattctattctttaccatttttagcacttctttctctttattttttttaaatttttcttttcactgctctcctcttttattttttcttgttccaaactatcctatattgctgttggttctccctctttaaatttttccagctcgttgttcttctctccttttacctattctgttatttccctatagtttttcccttcctggggtaattaaagctgtccttagagtgtgatattaaaacattcattaagaaaatgggagaagccaccttagttcaaaattttgccctttcccaaaaggatgcattattgtaacctaacacaaaaatttatagtccagaacccatgcttgacaatgttttttgaaatcttttatctttttctttgtgagtgattttttattttgctttcttattttgttttattttatctaaacagagaacggacattctttgaagtctaatcatgatcactacagatgaacccaatgtgccaacttcccaacagtctatagagtattagaagatttttacattttgaagaaggggagcaaatctaaaaaaaattcagttgaacttctgagagttaacatatggtggattatgttgatttagaacttaaaatagatgtgtaaatttgggttcaaaatgtagatttgagtccagtttggatgtgtgattaattttcaaatcatctaaagtttaaaagtagtattcatgatttctggcttttgatttgtcatattcctggtcataaaacattaagaaaattatggctgttgctgtcattacatatctattaaatgtcatcaaatatgtagtagacaatgctgtaattaggtgaactctaaaactgcaacatctgacaaatagctttaaaaatacaatgattataagtatggaatcagtgaaaatatttagtttgtatttttatgtccaaacttttccattttagattcctttatagacacgtcagcctaaaaatcagcctattcgggtgttcttttgaatatctcctggcatttttgtatctaactttgttcaatctgggaatttcagttttcaatatccttgaaaatggcttaagtgataacttccgtttcagttaaaaggaagcccgaagttgtgtttgtgctgcccacaggacagtgggagttacagttcatatcaggatgaccctacatacccaggtcagattgacgggaccagaagggaacatcgacttctaatccagctttcttgtttaattatgacctaaatctaatttacttccactgaaccatccaagacctctggcaggcagggaaatgggcagtgatgcaaaaaagggagactctttggagcttttatgaatagttcatggtgaggacagaacttttctactttcagacagactgcttgctagttttatgaattcagcacacgaattatgctgcgttgctcacattcaaaccaaaccaacgactatgtttaatgaactcagtattcaaatttattatatatgcgtatatatgtatatatggatcccttatatttagatttaactcgtagttttatttgaaagtagaaaagaactctacaaaaacgggaagaatgtgtctttcttcccttcttgacttctaataggtgtcattgaaatgtaaaatctaagtatgaaattatgaaaggacattctttaattactgcccactcaacacatatttaatatgtgcccagattattctaaaatcttaaaaaaagatgcatatagtgaaattttttaaatggatatacttttaataaagttttataactcactgacaaaacatatttcaatagtatatgagtatgagatttcttatcaattatgagtgaaatattctatctgaatgcattggaaggcatttacagtatttgctttcaacagttactgagtatgacattttagcatgaaatatatcaaacacatcatttgaaggacatatgtaatcttgactatggttatggtttttttgtatgtattccttgttttcatattgatagcatctaattcttttgacaatcttaatatgtaggttcatttaaattttaagacagttcagtgcatatatagtagaagccttaagaaaaaagaaaatgagcaagcaaatatttgaagaaatgtataaaaccatagatttctttcagaaaaaaaaaacaggcataggaacagttttctcttcatatattatgattatgaataataggaaagttgtattaattcagtatttgtcattatgcagtattttaatacctacataagtctattccattattatattttgcgcttggcatatttattcctttatgcttttaatcactaacatattttacttaagagtataaaactatgctaaataaattgtattgtatatggaatatgcttgccattatgaagaacagctgggtataccattatttcaagtaataaatctgaattctattagtttaaaaattgtaaaattcaagttaaatgacgtgtatgatatataagctgaacacattttctatagcccttaatttagttgtgttaatttttcaaggtgatgtatcaacagctttttttattttgcatttgttttttcaatgtgtttacattgtatgaattgagctttttgcccacagattcttgatttgtagttgtttggcaggatttttctttgtgatataatcacttctataaaaaatatgatgtaca

SEQ ID NO: 92 - DNA, 216842 bp, Homo sapiens
ccggtctggcttgggcaggctgcccgggccgtggcaggaagccggaagcagccgcggccccagttcgggagacatggcgggcgttaaaggtacatcgcggtccccggctcgcttgtcgtgtggtggggttgccacctccgttccggtcaagcctggggctgcgccttccgcgcgccgttggggaacggcctcaccacccttcccgcctctccggttcgggaggcgatcgaccgctcccttcgtcccttggggtgtgggtggagcggcgtttcgggggagccttggccctttttgcaaggccgctggccttcctgctctccagtggcggcaccagacccctccccagcctgagccctcggcgagagcggcgccctccacctctcctgagtttttaaacaaggtttccacttcttgacgccaccctaacgcctttcttctggttttctgcccctccgcagtttcctatttgccacaaaggaccctttgtctccagcgttcttagcattgggaaacttaatcctctttttcctaatgatttttccaactgggcagagttgaccgcgggcgggtgtcaatggaaagcacccagaaagacggtgtttctcgcagtcgtggagagtagattacgtgtaattttaatactgctttcttcggtgttttctctgtttatggacagagaagaaaccagtgtgtgtgtagtatgtgttttttgcatggggcagttggtaaaaacaccgcgtcccttatctgtatggcttcagagcaatgcgagacggaaaaggttttttgcaaggcttcctgtattttggtaggaaaacattccatttctaatctgtcgaatagagtagcatgacttgtttttatattggcttttatatcatccttgaaatttgcacccaaagatatccccagttaacatctgctataaacatgtagatagtatatatacgagtacgcctctgttcactatgaatttatccgagtatgtgagctgttagcagcagacattttatcgttatttctggctgacttttatacttaatatcagtttagtaaacatggtttacttggagagtgtcgactgtgttatatatccatttgaagccaatgccgaaaacagatgaaaagtagtgtctcagtactacacatgatcagaaactaccaaatcatgatcacgtttatgtgtgaatgtgttagaaaattgtgatgtagtgaaaaaaaaggaagtctgaaatggaaacggactaagggaaggaagcattttacagattgttcaacttttattgaggaactactgtatgccagagacttaggatacaaagataaatgagaagttattggtgggtgacagagctggaaataattatattactatgtcagtgtttatgttgggctcagatgcggtgggagaacagatggtgggttggattttgtcctccaaaaagatgtgttcaagctctaattccctggtacctgtgaatgtgatcttatttggaagtagtatctttgcagatataatcaaattaaaatgataactggtttaaggtgggccctaatccaatgactggtgtccttataagaagaggggaatttagacatagagacatacagggagaataccatgggaagacggagacagaaattggagtgatgcagctacaaagtcaggagcaccaaagattgttggcaaccatgctggcaaccactgagtgttaggaagaggcaaggaagggtgcttccctacagccttcagagggagtgtggtggcgctgctgacaccttgatttcagaagtccagcctccagaactgtcagaagataaatttctgttgttctcagccatccagtttgtggtactttgtaacggcagccctaggaagctgatgcaggtgggattgattcccctgctccagagaaaggactgttttcacagaagaggcgatgcttgaactgaatctgaagggatcaatgtggcttcccttggcaaggcatggagtgaaggtggagtatatcccaagtggggaggacagcacgtgacatggcgcagggcttatgaaacaacatgccttcttctcttcaggtacttaagctacattagtaagaccagaacttagtggtgagggttgaagctggctggacaggcagttaggagtgagtcaggcgatggtgagcctccgtgccagaacaacttgtaggctgtggaagcaaccgcaaagggatggcagcggtgatatatatagttgaaagatcactgtctgctgtgtagaggatggattggaagagtcacagaggcaggaataagaggttaagggcctgcaccagggctgtagcagagagtttaagaagtctgggagattgagtcaccttgacctactgattcattggaaggtggaatgcaatcatggtgtcagtcctctaagataggacctttaaagtgtagggatagtggtttggttttacacgtgttacacatgttgaatttgaggttcttgttggcggtcaaggcagagaagtccagactggaggtggaagtacaggcctagttctttaggacctactctgggctggagcatcagttgcggccgggcccttgtggtagtaggagctttgggttgaacataagttttcagcaggagtgcgtggagtgaaaagagagatggggttggatttttggtcaactccaactttaagagattcagaggatgtgattcctgaaaaaagaggaaaaaaaagaccaaaaagaatcaaacagaaagatggttgtgaacgttgagaaactggtatcagaacagaaggaagaggtctgcagtacctagctttgacaggcctcatggaggagggggtactgccgatggtcaggcacagaggagaggagcaaagcctgctgggaaaagatcatctgaatgaaatagtatgtggtatttgctttccatccacacatgggcattttccattaaagagtggaaatgtaaaaagatatgttaaaattgacagtgtttctttgtcccttaacatgtgtatactttcagatgttttttaaaaagcactttggcaccttcctattaaagagtctctctaaatcttctctcaagtaaaaggaagcaatcaaaaatgttcattggcttaattaattagtttaatactaattatgagtattatggacttttttcagaagaaaatttggataagatagtctcctatgcttttgatttctacctttatcaaagaacattgctaaaatgagtagatacctgagtcagtcagcatttatttggctacctccttttgccaagcactttacatagattatctcatttaattcccataagctcaataaggtggcaccattatttccattttacaggtgagaaatcaggttcagaggattagcttctacccaaagtcataagaccagatggtggcagagttaagatttgactcatgtttgtgactcagagctcaagattttgtaacaaccttgatactctgtttctcactcagcagcacaacaagggcaaatacgttcctactcccgcagagactagtgtccaatagatacagggaatacatattttattcagtgcacactagttgggaattgtttcctacaaagacatgaaaacaatcttcaaatacttgcagtactgtggtttggggaggcaaaatgatcaaaggtatatattacagggaggcagttctggatataatttaaagaaggagggctttcaacatttagaagctgttggaattaaatgacttgccttgggaggtagtgagttttccttcactggagttatgtggaccaactggctgccctctggtgacaaatacagagggaattcatccattggataggggttaggtactggaattacttgagacctttgtatactttatgatttcaaggtggcagacatgggtcattgtcttaatcagtttgggctactataagaaatatattttagactgggtggcttaaacaacaaacatttagtttccacagttctgaagactgggaagtccaaaattgtggtgcagtcagatctggtgtctggtgagagccagcttcctggtttgcaggcctgctttctgctctcacattggagaacagagggagagaaacacagagagagtgtgtgctctactttctctcttcttataagggcactcatcccatcgtggagaccccaccctcatgacctcatctgaacctaattatctcccaaaggtccacctcctgatagcatctcacggtgagagggatggagccgggaaggtttcaacatgtgaatttgaaagggacacacataatgcagtctgtaacgggtcaaatgtaacctcaataaaatgagtaaattgctacatttgcttgaatttgggacctttttttctttcttttttattttagtaaatgtttttattgataaatgattcacataccataaaattaacattcttaaagtgtaagatttcatggtttttagtatattcagaaggttatgcagccatcactactatctaattccagaaaatttactcatccgccaaagaaactctggacctattagaagtcactccccatttccccaaaccctctagtgcctgacaacctctactgtgggaactttaacttttggctttatttttcacagctctcgtggcattatccttcagtggggctattggactgacttttcttatgctgggatgtgccttagaggattatgggtaagttatcatttcaaaaagaactattcctctttctgtgtctttgtcactattagtatgggtgttagagagttcggtcaatttagcaccaagttctaaccagtgagttagtggagcccagtttatgaacacagtccctttgtgggtcaggtgtacttttgcagagggctctgttaaaaattgatgtattcattccataagcatttgtttaacacctactctggactagctggggacacacaaatgaagagagagtcctgtcctcaaagaggaggtaaagttctagttgtgagtgagagacaggcaaacggtctagtcagtaatctggcagctgcagtggagatgccagcacagtacgctggagctcggataaagtgcacctgagtttcagtgggacagtcagggaaggctgcatggcagaggttgtatctgagccaagactaggtggatgaataagagtttttcagggtgatgagtcaggggaggacattccaggcagagggaacattctacacattttttcattcaaccattgttggttgaatgcttcccatgtgccagctactgttatgggaactagggattaagacataagaaaacaaaggtcctgctctctcagagtttgtgtttcagtgggggagacggacagtaaacaacaaaagtatgcatactgtcagaggtagaaatggtacaaaagatgaagagcacagaagctgggaagacagtggtcagggagggcctctcagaggaggtaaaaagtgagaagaaatgtcaagaaaatcagcaagcaggccatacagatctctagggaaaaagcactttaggcaccaggaaagctgaatgctaaggcccggagacatgaaagtgtatatagccttttcaggaaaccacacatggtacattatggtacagcataaattgtagtggagtggcaaaagaagggttagtcaagagtgtaaaagtcagcacttagggctctatatgcctgccgtgtagaggaggttccattttatacatcagacaatagaacctgggaaaatatcttgagaatgggtttggaggagggggttatgttaaaatgtcattcttgccataacgtgagactagataggaaagagctgagactgcagtcagggagaatagtaggggactactatcataaatcaagcaaaattgagggctggggcagtaggaatggaaagaaaaggagagtgagttaggaaaccaaaccaaccaacaggttttgttcatcgatgtcaggattcaacaaggagggagagttcttagatgtctcccaggtgattggcttgaacaactagatagaagatgatgtgattaggccaggcaccatggctcacgcctgtaatcccagcactttgggaggctgaggcgggcagatcacgaggtcaagagatcgagaccatcctaggcaacatggtgaaaccccatctctactaaaaatacaaaaaattagctgggcgtggtggcacacgcctgtattcccagctacttaggaggctgaggcaggagaattgcttgaacacaggaggtggaggttgtagtgagccaagatcgtgccactgcactctagcctggcgacagagcaagactttgtctccaaaaaaaaaaaaaagatgatgatgatgtggttaagacctattgaagtgagttattatgacagtgatgaattcaaatccatcaccgcagtcctggccaactattacagaaattgtttaaacccaagagggatccagatataagcggtcacttatatttgtttagagccttcacagcaattactttattctagcttttggaatgtaatacggtattattatcctcatttctcgctgggaaaccaaagcccagggtagttaaagacttacccagattgaacagcagtaagtgacagagcccggccgtggtggctcatgcctataatcccagcactttgggaggcaacggtaggaggattgcttgaagccaggagtttgagaccagtctgggcaacaaagtgagaccccattctacaaaaaactaaaataagccaggcatggtgcctgtagcagggttgggaggctgaggtgggaagattggttgagcccaggggttggaggctgcagtgagctgtgatcacaccactgcagtccagcctgggcgacagagtgagactttgtctcttaaataaaaaagtagaaaaaaaattaaaatggcagacatggaaatggagctcatgttctgacgcccttgaccaaacgtttttccactattccacaaccaactgtaaatctaggagttttaattctctgtgatacactgtctttgtaaggtaagaaaatgactcattactgctactacaaataagtttgttttctatctttattttaattttttgttttttagagatgccacaacacccagctgattttttttagaagtttttgtagagaccgagtctctctgtgttgctcaggctggtcttgaactcctggcctcaagtcatcctcctgccttggcctcccaaagctgtatcttgatagtgaaccaggattatcatctatattggaagtcagcaaactgccacatataacctgctacctgtttttgtaataaaggttttattgaaatacagccatgctcatttgtttatgaattatctttggctgcttttgcattgctctgccaattatctttggcagagttgagtagttgagatagtctttatggcttgcagatcctcgttatttactctttggccctttatagaaaaagttggcccacccctggcctatgtatttattgaattgtatatatttaatatttacattttatatataaacaaggtttcttgtacattaatatttctcttagttggatatcggtggcttactatgaatgaaaacatagagtcagattgtttttcacaaaactgtcactgtattccaggaaaaattaagagttcttggctgtggatatgtaaggtgacatatctattccaaaccccttcccctctctgtgtctcctttctcactgttgaaagaagggctttgaagtagagaatgtctaagggctacttcccacaatattgtttggtgattcttgaaacatactatcatccctctagtttaaaatcaggggtccaaatccactgtttccatcctgagtcctcttgaaggacacattcccttcttgccttttggttgcctagatctgtggctggaatgggaggctttcattagtgtggcttcatcccaactcctgcttgtaggtgctgtctgggcgtatctgtgtgattacagtattgtggtgatatgaattattgtagtgtatatataaaaatgagcagagactttttttttcttaagaaatgaagcataagaaatgtctgatggagaaaaaaagattatttttgaagtactgatagagaaaatactgttggaaaccagatggcaattttttttttataattgcaaaatgttgaaatttgggaggaaaacagttttgttttgtttttgcattacactattaattgtgagctcttataatgaagatcaaagtacatctaagcttttcactagtgagcatatttattttcatgccttccgtacttaaaatttatttattattttattcatttaacaagtataaatggagtacatcattctaggccctggagataaatggcgtttgatcaagactaatctatcagatgggaataagtgttgtgcagaaagttcaaagagggtggtatgttcgagggtgacctggggtacattagaatagatgaccagggaaagttctgcttttagaaaggaatctgtcagtttagatcacatggtatgaaggagtcagccaatgagaagatcatggggaaggacattgcaagcagggggcacagctagcgcaaaggccccaggataacagctatgagctcaagagtgttcaagggacagaaaaaaggctggtgtggctacagattaagcaaatgaagggaaaagagtacaaaatgaatggaagaagtagataataccagaccataaaggctttgtaggctagggcaaggaatttagggtttattctaagctcttaaaaggtttcaagcatgcgtgcactcaaaagatctttaccgaactagcttttgcaagacactctactatgttctatagggaaggcagaaatgaccaagttaaaattctgtctttaaagaaattgtggctcagtggtacagaaaacagtaaagtttctagggtatatattatatagtggcttcttaacacaatataagctacctacatagtaattttaaaattatcactacttatctatccctggtagaaatcatcttatgttctaatattcacaattaattaattttttgacctaaacatttaaaatagcaatgattttgaaatagtagtatgtctttcatttaaaatgtaactgttacttttctttttggattttgcctgggtccaactgacagcgtttactggcccttattcgtcctgattttccacgccatctcccccatcccccatttcattgccaaaagagtcacctatgactcagatgcaaccagtagtgcctgtcgggaactggcatatttcttcactactggaattgttgtttctgcctttggatttcctgttattcttgctcgtgtggctgtggtaagttttattttctattgttttgcccaaccgttgctgagtttacttcagaggcctgtgtctgggacctccatttcatgctcattacttaggctttatactcaaggccgtgtgtttttagtttctctgttcctctactttagacctgcctaacagtagttcggccatgccttcagagtgctttctttatttctcttacaacttttagccagacgatatgatttcttactttttctactttaagctattctctggaattgttcttaaattcctgcctcttaaatcttacagtaatccacagatactatgctagcagtacttttctagttgcaagatgaagatatttcaaattcttctcctgcaaatgggatcatggactcaactctcaactcagtataataggtatatgttgagggacaactgtgtagcttccagaaaatgcagtgaataagttgacatcttcacttccaagacaaaaactttctttttgtcttcagagtacacattgtaggtataatttattcaattatttgctattcactgtctttcctactatttgattttattccctccaattacgttctattttaattttatgaaactcttatttgaggcattgaatatcagataagcgcaagtcttgttcattcaataaatatctttgcaacaactgctacttgtaaaacaccagaaataagaaataggtactgtctctgctcctgaggaacacagaaactagcttgctgggtaagtatactataagtgtactaagtgagacggttgaagcatgatcagaatgccataggggcaccaagaagagagaaattccgactggcatttgatatgggcctctaaggataaatagcatttgtattgaggtaggatggctgttgtatggaatgacattcaagtgtaagaatgcagtatatagaataaagaagaatccagtgtggtagagctaaaagaaagttgttgaggttaaggctggaagggttgtgaaacctgattagcaatggtcttgaaccccatgccagtttgatctttgtctagataatggggaaagattgaaggtttttgaatacaacaagattgtcatgactttatttttcttgtgctttagaccagcccttcttaagcgctgcagtaaatatttatattttttcctttcaatactgccatcatattttgtgaagaaactttcattgatgtttctcttgcttaaagtaaaacaaaaaatgcccactagagggtactctcacccccaaatgtgcttctgtaaaaccatctacaaaccatctactaagctggaaagcagttttcagttgtatgaagactattatttaaagtcttttcttgcctagaaaagaaacacacaaatttataactctacaatttttattttccatgaaagaagttgatgtgtgcagaactttcagtacccaatattgtaattgcactatttataatcttaccacttgagttttacttaaggcaatcattgtcaattaaaaacaagtagagaaatatgtctaattgggaacatgttaaggatgataccagacttaattaacaagcatcacagaagtaattagactcattactgaacagttcattgtctcctgttacattattaagccttttagcagctttgtgtaacatttcattggatgtttctaatgcagaaaataatagggattgcaaagagtacaatatgaaggaagtaaggatttaatccttcttttcttgtctttcagatcaaatggggagcctgcggccttgtgttggcaggcaatgcagtcattttccttacaattcaagggtttttccttatatttggaagaggagatgattttagctgggagcagtggtagcactttattctgattacagtgcattgaatttcttagaactcatactatctgtatacatgtgcacatgcggcattttactatgaaatttaatatgctgggttttttaatacctttatatatcatgttcactttaagaaagacttcataagtaggagatgagttttattctcagcaaatagacctgtcaaatttagattatgttactcaaattatgttacttgtttggctgttcatgtagtcacggtgctctcagaaaatatattaacgcagtcttgtaggcagctgccaccttatgcagtgcatcgaaaccttttgcttggggatgtgcttggagaggcagataacgctgaagcaggcctctcatgacccaggaaggccggggtggatccctctttgtgttgtagtccatgctattaaaagtgtggcccacagaccaagagcctcaacatttcctagagccttattagaaatgcagaatctgaagccccactctggacccaggacattttgatgagatccaaaggagttgtatgcacatgaaagtttgagaagcatcatcatagagaagtaaacatcacacccaacttccttatctttccagtggctaaaccacttaacctctctgggtgttacctgctcatttgtttaaaaaaaaaaaaaaagtctcacctgctttcatgctgaggacaagttcagatgttcaagcctataatatttaggcagttcctcaaatttatgaaaagtgttctcagaattgggagacagtcaaagggtacaaagcctcagttaggaggaataagtgtgatttttttttaaagatcacttgcacagcatgctaaatataggaataattgaatgtatatttcaatattgctaagagagtaaatttctaatgttctcataaaaaagttaaatatttgagatcatatgttaattagtgtaatcattccaccttatattcaaaaatcataaaaccgtattgtaccctataaaaatatacaataatttgtcaatatataatcaaaataaaaaacaaaacatactctctcccccaaaaaaacatctcagtggggaacagatgtatcttttcatctgaaagacaatgctgggggaagagctccactgagatgcgggcagggaggctgggctcgagccagcccctgcgttagcaggagggggagaacagataggtaactcttttacatttcctttatgatctggcacttctccccagctccttccctctgccccccacccctactcctcaacagttctggtttgccctgacttctctacggctctggcttcttcccgaagagatataggagccatgtaagcacgcagtgggtgaactgcttaatttcactacgtgttgatgtacttgtcttccgtcctgtaggtcttttctatataactttatgccacccttaaatgaatcattgggtatacctgtcatgttggatcctgtaatcacagttttccctgctcacctttttgtctaagatctattgagaaagggaaatatgggaaggagaaccatttgatcagaatacaaccaatagtctttaagcattgttaaagtatgaaactgaaatacattcaaaacacttaatccttgaggcttgtgatctgagtaattagcaggtatgatgctgggactggaaaatagaaagtaataactaaagggttaatgtgcaacgttattttttggccttgttcatgattttatgttttcagtgtcctgtgtacatatagaattgttaaagttgtcatttccaatatttatattagaaaaattatttagatactttataattttaaccggcatttttaataatgacacttgcatttattgtattgtaataaatttcacttttaactttaaaagtttaactttaaaatttttttgtgatgttgccttgcctgaaaagataacaaaaatgagagaatttcttgatgttttaaaatgggcagttttgagcaataatctgtcctaacagaacagtagcaataagttttaggataccatcttgaatgtctagttggtgtgcaatagcttttctttctaagatggcaataatgattcatttctactacattttgcaaaagtgtttttgttgcttatacacattttcaataaccaaggtagccttcatatgtagccttaaagcattacctcttgattgtatctttagattgatataaagtacttgcatatagagtatttgaagtgatagattattagatttgctctatgtctgaaaagagagctattctgcagtgcctaaatatcatttaaacagtaaatattaataggaaatattgctatatctgaatatataatacaaaagtttgatcatggtgacacaaatgttggacatttttttccttataaaaggctctttttttatatattgtacaatatatttggagattcagagcatagtgactatagtcgaaaactgagattgcacttccaaaattggccacaagtaaataatcttatgaagggattctttatcatgtttcaaacaagtgggttacaagcagactttgagacacttttccacagaaacaatactatgaattggtgattgagttcccaggccaagcctccctcaacaggttcaactctaatatacctaacctgtgatactgaaggtgcctgcctgagttttgggtctctgagacagggtagtgtgagtagtttggaggaaggacagtgcaactttccaccccttttcctaagaacaaggtctttctccttttaatttttccactcattttcacctcctaatgcccttgagatccaggtacactcctgggagttttgttcacctctcccaactgagaaccttcccactgggctccatcctccctcctgaggttcttcatattccagagtcacccacccttctcctcccattagtcagttctctaagtacagctgatgtcatgtggtgctgagaagaaagcagatcacacttcatcacagaaagaatgccttgtgattatcttctccacatctgaaattccttttgacacctgcattgggccgactgccattcccatgactgctgcacctgcgtttttagagaatgcctcataacccactgattctcattcacagagaatgggagaacggaatgaagaaagattccagcagcttatagaaggatagcaatattttgggacagggaaaatcctgtcatacctcatctcttcctcaggaggagttctgagctggtcctgcttttcatagttgtttcttttcttccacttaagaactcatagatttttcttactgtcctaaggaagtccttacctctgaggtatctcctcaatgaatactgttttcaaggctgaaatagttcattatgttaataaccttctttatgttctcagggaaatgcttaggtggtgtcacaaaatgtgccttttcttttctttttttttttttttttttgaggcagagtctcgctctgttgcccaggctggagtgcagtggtgcgatcttggctcactgcaagctccgcctcccgggttcacgccattctcctgcctcagcctcccaaggagctgggactacaggctcccgccaccacgcctggctaatttttttgtatttttagtaaagacgggtttcatcgtgttagccaggatggtctcgatctcctgacctcatgatccgcccgcctctgcctcccaaagtgctgggattacaggcctgagccactgtgcccagccaaaatgtgcctttgcaaagtttgcgaaatcagattttgtatcccaatagaaccaaaatatttatgaggatgctagcattttccaagcatagtaattagttcacaactgagaaatattatgtctgtagtagataaatattagttgtgcattttaatttaattctcctttttccattttgtctcatgaagtaccttattgcaaaaatcccactgagtaatagctcataaattataatctttcaaatagccatgctaccagcgtacaacagtgatacatgtaaccccaaatgtgatgtgagaggacgattactttgtaaataaaacttgttattgacattttaacaaaggcttttatgtacattattaaatgaaaaagtttatattttactttgcggtacgttacatttggaaaggagatcagcaagttaattttcccagtgtttttgtctgtataatcttaatgtgaatctgaccagtttgaagcctgtacttgctgtagttgaagagaaacagttcaggaatgttgtgctgactggaaggaatccaggccttaatttctgtggctgacactccccatggtggacatggaagattggaaaagctgtattggaaaagaaaaaaacctgacaccttaagaaaagtgctctacatattttgaagagtctttttgcacactacagaaaagaatgcactaatagaaagtagtctttaaggaataatatgtcctccttatgcacaaaacatttgggaaagatctgatgttttactagtggatttaggcagccagattgtaaagaaatcaagctagttatttctttgcattgccaagctaagtgtaaagttaaacttttaatagaaatagaaataaaaatttgataataccaacataactataaaatggccataagaaaagtcagttcccaaggaaaattaatagatgaccattttgaaacatttatttgtggtcaatacgaggcacataggcaaagtggtcttaatcctgagattgctcatttggagaagagcacacttggagactgcacaatctctcttcacttttgattatatctttatcaaaattgaataattctaagtgtttacacacttcggaatgaatgactagatattaacttaagtgtgtgcattcatttttcccctcagaataattaaataataaaaccatcagttcaactttagctggataatcattgcacttatcaatttaaagcataaatgcctctgcctcaacactttcatttcctctgtggttgagagacaaattatatcaccacactctgtaaagtttcatgatttcttacagccttctcctcaaaattgtatgcttgttcatctgacaaacccagaattctccagtacttccaaccatccctgctgcagccttgccatttgtggttccttgacagtgctgctgttaaaatccacttaaccactgatggaaatgagttacgtgagttctgaacacaggttttaatcggattcctgattaaattaatggcagtgagtcttaggcttgatttattcaagattccatggtgtggaactgacagttgctcagctctttaataaaatcatgtatatatgtatatattttgagatggtatctcagtatgttgcccaggctccctgggctcaagctatcctcctgcctcaacctcgtaagtagctagtacttctgctggaaacatgcaaatgtccattaactgatgaatggataatgtgatatatccattcaatggaatgtttttcagacataaaaaggaatgaagtactgaaacattgctacagtgtggatgaatcttgaagacaatatgtgaagtgaaaagagccagtcacaaaaggccataaaaggtcacaaaaggctgaggcaggagaatcctgaacccgaaaggcggaggttgcagtgagccgagatcgcgccactgcactctagcctaggcgacagagggagaccccgtctccaaaaaaagtttatatttcagtgtaagtagaaaaaaactaggtaaataaagtatatgatacggtaggcgctactggaaaaaatatagtggggaaggaggataagtagtatttgggtcattgtggttttagatagggtggccatgaaagcctcacccaaaagaggcaaagaaaagagccatgtggattttagggtctccttctgttgcccaggctagagtgcagtggcaagatatggctcactgcaaaccttaacctgagcgcaagggttcctcccacttctacctcctgagtagctgggattacaggcacgggccaccgcagctggctaagttatttattttttgtagagatgaagtttccctacattgaccaggctgctctccaaccctggcctcaagcaatcttcttgcctgtctcagcctcccaaaatgctgggattactggtatgggccatggctcctagccgcctttttttttttttttttttttcaaaaaatattccaactgaggtttggcatttattgcttgagaaataaataatataaataaaatagcttgatttaggaaatgaagttgtgctagctggaacactggccaggttatggccacgataaagaagagaccagccgggcacggtggctcacgcctgtaatcccagcactttgggaggccgaggtgggcagattacgaggtcaagagatcaagaccatcctgaccaacatggtgaaaccccgtctctactaaaaatacaacagttagcagggcgtggtggctcacgcgtgtagtcccagctactcaggaggatgaggcaggagaactgcttgaacctggtaggcggaggttgcagtgagccaagattgcaccactgcactccaacctggcgacagagcgagactctgtctcaaaaaaaaaaaaaaaaaaaaaaaagacagttgagctagagagtaaataaagtggcccctaatacagtgggtatagattcatgaagtggcagtagctgaactgtagctactgttaactttgaggactaattaagacaatgtcaggaaaattttctttttcttttttctttttttctactctgtgtttcttcattatctgaatttatcctcatgcaggttggaaactgctgaaagcagtccatttttatgagctcttttattctaagccaaatcagtcagattacaaaccccattgtattttagataacccaagtgattattcaggtgctcaaaagcttttagagaactgctaaacctcatgtacttctgggcagtatcagcaattaaaagagtttaattttctaggtgaaactgattctggtttggatttctttatttggactgagagatattttaaccaggttaaaatattggtgcaaagccatctctgatgagacttaaaatcataaagctacttccccatgcagttcttgtcaccatttcagggtactgctgggcaataggacatgagttcccattgcttgtgggatcttcagatgtatatccctccagtgaattggactcagtattgttgagacatcaattttccgcaacatgatttatagattgaaagcaatcacagtaaaaatcccggtaagatttttaggagaaattaatatattccctgatttctaacttattacaaagttatacattagacaatgcgatattggagaaaggacacccatataaatcaattgaatagaatcaataattcagaaatagacccaaaaatatatggtcaaatgatttttgatgttaaggaaaaaataaaaacattttaagctgaggagatacaggacaaattatttgccctcatggagcttaccttcaaatgggcaagacaaataatttttaaagtaaaaaataattcaatagtgaaatttgggctgggtgcaatggctcatgcctgtaatcccagcactttggaaggctgaggcaggtggatcatctgaggtcaggagttcaagaccagcctggccaacctggtgaaaccctgtctctactaaaaatacaaaaaattagctgggtgtggtggcagatgcctgtaatcccagctactcaggaggctgaggcaggagaatcacttgaacccaggaatcacttgaaggcagaggttgcagtgagccgagatcatgccattgcactccagcctgggcaacaagagtgaaactccatctcaaaaaaaaaaaaaaaaaaaagctgggcgcagtggcgtgtgcctgtaatcccagctcctagctactcaggaggctgaggcaggagactaacttgaacccggaggcggaggttgcagtgagccaagatcgcaccactgcactccagcctgggcgaggaagagagattctgtctcaaaaaaaaaaaaaaaaaaaaaaaagaaaaagaaaattgacagtagtgaatgctatgaagaaataaatcaggataaaggcatagagaatgacttacagtggtgctatttaaatagggtggatagagacgattggtggctgaatagagctattgaataatgagaaggaatcaacacgatgggacctatttttaggtctactctttcgattctttttaattttaggtctactctttcacttattctttcaagaaatatttgttgagcacctattatgtgctcaacataattatattattctaggtgctggagatagaacagtaaataaaacagacaaaacccccagcccccatggtgcttactttttttttttttggtagggaagcaaaaaataaacttcacaaataagtcaaatggatggtatgttagtggaaatgctaaggcaaaaaaaggaagaaagggatgtagaatatgtgtgagtgtgcgtgtgggcgtgaacgggtgacggtggcttctgtttaagatacagtgcccaagaaaggcttacctagaagatgacgtttgaaggaagtagaggcagttatggaggcggcaatgggcaagatggttcaaaaagagggataagcaagtgcagcggccctgagctggagcgtacctgtgagctggcatgaagccttcagggagagtggagggagataagataatgtgtgtgtaggggtggatggatcctatggggcccagcaggtcattgtaaggcgtcggcattcatttagagatgagacgccactagagatatgagcaggagtggcctgattatgttttattcggattgctctagctgtgttttaattaaaactattttataaagagaggaaaaaacaattttgcttttccaaatcaatcatgtttatgtctttgaaagaggagaacaacaaatcacagaaaacataaataaatgcattttgttcagggacagatggctgaagcaacgagagtgaatcacagagtcacagaatcacagttatgtgcaaagcactcaggaaatagcttggtccctaattaatcattccatgttgttaaactctgtggagataaatttagccagcagtaggtagaatgagatgaattctcatgaaaacatgttttcaatgaagttggcaaagaatgctgtgtaaaccccaaatagctgaaactatgtcctaatagcattgagcttggtgtgccacatccttagcaataaccacttgagtgtctgtccctggggcctgcagatgaggatgttaacatctgatttagcagaaggggtggggagagtgatgggggacaagggagagagtcctgaaacatacaggtggtgaccctaggagctgactttggtgccatttaggcatatttgctttcaggactcacacttccttaggtttaagctatcaataaaaggaaagtggtttctaagtcctagcctttggactgtattcctttaattcatatagtggagcagggggaaagttatcattttaatggctggtagcacaattccgagaagaaaacttttttgtttatttaatcttagataagccatttgagtgttaagagctatggcccacgacagggaagggatttgaaatgttttagataataaagtgaggagaatttgggatttgcatcagaatgacgaaggggaagtgggggaggggtgatacactaacaccagtggagaagaaatccagggaaaaggtgacagaaatcctggccactgaagggctggagcctgaggctaaaacagtgccagggagaccctctggggtgacagcctaagaatttttgataacaaggatattggcagagcagtggtgaaaccctctccccttttcccattgcttctccctcctttgccccagattcccactcaaagcctgtgatacatactgttgttcactgtggtgttcaggtatactgaggggtaggagagtgaagaaaaggagaatggtttgcaagtggggttaatgtgggctgagagagaagaggacagcaaagaggcgtgagacacagggtaaagaaagcattcagagtaaaatggaccaagaggtgagtaggagaataagttaccccaaatgcctcagaaatatttgttgggaggactctgctatatgagacttaagccctttttaaaaaaataaaataaaatgaaaaggtgattcccaaaaggttggtgccttatgaggcttcatctgcataggatccctggtttcacaactccttatcttgaccagactttctattgattccaggtctttagacaataacttaattctttcaaccaactgtcaatcagaaaatctttgaatccacctatgacctatgacccctcccctactccaccccactgatttgagtttgtcctgccttttccaactaaactagtatatatcccacatgtattgattaatatcttttgtctccctaaatgtataaaaaccaagctataacccaaccaccttgggcacatgttctcaggatctcttgagactgtaccttgggccttggtcatttatatttgactcagaataaacctctttaaatattttacagagtctgactcttttcatcaacagctggaatatttgtttcttgatctaatgatgattacacagcagttttaagtttgtgcaagtttatttggttttatacttacaatatatacactcaataaaatatgatatacctcaataaaaataaagcaatgccttccctgcctccaaaaacaaaaccaacctgggaatacaaagatcaaataacagtgcctgcagaagcttagaaaatcggcacagatgtgacatttgactcagttcagcacacattatggagggttactatacaagggagactgcacacagagaccatactcaggagcctgaggatcctgaatcactgacctagagggaagaagtaccagcccctatcttgaggacctcatattacaaggcagtaatagacatgcaaaaattaatagcaacagtctgattctggcaattggctgatatgccaactcttaccacttttcaacattgtgctagatatgtaagtggcagaaagactgaaaaggaataaacagattattatttgcattctatgctcttatttacttagaaaatccaggagaatctatacactattagaaaaaaattacacttataaaacttactagataaaagatcagtatcaaaaaaatcaattgctttcctaaacaccagtactaactaattagaaaatgcactgggcacagtggcttaagccaataatcccagcattttgggaggctgaggtgggaggatcacttgagcccaggagttcgagacctgcctgagcaacatagcaagaccctgtctctgaaaatgcaattttccaaattttcaataggaacaattacataaatgattataatatatatatataattttatatatacacatctatatctgatgttataaagatgtgcaatacttggagaaaaatttcaaaaattttttgctgggtatataagctctaaatatataaaaagatatactatatttaaatactaagggataaagtattaagcattcaatgaatactggaaaaatgattggatgagttcatattggacagagccacatctcggtcttcttttggaatcctttcttcatatagtacctagaatagtgcctgacactgtgggaaaccaaaatatgtcacctcaaaatatacttctttggcgtattttcagttggttattcagagaagtagcagacaggaatagttctgaaaagctgttcttttgggggtagatttgcatctgtagaggaaatctgcattggtgaggtaaagaacagacacagaggctttctctgaggtccacctatctggatcaggaaaaaggaactcaataagaaaaggagactaaagacctgatactttttttttttttttttttttatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgttaagacctgatacttttaaagtttggacagtgaaacttttgctgcatctcttccttctgagggctgctcccagagagacttcatctgcatcacaagacagcctttgctcaccatgcctttcctccccacaccctctcataatgtgttgctacctccctgcaggagcctttaggaccctatttctttctgtagcttaaaatgctattgaagcttcaactatctggcccttctttgattcttcgagtctcgtagtttgtgtggctcctgtgcacatgtgcatgtgataaatgtgtatactttgtctcccatgaatctggctattgtcagtttcttttatagactcagattaacaaactttcagaagggtggaggcgggcggggggtggggtggggagggaaatccctttgctcctacagcaaagtagtagggactcaaaaaatatcgaagagaagaaaacaaaggagaggaaaggaggaagggatgaataactttatttaaatgagaaaagtggcactgagttaaaaattattaaatattttgaattctttatgttattacaatttttacttttgctaacatcctcttgctttattgttgtaataatgtgtgctcatatagtcattaagagtttacaaaactgtgtcaattaggtccatataacaatgaaaaagcagcagcatcactggaaaatctcgaggctcttcaaggttaaggggcttgccttagatgacaaataacctgactgttactcagacccaagttttttgacttcaagggcagcgactttgtactctacagatgccaatctaaatgggctgcaagctagatgtgtaggctatggattgccatcctaattgggacacttttgagagcagaagtaggtgttatccattatgttgggacaataggtgtaaattggtaccatcttgggtacatccaaggtacagtttaccttatctatggctgaaaactgagtttaaattaattcttcttacgggcagcacaagtcaaaaagccctttgccaagctgcacagattgtaaatgctgctcctggctgtgttcaatgtatatttggacaaagtcaataataaataaataaaggtcaactatgaattaaggtaggtttgttagtttgttttttggtaaaaggaatgtcacttgcttagagaggttaatatactgcatgtggggcaaagttgctggtaagtatcattcttccttctgtccttcgaaccccaaatgacacatcttgttcacgtatccactatggtgtaagacatcactgggtgctggctgtaattttatcttccttcttaaagtctttataacgtgaagataatgagtggatctgtgcgaaactcactaccaggatcagccaatacttgtttttctgtggagcttttggtgattactttaactgaatagagttttttttttttaaacagcaaatctttcaatgtattagcaattttaagtaagaatctctaacttgtaacacacactgaacttagagttttgttttttttctacacatgccatttctgcaagtgaacttaagaaatttcaactaatatagaagacttaatcaattctcaattacatgttgtaaattaacctgctaacaggaacaggtgaaactctcttaacattttaaggacataaagtaatcaaatatgcagatttaacacaaaaccattaatattatggggttcttttcaatatttctatgcttaattttaaatcttttttaggataaaattgttttccaactaagaaaagtattgtcatcctattttgtgagataccactaagtcaaatgagattgcgtaatgaccagagatattattagttgaggtgctgactgtatttttatctgatataccaatgagtcttttcacttgggtaaatatgtaggagctggatttctgagttgaatggtaagtctgtttttaactttgtactaaactgggattttgttttccaaagtggctgtacaattttgcattccaaccaacaatgtatgagagtcctagttctgcatgctcatcagtaaatagaattgtcagttgttaaattttagccattctaatagttcctacccttttttagaccatatagggtaatgacattgccatggcatctgtaaactgtcatggcgctagtgggagtgtcttttggtatgctaatacattataattagtgtataatgagcaatgatatcgaacagaggtcactttcattgccatgtgggtttgggtgggttttggccagcttctttactgcaacctgttttatcagcgaggtcccttctgactaatgatgttaagaatcttttaatgtacttatttataatctttctatcttcagtaaaatgtctatagaaattattggtccatttctttattgagttgtgtgatttcttaatactgagttttgaaagatctttatatattctgaactcaaggctttattgtatatctcatttgcaaatatttatccagtgcatggctggtcttttaattttctttttcttttttctttttcctaactgctagatgatgtgggagtcttttcaaatccttagcatctttggaagagcagaagtttaaatttttgataaaatctaatttatcttttttgagacagggtctcactctgtcactcaggctggagtgcagtggcacaatcatggctcactgcagcctcaaccttcagggctcaggtgatcctctcacctcagcctcctgagtagctgggactacaggtgcccaccaccatgcctggctaatttttgtattgtgtgtagagacaggatttcgccatgttgcccaggctggtctcaaactcctgggctcatgtgatccacctgcctcagcctcccaaagtgctaggattaaatttatcatcttttttttttcttggatggatcatagttttggcatcttcttagaaatctttgcctaatgtcgtgatgattttctcctatgttttcttcaaagttttatagtttaaaattttagatttaggtctgtaatacatttgagttaattttttgtaaagggtatgagtgatcaatcaaggccctccctccttcctttccttccttccttgtatattgaaatccaattattccagcaccatctgttgagtcttcctattcatgaacagggactgtctctccatttatttagtttctatttgatttctttcattagagttctatagttttcctcatatagatcttgtacataatttgttggatttataccgaagtagtttggttttgggggtgctggtataaatggtattgtgatttttcttttctttttttttttttttgatacagggtctcaccctctcacccaggctggagtgcaatggtgcaatcttggctcacttgtaactttggcctcctgggctcaggtgatcttcccacctcagccccttgagtacctgggactacaggtgtgcaccaccatacctggctaatttttttgtatttttgttttgcagatatgggtttttgccatgttgcccagactggtctcaagctcctgggccccaagtgatttcattcacctcagcctcctaaagtgctgtattgtgtttttaatttcaaattccacttgttcattgctcatacataggaaagtgattgacttttgtatattaatcttgctctagttacttattagttccaggagtctgttgtttattcttttggattttctacatgaacaactatgtcttctgtgaacaaagacagtaatatatattccttccagatccatgtacctttcatttcatgttcttatcccagtattatctaggatttccaatatgatgttgaaaaggagtggtgagagggaacatccttatcttgctcttgatcttggtgagaaagcctcatgcttcttatcattaagtatgatgttagctgcaggttttttgtagacattctttatgaagttgaggaagatccactccattcctagtttactgacagcttttatcatgaatgtgtgttggagtttgtcaaaagctttttctgcatatattaatatgattatgtgatttttttcctttagcctgttgatgtagtgaattttacattaattgatttttgaatgttaaaccagctttgcatatctgggatgaattccacttgctcatggtgtataattctttttatacattgttagattcaatttgctaatatcttgttgaggattttgcatccgtgttcatgaaagatattggatctgtagtctttttatgtaatgtctttgtctggttttggtaataaggtaatgctggcctcatagaatgagtggggaagtattccctctgcttctgtcttctaaaagagattgtagagagttggtataatttcttccttaaatgtttggtagatattaccagtgaaactatctaggccttgtgctttctgttttggaaggttattatttattaattcaatttctttaataaatattggcctactcagattatttattgattcttgtgtgagttttggcagattatgtctttcaaaaaattggtccatttcatctaggttatcaaattaaatttgtggtcataaagttgttcatagttgtccattattatcccgttagtgtccgtgggatctgtaatgatgttccctctatcctttcttgctttgttgttgttgttgtttttgagatggagtcttggtctgtcgcccaggctggagtgcagtggtgctatcttggctcactgcaacctccacctcccaggttcaaacgactctcttgcctcaacctccccagtagctgggattacaggtgcccaccaccaagcccagctaatttttgtatttttagtagagctagggtttcactatattggtcaggctggtctcgaactcctaacctctagcgatccacctgccttggcctcccaaaggcgtaagccactgcacctggcctcatttctgatattaggaatttgtgtcatctttttgtttttcttggttatcctagctagaggcttagtggttttatttatcttttttttttttttttttgctgaggttttattttggaaaaaaagagcaattgaattgttttgtagctggagagtgcctcaggcagtgaactcctcctggggatgggctgagggcaagggctaagcctcaggtgggtctcctgttccctgtgctcccctgcacagctgcctccctctcggaccctggggcagccgcaggaagggtaggctgggaggggctgccatggctgttcacttgggcaggacatcagaggactcgaacaccagcctcccatcacaggtcttgattttcttcacaactacagccctggtggagctgctgcagctgaaggagctggagcctgtgccagagccaaagctggagcccagcttccctccggcaactacctgtaggtggcaatctccatgtccagggcctatttatcttttttttttttttaaatagcttttagtttcattgattttttttctattgattttctgttttcaatttcattgatttctgctttcatttttattatttcttattctttctttagaattaatttgttcctcttttttctagttttttaaggtgaaagcctagatgattgattttatatctttcttcctttctaatatatacatttaatggcataaatgttcatctaagcactgtttttactgtatcccacaaattttgaaaagtcatgcttttattttcatttagttaaaaataattttaaatttctctgagatttctcttgtgacccatgtgttattttgaagtgtgttgtttaatctccatgtattttggaattgtccggttgtgtttccgttattaaatttttagtttaattctattgtggtttgagagcagatgttgttttaaatttgctaaggtgtgttttatggcccagaatgtggtctatcttgctaaatgttccatgtgaactggagaagaaaatgttttctgcaaaagttggatgaagtagtccatagattttttttttgttccagattaaatgcttttttaaaaaatttattattattatactttaagttatagggtacatgtgcacattgtgcaggttagttacatatgtatacatgtgccatgctggtgcgctgcacccactaactcgtcatctagcattaggtatatctcccaatgctatccctcccccctcccaccaccccacaacagtccccagagtgtgatgttccccttcctgtgtccatgtgttctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatacacccagtaatgggatggctgggtcaaatgatatttctagttctagatccctgaggaatcgccacactgacttccacaatggttgaactagtttacagtcccaccaacagtgtaaaagcattcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaattactttgagttcattgtagattctggatattagccctttggcagatgagtaggttgcgaaaattttctctcattttgtaggttgcctgttcactctgatggtggtttcttttgctgtgcagaagctctttagtttaattagatcccatttgtcaattttggcttttgttgccattgctcttggtgttttagacatgaagtccttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctacatatggctagccagttttcccagtaccatttattaaatagggaatcctttccccattgcttgtttttctcaggtttgtcaaagatcagatagttgtagatatgcagcattatttctgagggctctgttctgttccactgatctatatctctgttttggtaccagtaccgtgctgttttggttactgtagccttgtagtatagtttgaagtcaggtagagtgatgcctccagctttgttcttttggcttaggattgacttggtgatgcgggctcttttttggttccatatgaactttaaagtagttttttccaattctgtgaagaaagtcattggtagcttgatgggtatggcattgaatctgtaaattaccttgggcggtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctgtctgtttgtctgttattggtgtataagaatgcttgtgatttttgtacattgattttgtatcctgagactttgctgaagttgcttatcaatttaaggagattttgggctgagacaatggggttttctagatatacaatcctgtcgtctgcaaacagggacaatttgactacctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaatgccttttctgcatctattgagataatcatgtggtatttgtctttggttctatttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctctttttttgttgtgtctctgcccggctttggtatcaggatgatgctggcctcataaaatgagttagggaggattccctctttttctattgattggagtagtttcagaaggaatggtaccagttcctccttgtacctctggtagaattcggctgtgaatccatctggtcctggattctttttggttggtaagctattgattgttgccacaatttcagatcctgttattggtgtattcagagattcaacttcttcctggtttagtcttgggagagtgtatatgtcgaggaatttatccatttcttctagattttctagtttatttgcatagaggtgtttgtagtattctctgatggtagtttgtatttctgtgggattggtggtgatatcccctttatcattttttattgcgtctattagattcttctctctttttttctttattagtcttgttagcagtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttctctaattcttttaattgtgatgttagggtgtcaattttggatctttcctgctttctcttgtgggcatttagtgctatacatttccctcgacgcactgctttgaatgcatcccagagattctggtatgttgtgtctttgttctcgttggtttcaaagaacatctttatttctgccttcattttgttatgtacccagtagtcattcaggagcaggttgttcagtttccatgtagttgagcggttttgagtgagattcttaatcctgcgttctagtttgactgcactgtggtctgacagacagtttgttataatttctgttcttttacatttgctgaggagagctttacttccaagtatgtggtcaattttggaataggtgtggtgtggtgctgaaaaaaaatgtatattctgttgatttggggtggagagttctgttagatgtctattaggtccgcttggtgcagagctgagttcaattcctgggtatccttgttgactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaagatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactccgtatccaatttgccagtctgtgtcttttaattggaacgtttagtccatttacatttaaagttaatattgttatgtgtgaatctgatcctgtcattatgatgttagctggttcttttgctcgttagttcatgcagtttcttcgtagtctcgatggtctttacattttggcatgattttgcagcggctggtaccggttgttcctttccatgtttagcgctttcttcaggagctcatttagggcaggcctggtggtgacaaaatctctcagcatttgcttgtctgtaaagtattttatttccccttcacttatgaaacttagtttggctggatatgaaattctgggttgaaaattcttttctttaagaatgttgaatattggcccccactctcttctggcttgtagggtttctgccgagagatccactgttagtctgatgggcttccctttgtgggtaacccaacctttctctctggctgcccttaacattttttccttcatttcaactttggtgaatctgacaattatgtgtcttggagttgctcttctcgaggagtatctttgtggcgttctctgtatttcctgaatctgaatgttagcctgccttgctagattggggaagttctcctggatgatatcctgcagagtgttttccaacttggttccattctccccgtcactttcaggtacaccaatcagacgtagatttggtcttttcacatagttccatatttcttggaggctttgctcgtttctttttattcttttttctctaaacttcccttctcacttcatttcattcacttcatcttccatcgctgataccctttcttccagttgatcgcatcggctcctgaggcttctgccttcttcacgtagttctcaagccttggttttcagctccatcagctcctttaagcacttctctgtattggttattctagttatgcattcttctaaacttttttcaaagttttcaacttctttgcctttggtttgaatttcctcccgtagctcgtagtaatttgatcgtctgaagccttcttctctcagctcgtcgaagtcattctctgtccagctttgttccgttgctggtgaagaactgcattcctttggaggaggagaggtgctctgctgtttagagttcccagtttttctgctctgtttttccccatctttgtggttttatgtacttttggtctttgatgatggtgatgtacagatgggtttttggtgtggatgtcctttctgtttgttagttttccttctaacagacaggaccctcagctgcaggtctgttggagtacccggccatgtgaggtgtcagtctgcccctgctggggggtgcctcccagttaggctgctcgggggtcaggggtcagggacccacttgaggaggcagtctgtccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctctttgagctgtggtgggctccacccagttcgagcttcctggctgctttgtttacctaatcaagcctggacaatggtgggcgcccctcccccagccttgctgccgccttgcagtttgatctcagactgctgtgctagcaatcagtgagactccgtgggcataggaccctccgagccaggtgcagggtataatctcctggtgcgccattttttaagcccgtcggaaaagcacagtattcgggtgggagtgacccgattttccaggtgccatctgtcacccctttctttgactaggaaaggaaactccctgaccccttgcgcttcccgagtgaggcaatgcctcgcccagcttcggctcgtgcacggtgcgcgcacccattgacctgcgcccactgtctggcactccctagtgagatgaacctggtacctcagatggaaatgcagaaatcacccgtcttctgcgtggctcacgctgggagctgtagaccagagctgttcctattcggccatcttggctcctccccccatagatgttaattatatccagttaattgatggtgttgttgagttcaactttgtccttactggttttatgcctgctggatctgtccatttctgacagaggagtattcaggtctccaactacaatcatggattcatctatttctctttgcagttctgatgtttttgcctctcattttaatgtatgtggttaggcacatacatattaaggattgtatatcttcttagagaacagacctctttattgctatgtaatgcccctctttgtccctgataactatttttgctttgaagtctgctcttaatgaaattaatagaggtactcttgttttcttttgattagtgttagtatggtatatctttatccatttgtttttaatctatactgtctatttttaaagctggttaattgtagacaacatatacttgggtctggtttcttcatccactccaacagtctctgtctttgattggtgcattagaccactgacatgcaaagtgattattgatatagtgggattaatacctactctatttgttagatttttatttgttgcccttgttctttgaccctgtttttgtcttccactctttttctgtcttttgtatttttaattaaatactttacatggttccattttctctgttatacttttttccatatctattgtatctgtttatttaaacattttttagtgtttgccctaaaatatgcagtatacatttgcaagaatccaatccttcaaataacactatactgcttcatgggtagtgtttttagtaacaaagtaacccaattctttcctcctatcccttgtgtcaatgctgttattcattttacttatatgtaagcatacataagcatatagatacacataagatatatacataagcatatataacctaatacgttattgctattactattttgaaaactgttacatcttagatcagttaagaataagaaaaatagaagtttttaatttttccttcactttcttctccttctgtattcatattatgcatatgtttatattttgtagttgtttcacagttcttgaatatgctgtcctgctttttctagtctttattctctttgcttttcagttttggaggtttctactgatagatccccagtctcagaaattctttcctcagccacgttcactctactaataagccatcaaagccattcttcatgtctattacatggttcaaaaaaattgtttatatagatgtatggggtacaggtgcaattttgttacacgcatactggtcaagtcagggcttttatggtatttatcaccagaataacatacattgtacctattaagtaatttctcctcacctgccctctcacctcttcccctttctgagtcttcattgtctataattccactctttagctccatgtgtccaccttttttctcagcatccacttacagtgtttacagtgttctcatgtttctttgtttcttttctttttaaatttcgagacaggctacaacagaatccaaatccataggtaaagcaaactactcatgtaatttcaaagctgaagttgatagtatatttgtacccaatatgaatggttcacctgcatgagttttgagttctcaaaggccagtagcctcctttcccttttatgcatcttgagtacacttgagttagcctatgatacatgaatacctacaaagttgaggcctataaaacttacatggcaagcaatttgaaatgtgccaacaatgtgatactggagcaaccatagtgctgagaacagctttgactactgcaggaaatccacaaacctcaaatttagatgaaaacatttttgaacttaattcatactgagggacaaattatggtaatagtggagggaaagtctttttatgtgagatacaggaggctcctttagctctttcacctcctagagtcaccatagtggtaccttcatttattccttctcaaatattcctcccatcttcatttagatctgagtttcaggcctatattattttccctctttctgaagaactcttgacatttctttcaaggcatgtttactgacaacaaagtccctcaattttcatttgagaaaatctttgtttcccttttgaatgaaaattttgctggatacagaattctaaattggtgatttatttctttcaacactttattttactctaccttattcttgtttgagtcgtttttgaagagaattccaacgtaatacttatccttgttcctccagtaggtaaggggtttttgttttgtttttgtttttttgccttcctatagcttctttaaggattttcttttgtctttgattttctgcagtttatgtatgatattcctgggtgtagatatttcttggtatttttcctgcttggcattgtgtgagcttcctgaatctttggtttggtgtctgctattaattttggaaaattctcagccaatgtttctttattttttctgttcctttttttctcctccttttgttagtcccattatacctttattatccttctgtaagtgttccacagttcttggatatttgcaccatttcttttcagtctttcttctctttgctttgcaatttggcagtttctattaacatatttgcaaactcaacaattcttatctcagccatatccagtctactgctgagtccatcaaaggcactcttcatttctgtgagacagacataatctataggtgaaaggaactgatgtaaatacacctttagtgtgagattttatgcttatctggctaagagctctgcatgtattcctgtctgtctcccaaagtgtagaaagattttttttgttgttcagtttctcttaggacaacaggtcgttgtccacagtatgtgactcagcacccttggatgatgaagttggctaagatgttggcaggcagagaatcacccatggtgttgccagtggtagttaccgagaagccagctggggtgctactgaattctctggggagctgacctctgagagttgcccttcagggtgctggaaagactagctgggaagtgtacctgtgaggacaatcctgaaactcacttggaagctgccctatggtatgctggccaaactcactagaaagccacccttaggagtgccagcaaagctcactggggaggcatcttctacctatctcacatgccactggcagctatgtgcagcaagaacaaaccaaaaaagcactcaaatcaggaagtggagctccttcttccctcagcatctttctaatgccctctactggcaaagcttaccattgtccaactaacaaagggaaatgttcacaggatccagctctgccatcccaacccaggacaaagaagcgtgaatttataactcaaatgtaataaattaataactggcagaactgcccattacacataggatatattccaattctttgccagcacctataatgatttactctctacctatttcttcaacattattggaggtccaccctgcctactttccaccattttagccattctctgttatttgcacactccaagctcatcttacctcagaacctttgcccttgctatactccatgcttggaacaagtttcccctatatctttatataactagctctctattaatatttgggtctttgttaaatgtgacctcatttgaataatctaaaatgagcccacatgcctataataccttctgttgttttgctgtttagttttcttcacggtacttatcactaaattatccttttttttttttttactatgttcttatccacatagtaataagccaagtaagagccagaccataatctatattacatatcagcaataagaagagtacccggcaagtagtaagtgctcataaaaaatactatatagttgttgaatgaatgagtgatctctgttttatagctgaggactgaagctcagagagagaaagtaactttcccaaagaacacagctagcaagtgccagagtcaggagtcacctcaggtcctcctgatcacagtgctctgattgtcatggctctgtaccaccacctccctgagtgctggaaagagtgtagctgaggtacatgttacagtggagtctctaaaataattgagcttttgttatctcattacccatttttttctttctatggatctggctctctactgtgtgtgcatagatacagatccatgtactcgtgccccctactcagaataataatgtgttaaatatctttcaaagaaagaattattagacaaagtcatggaactcttcaccaaaaagatgaccttcaagaggggccatgcgcgatggctcacgcttggaatcctggcagtttgggaggccgttcgagaccagcctggccaacatggtgaaaccccgtctctactaaaaatacaaaaattagccgggcttggtggtgtgcacctgtagtcccaactacaggagaatcgctttcacccgggagactgaggttgcagtgagccaagactgtgccactgcactctggtctgggtgacagagtgacactctgtctcaaaacaaaaacaaaaacagaaacaaaaacaaaacctttgaaatactttgtaaaattagaaattgggtattgagaaaaataaaaatacatcaaatggaagacaggaacctagatcccatttttttcttttctttcttttctttttttttttttttgatggagtctaactctgttgcccaggccagagtgcaatggtggaatcttggctcactgcaacctccgtctcctgggttcaagcaattctcctgtctcagcctcccgagtaagtgggattacaggcgcccgccaccatgcctgccaaattttgtatttttagtaaagatggggttttaccatgttggccaggccagtctccaactcctggcctcaagatatccgcctgcctcggcctcccaaagtgctgggattacaggcgtgagccaccatgcctggccccagatccagttgtctaataccattcttcagtaaaataaaccagggctcttaggagaagtggtcaattctagcactggggcaggaaatacaaacataggcctaaggtaccagggcataaggaagtgttcagaaaacaaaaaaatcacacaacgatggggatatgttaaaaggaactgtagccagagaagggttcctaatggctgaagacagaaaaacttgagcaacaaagtcaacaaaatagtattggattataaagtataaataaatatccacgagtctgtccatactgatacaaataaatgattgaataaataaacaagtagtggagaataggtggatctcccatacagaagaatcccaaaaaatttatgtagatactctgtcctcaaggaggtagagcataattccacattcaagtgtgggttgcgcatactgacttccttcaaaataatacagttatggagagaggaaaaactaacttcatagtggaaaaatctgacaaaccccacctcagccaggggatcaaggtcagcatcaatggtatatatttttgatatgatgtgataagaaaggcatattatttccatagtcttcctcagcaaaccccaaacatcagcctaatcgtgaaaaaatcatcaggcatctcccagttgaagggccttctataaaatacctggccaatactccccaaatctgttaaggtcttagaaactgttttttaaaattattattatacattaagttctagggtacacgtgcacaatgtgcaggtttgttacgtaggtatacatgtgccatgttgttttgctgcacccatcaactcgtcatttacattaggcattactaattagggttactaatgctatccctctcccatccccccacccgccaacaggccccaatgtgtgatgttccctgccctgtgtccatgtgttcttgttcaactcccacctatgagtgagaacatgcggtgtttggttttctgtccttgtggtggtttgcttaaaatgatggtttccagcttcatccatgtccctgcaaacgacacgaactcatcctttttatggctgcatagtattctatgatgtgtatatgtgctacattttcttaatccgttctatcattgatagacatttgggttggttccaagtctttgctattgtgaatagtgctgcaataaacatacatgtgcatgtgtctttgtagtagcaagatttataatcctttgggtatatacccagtaatgggaccactgggtcaaatggtatttctagttctagatccttgaggaatcgccacactgtcttccacaatggttgaactaatttacactcccaccaacagtgtaaaagcattcctatttctccacatccttccagcatctgttgcttcctgactttttaatgatcaccattctaactggcatgagatgttatctcattgtggttttgatttgcatttctctgatgaccagtgatgatgagcattttttcatatgtctgttggctgcataaatgtcttcttttgagaaatgtctgtttatatcctttgcccactttttgatggggttgtttgtttttttcttataaatttaagttctttgtagattccagatattagccttttgtcagatgggtagattgcaaagattttctcccattctatatgttgcctgttcactctgatgatagtttcttttgctgtacagaagctctttagtttaattagataccatttgtcaattttggcttttgttgctattgcttttggtgttttagtcatgaaatctttgcccatgcctatgtcctgaatggtagtacctaggttttcttctagggtttttatggtgttaggtcttacatttaagtctttaatccatcttgagttaatttttgtatatggtgtaaggaaggaatccagtttcagctttctacatatggctagccagttttcccagcaccatttattaaatagggaatcctttccctatttggttgtttgtgtcaggtttccccattgcttgtttgtgtcaggtttgtcaaagatcagatggttgtagatgtgtggtattatttctgaggcctctgttctgttccattgatctatatctctgttttggtaccagtaccatgctgttttggttagtgtagccttgtagtatagtttgaagtcagatagcatgatgcctccagctttgttctttttgcttaggattgtcttggctatgtgggctcttttttggttccatacgaactttacagtagttttttccaattctgtgaagaaagtcagtggtagcttgatggggatggcactgaatccataaattaccttgggcagtatagccattttcatgatattgattcttcctttccatgaacatggaatgttcttccatttgtttgtgtcctcttttatttcattgagcagtgatttgtagttctccttgaagaggtccttcacatcccttgtaagttggattcctaggtattttatcctctttgtattaattgtgaatgggagttcattcatgatttggctctctgtgtgtctattattggtgtgtaggagttcttgtgattttttgcacattgattttatatcctgagactttgttgaagttgcttatcagcttaaggagattttgggctgagatgatggggttttctaaatatacaatcatgtcatctgcaaacagagacaatttgacttcctcttttcctaattcaataccttttatttctttctctcgcttgattgccctagccagaacttccaatactatgttgaataggagtggtgagagagggcatccttgtcttgtgctggttttcaaagggaatgcttccagtttttgcccattcagtatgatactggctgtgggtttgtcataaatggctcttattatttttagatacgttccatcaatacctagtttattgcgagtttttagcatgaagggcggttgaattttatcaaaggccttttctgcatctattgagataatcatgtggattttgtctttggtcctgttgatgtgatggattacgtttattgatttgcatatgttgaaccagccttgcatcccagggatgaagccaacttgattgtggtggataagctttttgatgtgctgctggattcagtttgccagtattttattgaggatttttgcgttgatgttcatgagggatattggcctaaaattctctttttttattgtgtctctaccaggctttgctatcaggataatgctagcctcataaaatgagttagggaggatatcctctttttctattgattgaaatagtttcagaaggaatagtaccagctcctttttgcacctctggtagaatttggctgtgaatccatctggtcctggactttttttggttgataggctattaattattgcctcaatttcagaacctgttattggtctattcagagattcaacttcttccactggtttagtcttgggagggtgtatgtgtccaggaattaatccatttcttctagattttctagtttatttgcatatagatgtttatcatattctctgatggtagtttgtatttctgtgggattggtggtgatatcccttttatcattttttattgcgtcaatttgattcttctctcttttcttctttattagtcttgctagcggtctattttgttgatcatttcaaaaatccaactcctggattcattgatttttttgaagggttttttgtgtctctatctccttcagttctgctctgatcttagttatttcttgccttctgctagcttttgaatatgtttgctcttgcttctctacttcttttaactgtgatgatagggtgtcgattttagatatttcctcctttctcttgtgggcagttagtgctataaatttccctctacacactgctttaaaagtgtcccagagattctggtacattgtgtctatgttctcactggtttcaaagaacatcttcatttctgcctttattttgtaatttaccctgtagtcattcaggagcaagttgttcagtttccatgtagttgtgtggttttgagtgagtttcttaatcctgagttctaattttattgcactgtggtctgagagacagtttgttgtgatttctgttcttttacatttgctgaggagtgttttactaccaattatgtgatcaattttagaataagtgtgatgtggtgctgggaggaatgtatattctgttgatttggggtggagaattctgtagatgtctattaggtccacttggtccagagctgagttcaagttctggttatccttggtaaccttctttctcgttgatctgtctaatattgacagtgaggtgttaaagtctcccattattattgtgtgggagtctaagtctctttgtaggtctctaaggacttgctttatgaatctgggtgctcctgtgttgggtacatacatatttaggatagttaggtcttcttgttgaattgatccctttaccattacgtagtggccttctttgcctcttttgttctttgttggtttaaagtctgttttatcggagactaggattgcaatccctgcttttttttgctttccatttgcttggtagatcttcctccatccctttattttgagcctatgtgtgtctttgcacatgagataggtctcctgaatacagcacactgatgggtcttgactctttatccaatttgccagcctgtgtcttttaattggggcatttagcccatttacatttaaggttaatattgttatatttgaatttgatcctatcattatgatgttagctggttattttgcccattaattgatgcagtttcttcatagtgtccttggtctttaccatttggcatgttttcatagtggctggtaccggttgttccattccatgtttagtgcttccttcaagagctcttgtaaggcaggcctagagtgacaaaatctctcagcatttgcttgtctgtaaaggattttatttctccttcacttaggaagcttagtttggctgcatatgagattctgggttgaaaatgcttttctttaagaaggttgaatattggcccccactctcttttggcttgtagggtttctgccgagagatccgctgttagtctgatgggcttctctttgtgggtagcctgacctttctgtctggctgcccttaacattttttccttcatttcgaccttggtgaatctgacaattaatgtgtcttggggttgctcttgttgaggagtatctttatggtgtcctctgtatttcctgaatttgaatattggcctgccttgctaggttggggaagttctcctagataatatcctgaagagtgttttccaacttggttccattctccccgtcacttttggtacaccaatcagatgtagatttggtcttttcacatagtcccatatttcttggaggctttgttcatttctttttactcttttttctctaatcttgtcttctttctttatttcattaatttgatcttcaatcactgacatcctttcttccacttgattgaattggctattgaaccttgtgcatgcatcacgaagttcttgtgccatggttttcagctccatcaggtcatttaaggtcttctctacattgtttattctagttagccattcattcttctcaccttttttcaaggtttttagcttccttgggatgagttagaacatgctgctttagctcggggaagtttgttattaccgaccttctgaagcctacttctgtcaactggtcaaactcattctcgtccagttcgtttccttgctggcaaggagttatgttcctttggaggagaagaggcgctctattttttggaattttcagcttttctgctctcatttctccccatctttgtggttttatctacctttggtctttgatgttattgacctactgatgggattttggtgtagctgtcctttttgttgatgttgatgctattcctttctgtttgttagttttgcttctaacagtcagacccctcagctgcaggtctgttggagtttgctggaggtccactccagaccctgtttgcctgggtatcaccagtggaggctgcagaacagcaaatattgttgcttaatacttcctctggaagctttgtcccagaggggcacctgcctgtttgaggtgtctgttggcccctactggaaggtgtttcccagtaaggctacacgggggtcagggacccacttgaggaggcagtctgtccattctcagagcttgaacacaatgctgacagaaccactgctcgcttcagagctgtcagatagggacgtttaagtctgcagaagccgtctgctaccttttgttctactataccctgcccccagaggtggaatctatagaggcagtgagccttgccgtgctgcggtgggctccacccagttcgtgcttcttggcctctttgtttacactgtgagctactcaaggctcagcaatggcagatgctcctcccccagtcaagctgcagtgtcacaggtcagactgctgcactagcagtgagcaaggctccatgggtgtgggacctgctgagccaggcacaggagggaatctcctggtctactggttgctaagactgtgggaaaagcacagtatttggtcaggagtgtactttttctccaggtacagtctgtcatggtttcccttggctaggaaagggaaatcccctgaccccttgcgcttcccgggtgaggtgatgccctgccctgcttcagctcaccctctgtgggctgcacccactgtccaaccagtcccaatgagatgaaccaggtacctcagttggaaatgcagaaatcacctgtcttctgcattgatctcgctggagctgcggactggagctgttcctatttggccatcttggaagcaactgcccatcttagaaactcttacagccaagaggagactaaggagacatgctgactcaatgtaatgtggtgtcctggatggatctgaggaagggaaagaggatatttggttaggaaactctgaacaactaaagaaatctgagtaaagtatggatgttagttaatattcatgtattagaattggtttacagtggttacaaattatagaggacactgggtatgtggtatagttatacgagaacaatctgtactctcttagcaactcttctgtgattctaaaaccattctaaaataaaaagcttccttaaaaaaaattgatggcagagcaggagtaagtatttttgttttgtaaccttggaaaaaagagagttgaggcaaaatccacagaggactagaacctgtattcctatctggtgtgggaggagagagatgacatttggttgggagaaggctggagccaagttatggtgttcagtttgtttctgctctgctgtcatagggctcttccttggaggagctatagctctatggaaccgtatgaatgggagagtaaggttcaacagttcgttggtgtgacctgggtgtatgtgcacatgcggatgcattgtgtacatgcaaactcaaatccccatagcatccagctaggaagtctaaatgagcaaagcaagttgggtataagaaataagaaagtgctgggagctatgcttaataggagacacaagcctcaaatagcagaacagctgctgctctgttcagtgccgggtgatttttgctgtgcgggaaggtgaactgagatgcattttctggtatttcaaaagaagctgaaaatctagatttactttttgaatgtggaaaattctgctttttaaatgttggcaactatttcagaaagtttttattaatcatcatgtatgcccaatctgtgttgaaggaaatgtgtctgtggactgcacacagtccataccaccaggttgcaattatttctgtcaacctgagctatgctgagtccggtgggctaatacagatgaggcagggctgtgtctgtgtggtgtagagcatggagtcagtctgtgtcctgagctgtgatgagatcattctgtgagagtaaataactgagcttgtacttgaaagttgaggacaatgtggagaacaaagagctaagagcacaagcaaaggtccagaactagaacatcacagggtgtgttttggagactggatgatttgagtaaagaatcatgaagagcagaagtagttatcaggctagaaagttaggctggagccagataaggatgggcctgagtatttggaatatatactgttggcaacagatgactaaatactcgggttctcttgaaggagtacagggcagaaatcaggagatagaatgagaaatttgacatttacaccagaactttccagccacaaagagcaaggtagagtcaattaatgcactgagtctagttagaatgattgggttaaggtgagagtggccattcctaacacttagcaaaacagtgtgtatgcatatgcctgtgtgcagttatttgattatacatacactttccagctgggctaggctggcctatctgggcccagtcaactgctgtggacactgagctttaacaccaataagtgcgtgccgtattcatcctcattctcatttctttctcagtgcctcttgaccctccaaggattattgcactgatccagaactgctaaaatggagaaagccaggcctgacctgtgcgcacagcacacagcattgatatttgatgtgagattaggtcagagtcagccgggaagccttctaaagcgtggcatacagccaacaaaatgaaaaggctttattctggggggaaatgtttccctctctgcctggcttgctttccttatcctcccttagacatcctttcccctaaattctagttcattattttcatttgaaactctcaaattccactgggccactagctgaccacattcctccctaaacaatagcattctattttaaacacttattgtgccaatgttgacattttaatagcccaagaggggctgaaataactactcctacctcaccaccatcaccaaggagatcaagtatcatttctaggatttatggtaagcccctcacggtgaaagcacaaaaatcagaggccaggaaattggcagctacgtattttaaataggatttcggtaatctttggctggtctttcctaacaatgttgaagttgatattttgtaacttaacattggttctagttctgcctggtgagtagctctaatctcattttcattatgtgagaaaacacttattaattagtagaaactattggcaaacttgatatagttgtgaatgaataatgtaaatccctagtggggcccttcccaaacccttgctccccttcctaaataagcaaacagagggaaatttctgattttagtgggatgatgtaccactgattacccaacattgcttatgactttaccattaagatttataatgaaaactcttttatctatatgtaacaggaattaaactttatgcaacaagttaaataacaaactttctcgatatccaaatgagtgctttctttatccaagttcatcagtgtaggggaaagtcctaaccttatttcaaaaatgtgcaaaatattttgtaataactaggtaattctaaaaacatataaggaattatctgaagttaagtgtggtgagtgaagtggatgattgatagtcatttgggagcagtaaagtgggtaagagtaaaaattaatgagacagtcttcttcacgtggttcaaaaaacagcttctgaaggcagtttccctggaagagctccagaagtgttcttgtatgtggcagtaaagaaagacaatactcctgatgactggtaaccaagtaatgctggcttaaacagttacttatgtgataatcaaacttcccttgctgatataaaagtttttatgtattcttggtttgatcactcctaatttgtctgcatgcaaggagaaccagacttaaggtaggatccactcatttactgactgattgcttattgaatgccttctctgtgctggacagtaggagtaagatgaggagcactgtggactttgtccctgccctcatacatttatgataaggggttgtggggtcagggcatggaaaaaacaaaaggcaaatctttaagacaaactgattggaaacgactgctattggttaaatacacccacatgttgagataatttgtactttcccaaaacattatcttgataacattatagtcccagaaagcgttagggaatgtagtaatgaaactttggcaggtcttgtgcctctacaatgtttgtgttgctcatgacctttgtacatgaatgcttttgcccatgtggccagtcaaaaaatgacctggttgacctgtttttccaaaagacctttgaccaaatctttgatggacaaacagagaatcatgttttcaagaaggatctacttgcaagcaaagttctatagtgtagtcagggaaggctctatgaagtaatgaactcttctggcaaagatctgaaggatgagtagaaaatagtctggtcatgagctaggggaagtgatttacaggcaggagtaacatgtggaatacagaataatttgactttaataaatttcaaatggtaaaaattttccaaagttcaaaatagaaacataacatcccgtgatattagaaaatctcattactttactttagtctggccagaaatgtgtcaagaggaagacttcaaagaggtagatttcatctctctggcctgtaaacaaaatgcccaaaacacttccccaaggcttaaagtcagtttgtaattactcttttcatcacctcagaagaatttccaaactttagtaacgtagtaaaattttttttggcctttgtgaataaatactatgaaatttggttcaaaagataaagcaaagagcaactgaggtcttcaaaacatcatgtatctagaaggtattaccaaacatccgttttttttaaaaaagcataaggcataaaatcaattcactaatgtcatgctagagtgaggtagtaaaatgaggcaactcagaccagatggtgtaattcataaacagggctgtcatttgggaaaacgggtggagtggatggagaaattaacttgcagtctttccccttccatttcttcccaatccaactaaccttattcctctgggtcatttagctgtggctaaaacacacacacacacacacacacacacacacacacgtgtgtatatatataatatatatataatatactttttacttatagccataggtaaatggtgaatgaagtagatgattgacctgtgtgcatagcacacagcattgctatttgatgtttgatgaaatatcaatgctctcagaataaataattaaatgagtgtatatatatagacacacacacacacacacacacacacacacacatatatttcttttttaaaagagtgtaattgatgccaaagccactttctcttcagagctgcttaactacatgaagagtgtgcaccaacctggggttgcaaagagttctctaccttgtccggcttctggaaaggatgtgcgctttgctcaatggggaatggataagatgaggatgtcccactgctggttggttagtacatttttgtagatgaagcaaagcacatctgttcttatacagaatctcatctttaaaagggacctcagatagcatctaattcaaaaactcatctaatgcagtgcagtattcctctaagatacatacataaatgctggctaaatgcccccagggatggaagtttactgcctcacaaggcagccaattatctttctgacaggtgccattcttcctaatactgaggtaaagtccattgttctttagcttccacaaaaagcagtgataatactcttgacggcttgccctgtgccagggtctgtgccaaggagcttcatatgcattgtttgtaacacttgcaacattagtggcaggcagggatcatcctgcacattttacaggtgagggaactggcacaaggtcacacagctaagagagaaggatctagtctggctaaatccaatgcctaggccaatttcttgacaccatgcataattcctgtttcaaatttctatatgtgaaggcaccttttagactcttctgttttctcattgatttctcatatggcatgccttccaatgctttcagaatatgctatgacagtatctctataaaaatataaatcaatacaaaagttattgacccctagaaaatgacaatcacatacttcaattaaaatgagtagtacaaagagacttccttgaatcttttaataatggcatttatttttacataataacagcagcatattggttaagacatggatttaggtagatttgacacctggtttcaacattcattagctgtcagattcggggcattttatctaacttctcaaattatcagtttctcacttacaatgtggggatgatgatgatgcctatgttttagaattgtgagacttgacatagtacatataaagcacttagtatgatgctggcactatcttcaataaatggtattattatttctttatttgcagcaaaccaaaacccgtatgattgttgtcaagtaagacttcccctacatcatgtttgtaaattagaatgttagctataattataagaaattgaaaaattcatgttgtctaatcaatattacattttagccagtagtttcagccaggatcttggttctctcattaaatatactggtaatctttttcaattttgtgtcacctgcaattgttaaacatattttcagtatctttatccaagttgttgctaaaagtgattgaacagggaaatcaatgtttgttcccatctgtgggtgctgttaacagcttcgtatgtgtgttttacagtcacatatgtaattttccctgtgcttttctgtctatatcatacacttgttgtatcccctagtgatctctgaagttttaagctgtctttgacctatgattctgtacatctcctgatattgacatagctgaatctattaactaacttctaaaatggaaaccaggacacctggggctcagcactagcctttccccagtgtacttaagccctctgtggctccatttttcatacttttaaaactgagcaaatatttgccctctccttcctttcaatgatatggtgaaaatgaatttaaagcaattataaaaaggacatgtgttcttataattggtagcatatcatttacagagaaattcctcatctggtcactatctaagtagctaaacaactaaacattagcaagagaagtctttgagcagtcaatgtaaatgacaccaagtctatgcatttatcatgtgctttactcatagactcatacttattcacagtcccattacatacacacatctaacaagcttgtttatttcatttcccagtccacagccaaatagaggaagaaagtggatggagactgcccaaagtgggtaaattgaaagtagcaagaaaaggccaggtgcggtggctcatgcctgtaatcccagcactttgggaggccgaggcgggcagatcacgaggtcaggagtttgagaccagcctgaccaacatagtgaaaccctgtctctattaaaaatacaaaaaattagacaggcgtagtggcgtgcacctgtaatcccagctacttgggaggctgaggcaggagaattgcttgaacctgggaggtggaggttgaactgagccgagatcgcaccattgtactccagtctgggcgacagtgcgagactccatctcaaaaaaaaaaaaaaaaaaaaaaagtagcaagaaaataatcattttgaaaggtgaaaaaaaaaaagacaagagaattataaaaattagaaactcaaaaagtaaagaagcctgagaccactaattaaaggggaaagatagccttaaacatcagttttcaagaacattactgaattacaagttaatactataattgatgttcaaaatgattattcattattgtgttggacttccgtgttttcacatgctcagcattcattctgctctcctctggaggcagcactatgatttttcttcagaaaattacccttcccaatttgtattctgttccaaaggaaccatcatgtaaggagctttcccatctcctgaacaaggctgagcttatggtccaagacaagtcagtcacctttttgcaggaatttggatgttgagcagagccaacacaaagctactgggctggctcatccttatggtggtatcctgaattcttcccttccacgtagaaccctggagctgcatggtccctgaccttttcaagactggttgtccaattttcttttaatttggaagactactttaaaacattctaataaaatatgttagtcaaaggtggtctttggctgctcacagcttgtgtttcataactgacacagattcattaaagggatcaattttgttctatatgcagtgttcaaaaagccacagatatttgtaataaaaattaaaaataggccaggcatggtggctaacacctgtaatcccagcactttgggaggcagaggcaggaggatcacttgagcccaccattacgaaaccagcttagacaacatagtgaaaccccatctgtacaaaaatacaaacatttagctgggcatggtggtgtgtgcctgtaatccctgctgctcgggaggcttgaggtgggaggattgcctgagcccaggaggttgagtctgcagtgagccatgatcacgccactgcactccagcctgggtgacagaacgagaccctgtgttaaaacaaacaaaacaaaaaaccccccaaattaaaaatatttccatccaacttggttaaaatagaattgaaaacctttagcattaaagggatgtttccattataaataagttactaatttcctaaccatactagatgaatgagttgttattgcatacaaatccaaaaattattacattttattgtagcttgaatatatcttggtgaactcattttcttagagtggctctggttagctctttattaaaatgacaactgatgtcacagaagctgcctgaggacacatctaaaatgaacatgcttttagtggtggttaaaatactttgaacagtcaacaaatatttacagctctttttgtgtaacgtgctgtactaagtgctgggataaagcagtgaacggggtggacatagcctcagaactcccggagcttgtggtccaatagctcagtaaaggtctactgaatgaaagggagacttccctttgctcacaatgaggtcattcctcatgtttttgccaatgtatttttcctgcctggataatccaccctctgacctttatccacatcctttacccatttctttttcaaggtccagatcaaacagcaagttctccactaagcctctaacaataataacactgatggcagctaaacatttattgagcctgatgctaacctctttacatggattacataactcatttctcacaatgcactatgagatatttacatataattcttcagtaacccaattgaggggaattgcagggcaattaaaaaatacgtataacttaaaatgttgaactcagcatgcccagaactactagaatctttttgagcatagaacttaaaatgtaaggtgcgaagaaaacaattttatattttactgtgcctcagaattgcttggtggggtcttttaagaaataaagatgccagagtacattgtcaaaatttccaactaattaaaaacacacaagcacacatatgcagaacacagtacagaaaattgccgcaaatatcttctaaagataaccacaaattgcactttatgtgtttccattcagtttttcttctttttttgtagctataatcttttagacataattttaggataggtatcaccttatcagtgagatctttccttacccacctccattccctgtcctcattactgcttaagttttctccaaagaatttcttaccttctatttattaattactttttaatttactttgcttcctcagagtaacttatctccccacctccccgtggccccacttccacatacatactagaatgtcagctccataagggcagagatttttgtctactttgctcacttcagtatctacagtcgttaacagagtgcctggcatggagaggtagcttagtatctctttgtccaatgatggatacctgaatgaatacaactgtcaaagtgcccttcagaaatgctgtactatttccacttctacacgaagggtaaggcagtgccatgtggaaggtatatttttaatgggtgggaccttgagtcatcccttgaatgccacctgggatctctgtggcaggcacttgcaacaccaaaggagtgtacactgtgcctggggccaagggcaggtgccatacacaagtgcaaggccatactgaagaggccacctgccctcaaatgggttcaacaggaatgctttttaaagcaatgccccaaaattggttttagcacttgattgtataacctgaccacattatgagttctggaatttgttcagggctgtgtcctgtttcctttagatcacatctttctctcacccagattgcctaatttttgaacttttaaagagcagagtactgctttcagtgctatttagtcatttcccacagctcttcatccctttagagtagcttttatagttacttgggccattttgggtagtggacattggattactatttttgttcaaccaaataaatggaaggcttcttagtattattaatgctcaaaacatgcaacccacactcctattatgcaattgaatattgttttgaagtcatcctgtaattacaagatttccttccaaatcagacaataggtctgaaagtagtaattttgacctaaatatgtgcaagagcttgaagggcttcttataaaaactaagaggaagaccaagtttagtggaaaaacacccaggctaggatttgggagacctgggtcccactgacatctctgccaattattggctctccaagtccccctttggttgggtaatggggccgtccatcctaactcactctattatgtggaatataaatatgggaatcacaatgaaaactgtaaaattatattacatctaaaaggctgccatgttttcttaaacactggttaattatggtaggtagaaagaggtcttttgaaggcttttagagctcattttcccaaattgttttgtgtggacctctgcttcagggagatgtatttagtcagcttttgctgcatgccaacttcaatatcaaagtggctcatattccatacacattcctatgcttgctcgtctgcagttcagttagagttcagtcctgaagtttaagttgaaaggaagaaacttgatcttagtgggtacttaatctgttcagctcactaaaaacaaaaacaaaaacagctcagttgtatggaaggagcatgttaaccacaaaaagtaggggtagaccagaaagaagtaagctagaaggtgggttttggaatgagatcagcgccagtgaatctacccttcagttctagatttgagaaaagtagtcaaccaccataccaatgggcaacaagtaggaccaatggaaactgtactcaccccacctgttgaaaacctggagtttgagtaggtcttgccttgtgtaagaaggagtggagaagaaaaaaatcacaccctacatttggtcagggccaaacaagattgaggacaaatagaactttgtgttaaaatacttgtcccaggtccagtttcgttttgcaggattcagaaagagttgtgtttgtttaatacagtcttataaagaatttccaatcccagaggattcatgaagcaaagtgatgctacagcttccacggtgtgtatgtcagagcaggcaggattttggagattgtatatcccaacactgtaattttacaaatggaaaaaggcacagggaggaaaataaagctcaggattattcagttggaggagatagaaatgcacctaagtcccatagctcttagtacaggacatatttttttttacaatagcagcagcagcagcattattaaataatgatcatggaacatttatgaatctaggcatagttctaagtattctatatggattatgacttttatgccttataatagcccatagaggtacacttcccctttgtacaggtgaggaaaccgagagaggcagagaggttaataaacttgtccccagagtaacatgtaagaaaatgatagagataggacatatcatgaagcaatttccaaagcgtatctggcatataccagcttcgcttccagagacatctacctgaccagaggtagagcagtagtttacacttcttcacttgttcagacaataaagaaaatgggttttgaggaagccctgtatgcctttctaaaagtgctttctaagacagagtacatatttcctgatcttctgtatatccgtcatcaaactcaactgtcatcttcttaatgccaggtagatactaaaccacaaatcctccaaaacaactgggcagaaagtagaagacaatcagcagcattcactgctttctaagaaggcaattcccaggaatacagtcctgaaggtttaagttgaaaaagaaacttgatcttagtaggtatgtaatcagtttagctcactaaaaacaaaacaaaacaagacaaaaaacaaacaaacaaacaaacaaaaaaacaactctgtcaggtggaaggaacgtgaaacgtgttaacccatgaaaaacagaagcaggccagaaggaagccagctagaatctagggtttagaatgcgagcagtgcctgtcaatctacccttcagttctagatttgagaaaagtagtcaaccaccacaccaatggacaatgagcaggaccaacagaaactccatccacctacctattgaaaacctggagctttaataggtcttgccttgttcaagaagtagagaagaaaaataaaacaattcctatggtagaaaaaaaaaagatactgtgcaacaaagaaaaaccgtatcgagatggtttttgaggaagaatacacatgtgaaaaccagctagtctgggatccagaaaaatatttaagaaatagtctggcatcctcagaaaagtacaagaagatatggtgtctatgaaccaggagctgcatggagacagatgtatccagtaaggactagagtgaagctaagatataatggaagggagacaaaacactccctatctctggaaacaaaataaaatggaatacagggtgccagttaacccttgcagtaaatgataatttaaaaggaaaatacaaaatacccacaggtgaatgataacgaaagtatctcatatcaaaatttactggaagtcgctaaggcagaggaaatttataggtttgagtagattttctgtttttcctatttatttatatattaaagatatatacatgaggatatttatccccattttacaaaagaggaaaaagaagctaagagaagttgagtagcttgtcaaagttcacactaccagtaatagcagagccaggatctgaaccaggaggtctggttcactcttaataagacagaaaaatctctagcaaggttaagaaaaaaagaaaagatatgaataagcaaaatacatgataaagagagaaagaaaaaaatgttttgaacaactagcttacactccaataaatacgtatatattagtttcctagagctcttataacaaaataccatagactgagtggcttaagcaacagaaatgcattttctcacagctttggaggctagaagtctaagatcaaggtgttggtaggtttggtttcccctgaggcctctctccttggcttgcagatgactgactgccttcctactgtatcctcacgtggtctttcttctgtgtgcaggcatgcctgctgtcacatgtatctccttataacaacagcaggcaggttagatttgggcccaccctaacagcctcattttaacataatcacctctctgaaggccctatctctaaatacagtcacaattcgaggaattgaggattaagactttatatgaattttctaggaatatgattcagcccataacagtctagaaaagtgggtttcggggaaaaaaaacccacaacttcccagcataaatgtgaaatagaaaattaaatacaccaataatataacatgattattaatcctttccttttactaccacattcctagtagatagagactgtggttgttttacaggtgagtccaaacacactttccaaggaacagaaaatccctatattactttagttgtatcagaaaataaaagataagaaaaagttgcccaactcatttcattctaaaagtggattgaataggtataataaataaaagtaaattatagaccaatgtttaagacataggtacaaaaatcccagactttatattatttaaaagtaattacagcaatatgtataggaattaatacatcattatcaagttcaatttattccaggtatgtaaatatacttcaactttggtacaagtttggtacaacttcagacacattatctttcaggtaatttgctaatgttactaaaaaaaaaaaaacaccccagaagaaaagttaaaaccctaaacaaaaacaagaaaaagaagagtataagaattagaagaaaaaagaggaaattagcattttagaaattttatatgatgatttaatatggaacacctacaacaagctacagatacattactaaaattgattaaaaagtttagataagttgttggataaaaatcaatatacaaatacattgtatttctatacaacagcaacaaagctctaaaagagctgaaattaaaagttacaatttaatttacaatggcaattttacacatacacacacacacacacacacaccagggaatgagctgaaaaaataaagaccttaatggagacaattattaaatttattaaaagatattaaaaataccagaattaatagaagatatatcatatgtatgaatttgtagacaaaatattttgagatgctgtatctactcaaatggaacaatatattcaatgggattaaaatatgtatctgaaggcaatctgtgttgtactaaaaagcttgaaatgacaaagcttgaaagctggttctaaaatttatatagatgacttgagggtctgagaatgacccaaattgtcctgaaaaagatgaagcaaattttattattaagcttattaaataagaagtgagtgagtgactggtatgaggactaagggaccaagggagcaatggaacataacaaacttggtatgtgacagaggtggcattgctgaaaaccagtgaaatgagggaattggtcaacatatggggttgaaataattggttacttacatggaagaagtggaattggatgttcactttaccatgaacatagatatcaattccatgtctattaaaaatgtaaatgtgaggctgggtgcgatggctcaagcctgtaatcccagcactttgggaggccaaggcaggcgtatcacaaggtcaggagttcgagaccagcttggccaatatggtgaaaccctgtctctactaaagatacaaaaaaattagccaggcgtggtggcacacacctgtaatcccaactacttgggaggctgaggcaggagaattacttgaacctgggaggtggaggttgcagtgagccgagattgtgccactacactccagcctgggtgacagagtgagactctgtctcaaaaaaaaaaaaaaaaagtaaatgtggaaggtaaaagtctacaaagggagtatctgtgacttggggcagggaaatattgcttagacaaaacacaaagcgcacaaaccataaagagaaagattggtaaatttgagcacattaagaacctctgttcatcaggagacactgtaaggacagcagaaagcagacttggagaatgttgtgtgtgtgtgcgtgtgtgtatctagcaaataattagtattcagatatacaaatcaatattgatttttctacaaatcaataagaaaaagacaataccatggacatgttctcaaactccttagtaatcttggaaatgaaaattaaaacgacaatgtatcaccatttcctacctatcagattggaaaaatacaacctgatattacaaaaaactgttgatgtaggacaatgagaaccttagacaatgatagattcagcatggaattaacctaaaggaataaggcctgtctcctaagtttttgagggagttacgatatcacaacaaccttaggcttgtgtggcatcagcctgtgaatattaacttatatcaaggccaccgctataaaatcaaagtccttaaaatgccctaccaggacttggtatgtatgatctggttctcccttgcttctctaatctcacttgttactactttcccatcactcttgccatcctcagtccttggaagtatttctcgattattcttttatatttgccattccctcttaccggaatatccatcctccagatatccacatggctctgtctcttcattcattctagtgcctgctgaaaggtcatctttttaagatgatttctctgataattttatctgaaaagtgaccacccatcctacttgtcactatcttcttccttgtttttttttctttataaccttcatcatgactttacattttaaatttttaattttttcccttctctccttttttttttgagataaagtcttgctctgttgtctaggctggagtgcagtggcacagtcatagatcactgcagggtaattttaaattttttgtagaggtagggtcttgttacattgcccaggctggtctcgaacccctagcttcaagagatcctcttgcctcggccttccaaagtgctgggattaaaagcaccagtcactgtgcctggcctttacacttttttattgtgtgtttgtatccgtccactaggctactattgcgatacccctagttcccagattacttggcccatagtaggagcttaatatttgtgtaatcaggggacatgaaattccttataagctcttatttaatagaattaacaaaatattttacttctagattttaaaatctaatttactaacatcatttgggaattttgttacatatacatgcctcccacacttttttttttaaaaaagagttcgtttatcacacacttgttttttaaactaatgatttgctttcaagtcagtgttgtcacacgtccaaggttttcctacattctggtcaatatttattctattgtggactgtacaaagagagcgtcatcagttgttcttttaacactgagacttgtcaatatgaactaggaaagaatgatgataaagaacaccgaaggtacaggaggactctgggtgaggcatagtgccatcagatcagaatcctgagtatttcatgcaactgaaaagcctctggcttcaataataactcatggggaaggaaagttgttccacacccaaagagatcatattttgtaacaagccaatgagatcaagatttgtttaggtcaatttcagagcaaacataggttatcagatgcatccttcaatatggtttactagaatctgaaaattgcatgcttcttttgaagaaaaggatggttaaaggatactgctatgatttttattctgaaattcatcacaatactgtatatgtttataaggaaatctgctatctggtcagtgaaaggaactatctttcagacaactaaattcatgtttgtttcatatgaccaaaaatgcagacagaagccggatagtaaagatgccaggcagagagaatacacttgaagtagttggaaactacttgggtttaaattattggttgaaatctactggggttcaaattccatccatgccactcactgtttgacattgatcaatttagctaactcctctaagtctcaatcttttcatccataaagcatttcttcatctataaaacagggaagagtaatgagaaaattcagataaagcagtcaacacacgttcataattatgttaatttacaactaacgtatcttgaatgcttaccatgggccaggcactgactgggctaagtgccttatgtatatttttttcttttttaatcattatgtgcagtaggtgttgtgattatatcctttttacaaatgaaataaaaggcaaagatgagggagccaggacccaaaccctctgccctgtggtgggccccaaagtctgcatttgaaattcttggctttcttgcatctttctgttgccatagagagcatcaccatcaccttttagataggaggtggggttcagatgatcttcaaggttgcttacataaatcttttcttgttgtcacatgcagacacacaaactctctctctctctctttctgagaggtcagcccattttcctgtctgctacaagttgtgccattttcagtattgttctaaaatcagattagtcacaatagatcctatagtgcttccattaccaatttgtacagtcagtctacaatattgcttataaaaatgttcttttggagccattgtgggtctctttgaacatttctgcaatgttgtctgtacagacagtacatccaagaagaatgaggatggggaatgacgtaattaagcctgttgggaagctctctctctaaggtgaactggagtgtcagatggagttacggtgcttctgaacaccattccccaaagctccattttggaatcttagatttaaaaggcactttagcaaatactgtaaaccttttctctcatgctgaattactttggtaatattcttcatagttatctccacttgctgtagttggagagggaagcacaatcttctgggaattttaactttatttctggaatctactaacagatagttcattcagccgtttttctttatgcaactttcattctctgatgtgagttctgcctttgaaagcagaacagaatagatatatattttattcatgaaaaactttaaaatttgaaggtaacagtcaaatttcactcatgaggcagggattgggtctcattttgtgctccattataaccatagcacctagcgctgtgtaggaaatatagttggtactcattaaatttcttgatgaatgactaaatgagttctctcttttctccactagagtgactgaaagaaagtattatatttctttgacatgtgaagcataaaatgtgaccattaactcttctcaaatgtgagctccatgtggtgaaggaccacatatcatatgtaagcaggtaaattcatgattgagtgaataaatcctgaatgctgctctagtagtggttgtaacgttttaccctgccacacttggccatgacttgttggagaaaaggtaaatatctgatttaatctgggccaatcaaattcctctcctgggtatttggaattaagacctatctctggggagatgagctgaaagttccaacactaaggctgaaagtgaggactagttaaagcctcatggaggctaacatttctaggagaaccaagagtaacaaagatgagagacacgtgacctcagggagaacatgaggtgggccatatggctgtccagatacctgatggctttccagcccgtggctccagtttccatgatggtcagctgttcttcatttctttgagatctctgaatccttacaataatcaccgtcccaccctgacagaaaaacagagaaacacacacatgtgctgttattgaaggttgcctatgttagttctgttcctaccactctataaaacagtttattcaatctaatataacactaattcttgactcatattctgcacacagataactaaaacacccagatcttttcacacaaactgcagtttaaccaattgtataatagaatttttggaaagtttgctcattcacccattcattcaacaacaatatattaagcaactactgtatgtgaatggactttttatagtttttactatttgtctgtcagttgtcactttttgctgctgcgaaggatgttgtcttttctttccatttacttattagcagtggaattgagtaatgatgagtaaaataaaagctcgtaagctctgaatgtgggcactacatgatgtttgtcatatctattttgagtgtggaaagaacattttgcctactgtctgtttccctcttagattctgggttgttgtaggtatagtaagtaaatattggatacttgaattgttatgtgtggttttatatatacatttatatgcatatatcttatataaatttaaatctaaatatatatacatagctaggaaaaaacaaagtaaggttgtaccagagtaaagaaaagttgaccatatttaaataaataaatgtgattacatttacagaccagcagatgtacttgggactgtcacctctgtgtatcttgaataaaactgaaggttaaacttgtcccttcattgggctttaaattaaaaaatttttttttaaaattatcttaggtacataataggtatatatatatttatgggcacatgtgatattttgatacaggctacaatgtgtaacacctcagggtaattggggtatgcatcacttcaagcatgtattatttctttgtgttaggaacattccaattccactctttttctttctttctttctttccttttctttctttcttttttcgtctttcttttctgtttttcttttgctctccttccttcctttctttctctctttctttccttctctctttctttcatctttctttcttctccttccttccttcctttctctttctttctttgtttctttctttcctctttctttccctccctctctccctccctctctcttcctttctttccttctttctttctctttctttctttctttctttccctccctccctctccttccttccttccttcctttctttctttctttctttctttctttctttctttctttctttctttctttctctctctctctctctctttctttctttctttctttctttctttcttttctttctctttcctctttctttccctccctctctctctctctctttctctttctctttttttctttcttcttcttcttcttttttttaacaggatctcattccatcaccctggctggagtacagtggcatgattatggctcactacagcattgaatcaacctcctgggctggagcaatcctcccatctcagcctcccaagtagctgggactacaggtgcacaccactgtacctggctaatttttgtattttttgagacagggttttcttatgttgcccaggttggtgtcaaactcctgagctcaagcggtctgcttgcctcagcctcccaaagtgctaggattacaggtgtgagccaccatgcccagcctagttattaaaaaatatacaattaattattgttgactatagtcaccctgttgtgctaccaaatactagatcttattcattctatctaagtttatttttgcacctattactcatttccccaccccctaccactcccaccctgctatccttcccagcctctgctaatcatccttctactctctatctcaatgggttcaattgctttaacttttagctcccacatgtgagtgagaacatgagaagtttgtctttctgtgcctggcttatttcaccgaatataatgtcttccagtttcatctatgttgttgcaaatgacaggattttgttcttttttattgctgaataatacttcattatgtatatgtaccacattttctttatttgttcatctgttgatggacacttaggttgataccaaatcttggctactatgaatagtgctgcaataagcatgtgagtgcagatatctcttcaacatactgatttcctttcttttggatatttacctagcagtaggattgctagatcatgtagtagttctatagttttccaaggaactttcatattgtttgccatagtggctgtactaattgacattcccatcaacagtgtatagggactccccttttgccacatcctcaccagcatttgttactgtctgtcttttggataaaaacctttttaactacagtggaatggtatctcattgcacttttgatttgcattactctgatgatcaatgttgttgagtatttttttatatacctgttggccatctgtatgtcttcatttgggaaatttttattacagatgttttgcccatttgtaaattggattatttgattttcctcctatagagttgtttgagttacttatatatttgggtattaatcccttgtcagatggatagtttgcaaatattttctcccattctgtgggttgtcacttcactttgttgtttctcttgccacatagaagctttttagcttgatgtgatctcatttttccattttcactttggttgcctgatcttttgaggtattactcaagaaatagttgccaagaccaatgtcctggagaatttccccacattcattgggcttttagttaatctcctccatcccactctttacttcaaccaaatcaaccaacatttaaacactcattttcaagctgcttttctgtaattccaatttgttgggatttccctggcccctatcacttgtgagttcagttttatgggtgagaggggacttgataaagaaggcacaatttttttttcataccccaaatgccagggcaataagccaagtttatacttgatgcgtcctccattttcattagcaatagaaacagtatagtgctactaaggtcaggggtttgaaccctggctctgctacctttcaggtatgcaatctttcggaaattctcttaatttctttgagcttcagtttcttatttctaaaagataattaatactaccagattatagtgattactgtgagggctaaaagacttaatgactacaaaatactcagcacagtccctggcacctagtaaatatccaataggtcatcgcttccagtgttgtttttattactgggggatgctgctgtccacgtaccaaaagagaactgtaaaaaacagcttgcaaagtaagagaaggaagggaagtgttttaatgtgtaatggcacattacattttctggtaatcccaatgttactttaaaaaatcttaaaaatttgacagtggtagcacagtttatttagagccttgtcttggggataatatgaatttttctgggaggattatacataccaggcttcttttcctgtgagagcaaattcccttggacttcttaaatttctgttttcttggtgtagagactgttttctctaattcactgtgggttttctgaacttttccccgttcaatcctagtggtttcaatctgggctgttgtaagaatggcttttagaggaaagagatattagaaatgacagcttttcaagatgaaaaaggtgccttaagactccaaataattctgttataatttttcatttcttcttaagcattttacggaaaatggcccatcttgagtatttttatccttgggcctaaaaacaagttcttgttagccagcggctaggcctttgaagctgcagtgcttgtattttggtctccaccctcttggatgacttgtggaagtatcttccaagctccttcctgattgcgtttccccagtttcaactgagaaggagaaagaactgtgactatatcgatgatttcagaagtgtaaacaacttatcatgtttgtggaacactggataaccctcacaggggatgctgaggaatctggatgcccatggatttttaataatgggagagaatgctatttggaaatcagaggattgaatggatcttggattggatcttgaacacaagactccaactccaaaataaaaactgtgggctgaacaatatgcaattatatatgtggttgtataatgtgcttccatttccttactacaccctaacaaagtctttgttgctggcagggagatcagcctggccttaagaatctgcttctgctagttcagatgggaagtgattagtgtttgtcatatgcttaaaatcctttatgataaatggcacaggcagttattttcgtatgtacacagaatacatcacgaagatcaaagaactctaaccagaggccccatttccagctaacaggtctgagtctatttgggtttagattgtaaaacttcaggaaaatctaacgagcttatgttaccctgaacaagaaatgagatttcttagtaatacccactattgctaagtgactattaaggtagccaaatatcattctttacctatgctttagtttaaaatttcaaagagaggtatggtcagatttatccatgtgttcaatatctaagattttgtcttttaagggaaagcgctttctcctctgattttctgcctaggggaacctcaaggtatctatggcgtaaaagccaaacgtctgttttagcaaatagccagacattacagtggggagtatgtagatcatcttgattattttaccaaccatcagggcagagatggaaacattgtgagctgggaacattgagtttcatttttaccagtatccttgccttttagaaggtatctgttaggagtacttaaagtaaaatggattgtttctaaaattgtgagatgagctatagggcagcttttctacttaattagcttttgtcgttttgtgtttctgttgagaaaagctgagtgggacccaagctatccattcactgcagcatccaagttgcttagaatccttttagaatttagctaagaatactgtttctacccattccaaaaagtatagctagataatttgtaaattcaatttcatgttaattataaacaatttcttgtgctcctttctgtactgtgggtatttaccgagttcaaccatagcttatacctcatatgagaaagattaacaataaaaaatcttttctgtgcacaagtgggggtaaaagactcattatcttctctactttacccccagtgcacccaggctccaaactccagaatcatatattctttctccacttccaatctaatattaaatcatgttgatttttgtctcaacaatattttttgtttgtttttaatttttcattaccgttgtcattatcttagcttaggctctcttctttcatgaattaagcttttccttattatgcgtgaagttattaattgaacaaacacttattattcacctactaggtactaggtattagtaggtgggaataacagcaataatcaagataaaaccttatgttgggtacaatcttcttactcaagtcactgaaaagcctttaaataggtcctttatgtattttctctctctactccaaaacattaaaaacataattgcaaaactagttttatgtaatgcttcattatggcctgagatatcctaatagtgtggccatagtcttctttctagggttacttcatattattttcttaattttcccacattttagataaatgcatgtgttaggtatacgttaccatgattcctggcctttcgtatagcttcagtggttatgttattcttgttgtatgggaatgctttcctctccatctcatatgttaaaattcatccatcttttttttttttccaaaaaagtgaatatttatttatttattttaaatttaatttaattttaagttctgggatacatgtgcaggacgtgcagttttgttatataggtaaatctgtgccgcggtggtttgctgcccctatcaacccatcagctaggtattaatcgtccatcttttaaagctcactttaacttccacttttccatgaagcttttcctgatcttcctcctccttccatcctggaaaatccttgcagtttgttctgcagcatcacacctagtgtctagccatccctactttgtccctacactttttgaattgcttaccaacaacttagagagggagctagagattgttgctggccattgctccttgttttttctcttatttcaggtacttttttgtattttgtcgattcttcccggacgctgccagttttttgcccatctctgttctatttttactgcaactccacaccagttctggttctttggttttcctacttgttctcttagcatttgataattgattctccacaatagattttgaaataacttcttggatttttttctaaattaggtattacagggtaaggtcttgcttttgctccatattccagaatccaatcttgcctggggccaaacccatgccaggctttccctcttttttctcccaaggggatggggtggtcagtcaattatctttatagatatttttttcattaaaattaaaaaattcttaattgtggcaaaagacccataacataaaatttaccatcttaaccatatagttcaatagtgttaagtatattcacattgttgtacaaccaatctgcagaacttttttcatcttgagatctttctttacatttttaagcagtcatttatttacttgttttctcttgtatatcggaccaaaattttcttgaggacaaggctgtgttactgacttgtgtatcttttagtcaaactacctggtataatcaattaataattgtttcatgaatttgaattgaccctggcttccctgatgttctaatctaatgtgcactccacaggaaccctattctgtcaacagacctggattctgatatcaatgaaatagtgcacatcttgaaaacatttccactaatgtaaacaagaaagatgaaagtcaacagagtaagaagttggcacaaggagttgattccgtctgctttggaggttttgctttttggcttaactgttacatggtgctattgtttttgttctgggaggtgggacagtgctgctttatttattttaagaaggcagcaagccaggaacacataattgaaaggaaatttctgtactggcgtattattttttcaactaagatggcaataaataacttgcaacttccttttgtttgaagtggttgatatgaactagagtttaatcttatacactcataaaattgcacatggcaaatactttcacaattgctatttaaaaataggcctatatacttacacactactaataatgtgtccctttacatcatagccttacagcattaggggaaagtcattatctcccctcctcctatatctccaaatgttctctgagggcttacgtctcttatagtcacctcttgttctgacttctggattctcaaagttattttcctcacctgcattttgcttcttttggctgttctctctcctccactagcatgtaccccaaagcatcaatttttctttggtttctcaaaatatcacttaaggcagttgtctgtatgagatatttaacagagaaaaagctatcacaaaggtttactttatatcataatgctacagaaaaatttaaattggacttaggcacaagttcttaaactttcttagccactgtaaatattttatagactgacttctctcttcaatttctagggtctcctgccatatcactgatttctttccattcccttattgctaatctttggcgcctaatctcctgctaggtggttctggaaatatcacaacccttccaaacttaatatttctctagtctctatctatcatgacctggggctatgattccatagtcataatggcatttttttcactaaaaagataattatctcaaaatgagtcaaagacttaaatgtaagatctgaaactatgaagctatgagaagaaaacataagggaaatgctttaggatgttggtctgggcaaagattttatcaataagaccttaaaaaaacaagtagtaaaagcaaaaacagacaaattggagggttatatcaagtgaaaaagtttctgtacagcaaaggaaacaatcaacacagtgaagagacaatctacagaataggagaaaatgtttgcaacctatacatccgataaggggtcaatatccaaaatatacaaggagctgaaacaactcaatagcaaaaaaagccaataacccaaaagacctaaatagacatttctgaaaagaagatgtacagatggccaacagatggaagaaaaatgctaatatctctaatcatcagggaaatgcaaatcaaaaccatgataacatattacctcactcctgttagaatgactgttgtcaaaaagacaaaaggcaacaaggtttggtaactatgtgaagaaatgggaacccttaacacactgttggcaggaatttaaattagtgcagccattatagaaaacagtagggaggtgtcctaaaatattaaaactggaactatcatatgatccagcaatctcactactggatatttatccaaaggaaaggaaattagtatgttgaaaatatatctgcactcccatgtttattgcagtgctattcacaatagacaagatatggaatcaacctaagtgtccatcaacagatgaattgataaagaaaatgtggtatatgtatacatgagggactattattcaaccataaaaaagaaagaaatcctgtcatttgtggcaacatgaatgagcttggaggatatatgttaagtggaataagccaagcacagaacgacacacaccacaagatctcactcatatatggtagctaaaaaagttgatctcatagaattagagagtagaatagtggttatcagagcttgggatgggtaggggagtggaggatagggagacattggttaacaagtacagaattatggttaattaggaagaataagttcaagtgttctatagcacagtatgaagactatagttaacaacaatttattgtgtatttcaaaacagttagaagagagaattttgaatgttccaaatataaagaaatgataaatgagatgatggatatcacaattaccctgatatgatcattacacattgtatatacttgtatcaaaatatcagatgtatctcataaatatatacaattattatgtgtcaatcaattttttttaaaaagccacaataaagaaaatactttaccccaaagataattatctccttaagagaaaatttgttttaataaaaacttttattttagggccaggtatggtggcacatgcttataatcccaggactttgggaggccaaggcggtgggatggcttgagctgaggagttcgagaccagcctgggcaagttggcgaaaccctgtctctacaaaagaaaaccaaaaacaatagccaggtgtggttgcacgtgcctgtagtccctgccagttgggaggctgaggttggaggatggcttgagcttgggaggttgaggctgtagtgatcaaaccactgcattccagccttggccacagagtaagaccctctctcagaaaacaaaaacaaaaacaaaaaacacttttactttagaattgttttagatctaaagaaaaattacaaagattacaagaaagttcatgtgtactgtacactcagttttccctattattaacaatcttatatcctttctatcacattcctgacaaatagtaacatctgcttaaatacttccagtgactggcaacccagtatgtcttaatgagccccattgccagataactctagagcagtgtgacttgagatgtagtcctaggaccagcagcagcatccatacaacctgggagctgcttagaaatgaagagtctcagatctcattccagacctgaattagaatctacattcaacaggatctccaggtgattcatgtgcacatccaaatttgaaaagtattgctctagtgttcatatacatatatatatatatacacacacacacatatatgtatttttcccaaaagatggcaaccaaggtcttgcaatcacattgccccattcattaatttatctgtgtattcacaaaacatttcttaagagcatattatgtgatttaatttgaattttttttagaaaaaattatccctaccctaaaaattttcacattccagtcctgtcatgcaaaaggtagttgaatgaacagggtaatttttattcagaaaagagaggactaagtttgaagagctgaccctgaaagaaaagcaaattcagaaaaattcaggaaaagcttattctttataatatccattctttggtctcaactgggtttcttttaactttgtgtgcatctagtctgtttcttattccacatgacagctgttcagataatcgaaggcagaatccaagtttttacttggctggactcttcctagattgttcaaggctagacacccttcctgtcttgagctgtccaatagtaactttgtcctgcaggattgcttttacatgaatgtcagggtctgcaactgaaagattgatgaaagggaaggcaggctacctcatccctttgccctaatcgtaggtggaatgggaatgagagagaaagaacattatgagtgggttgtttatacactcaagcctcaggacatataaacaggatgaaaccacttatctcacccttactgactgttttctacagattgtggcattttcctgtatttgctcttctctcaggcacagctcttcaaacttagtcttctcttttctgaacaaaaattaccctgttcattcaactgccttttgcatggcaggactggaatgtgaaatttttgagagtagggataaggtcttatttaaaaaaaattcaagttaaatcagtgcttagcaatcatatgttcttaagaaatgttttgtgaatacacagatgaataaatgaatggggcaatgtgattgcaagaccttgcttgacatcttttgaaaacatcttagtgcgttactgtcccctgtccctgataaaatgtggcatcatgaattgagcagaatactccatatggtgtatgaatattgtaggatagtggtataattaatttccctaatttagaatttactttttgatgagttcagcctaataaagatgaaagagaatatgacccccatcattatggcggtctgtgtttagaaggccaaaatagacccctacaacgttgacttagcttatcagtaaggtagaatttgctttaaatggcaattttgagatttttcttgaggagctgaaaggctttacaagattaggaaggtcccccactggctaaataactgctgagggctttcccccttttctttccatcattctttgcttccttctttctctaactgcattgcaagccacttccctcacctgaaattactttttttttctgtaaatactattacaaaaaaaactgtaaaagagagtggtaaatgcagagtagatggataaacataatgacccaagaatgacgatggcgaaatatgacattttctggtgttgggtataataatgggtagagacggaggaatggaaaaaatagactagctcttttgccatggcaacaataagtgcatttattatataaacagaagaaggaaaggcatttatttggtccttgttccttttccctcctaattctcagtttctcctgttttttgtttagtttagattctcaaaagctggaagccagttaccttgcaaagacattgatcatttctttaaatacccaggtatatgcttgactccataatattttactgtttaaaaataaataaatgaatgttttctttaaaagctgattgaagaatagctcaagtcctcttttatcaaacatagaagaatgctctctttaaaagtttgcatctttatcttgagtcaataaccttacaagcaggaatcaaggcacagttttctttccaattgagtatcattagaacattgtctggttcattcatgtatgtctcaagggtaaatggccatcagcgagtctctgacagagaaatactaagtgatcctagtctaaaaggaaagccaatgtgcacttgagtagcagcattcactttacagagagttcaaagggcactttactatgtctaaatgccctttatgttctctggtgccagcaggaaaaggaaagctattaaatgcttataagagtgagacactgtattttaggacataggaaagatggggggaaatagatggcaaactaattgtaagtcaagaatatagcgagtttcccaaagagaattcctgcattttcaaaatattcttcttttttaagggtgtgtggggtgggtggcgtaaaatggaaaaatatgtaaagcctcatttaatatgttttctgaataatccaaaattttcaacatgagctgtaggttgggttgggttggggcaaatcgatgaggcaggagcctaaaattataccaaatttctggatataaatatcagccccaccattattagatatgtgaattccgggaagatacttaatgtctttgagtcccagccttcacgagtatacaattaggaggataaattccaccacggagaaatgttgtcaggtttagtgtagtaacatatataatgcagtcagtagggggcctggcatgtgttagggcttcaaaaataagaaccacatttccattcccactgtcccttaggatcaaatctgcagacatcttctttaggcatttaatacctcccagtattccttgtctacagctcatcgatgtttgtttaccccaagtatttgtataaaattttacacacaaccttcctaacttacatttaagactgtgccatttctgattttctagaaaagagttcagattccttatcacagcatttaaggacatccatgttctgaccctgacctagttgggctgtgtccccctccaactctcatgttaaattgtaatccccacatgtcaggggagggagcttgtgggaagtgattgggtcatggggttggatttcctgcatgctgctctcataatagtgaatgagttctcatgagatctgatggcttaaaaatatggcacttcctccattgctctccctttcctggtgccatgtaagatgcgccttgcttccccttcaccttctgccatgattgtaagtttcctgaggcctcctcagccatgtggaactgtgagtccattacacctcttttctttataaataacccagtctcaggtagttatttataacagtgtgaaaacagactaatacagacccccccaacaaataacatctcctttataaagaccctatgttatattggccagttcctcaatatgttctgaaatatttttcctccataatttcattcacttttcccctgactataatacagttgacccttaaacaacatgagtttgaacagtgcagtttcacttatacacagattttcctctgcatctgtcaccctgagagggtaagattaagcctaccttttcctcttccccctcagcctactcaacatgaagacagtgaggataagacctttatgatgatccatttccacttaatgaatagtaaatatattttgtctaacttacgattttctgaataacattttcttttctctagtttaacttactgtaagaatatagtatataatacatgtagcatacaaaatatgtgttaattgacaacattatttgtaaggcttttggttaacagtgggtaattagtaattaagtgcttggggagtcaaaagttatatgcaagtttctactgcacgaggtgttggcacccttaacccccacgttgttcaactataccttccatttctgcactttgaaaggttattctttaaattccagcatcaatgtcatgccctctatgaagtcttcctgaatactttggacagaagtgatttctgttcttctggaattgcctagtaattcctcataatattaataataaagttctatacattcgtataatgctcaaatcagtggacacttcctgatttagatatgatttaacctgcatagagtagttgacaatacaagtgactttccatccattttcctcctctgacttctgaaacattctggttttcttactacctatatggcttctctttctcagtcttctcagtgaatttattcatttcctaggactgcctttaaaacatactacaaactgggtggcttaaaacaacatgaatttattatctcagaattctggaggctagaagttcaaaatcaaggtgttgggagggccatactccctctgaagcctttaggggagaatatcccttgcctcttttagcttttggtagcctcaggcattccttgttctgtggcagcataactctaatctctgcctccattttcatgtggctgtcttccctctgtcactggtgtccttaaaagaagagaaacagacacaaggaggaaaaccttgtgtctgtttctcttcttataaggacactggtcatattggattaggtctcatcctaatcaacaatgacctctcatcctaatttgattacatctgcatagagcctattttcaaataaggtcacattcacaggtactaggggttaggacttgaacacatcttttggggggatacaattcaacccaaaacagtagcgttcccatttcttgcctctcccttaaatattaggtttcttcagagtgatttcttaggctcccttctctcagcaattatttaaataatgaggaaaactaaaatttggcagtgtcaaatatgtgaatcataaaacaggtgtaacacaagggtccaaggaggatattcgagatacagtgttctgatgcgtcctccttgaatgtgactatattcccttagcttttcctttagaaccacacttgaggtggtggagcctttaaaaatatttaacaaatgttacttttgaagaagagagtaagagtatttaataaggtaacattggcaatgtgaaagttatatgagatacataatcagtggtcctcatctttgtctccttcttaaagaaaacaagaggaaatgattgaccactggaagggtaatttttgtgggctgaattgtacattccccaaatttctatgttgaaaccccaacgcccagtacatcagaaggtaactgtatttggaggtagggccttgaaagagacaattaaattgaaatgaggctattaaggtgaaccctaatgtaatatgtcttatgaagtcatcataagacagggaaatttggacataccaagagactccaggtatgtgtgcacccagaggaaagaccatttgagaaaatgaccatctgtaaaccaaggagagaggttttaggagaaaccaagcctgctggcaccttgatcttggactttcagcccagaactgtaaaaaaacacatttctgatgtttaagccacccagactggcattttttttttatggcagcttagcaaacgaatacagcaatttttagttactgatttagtgactagtgtggtccagatgctattctgggtgctgacgatatagcttccctgtggagctgatgttctagcggatggagaaagggaataacaataaataagtaaaatatatgtcagatcagactaagtgctacagagaaaagaagtcagagaaatcatcatatagaaagttgcaattttatagttatgaagccttcattgtgaggctgaaattttaacaaatatctgaataagatgaggaagaggcagaggatcccaggtttaggaagtagcaagttcaaagaccctgatttgggattgtgtctgacatgttcaagagacaacatcaagaagccagtggggctgaaatgtatagagcctggggggagagtaacatgtcagagagaatgggggtgggggagctatggagctactggggactaacttgtagagaaaaccagtccccagaatgaagttaatacaaaaagaagggtgagcaggcaaaatgggggagggtatggatgagggagggagagagaaagagagagaaagagacagagagacaaagagaaagatgccagtctgaaaaggctacacactgtatgatttcattatttataggacattctggaaaggcaaaactatggaggcaacaaataaatcagacattactggggtttggggagagaggaaggttgaacaggtgaagcacaaaggatactctttgtaagtgatgaaaccattctgcatgataccataatggtgggtactcaacgccatgcatttatcaaaacccatagaactttacagtacagagtgaaacttaatgtatgaaaattgtaaaaaaaattatttctgaggtcagagggtcacagggtggaatatagaacatgactaaacaattaacaatgctacaaacatatgataaaacctcactgaagggactggcagaaaaagttgctagcctgaataactttagaaatgagcagagattgtaagactaaagggaaaaataattgtatgtaagcacggtaatctagttgataaagtctcccatgggggaacaggttaacaattctgaaaccatcatacatctaatctggaactgaagaattaagtaaatggaatgtggatagcaggaagcacgagccaggtttctcactgttgaagtgggagcttacaggaaagcatggggagaaggcaagaatgattcatatggttatggattagagttagagacatcagtatgaactcatgcttacattattataggtacagacgtttacatatagaaatatttatagatacgtatatatactgaagttagctacacacacacacacacacacacacacacacacacacattttgctctgtcagctgaagaggtcaagatacaaggatacacctaacaagtcagatctttgtttctaatactatttgttccaataaaaggaaccagggatccttagagagacggctgattctcaggaagcatacaatataagtctggagcatgttgtagtttcttaaaagaaagaagtacttaatacccacaatgatggagcacatcaaagggagactagagccaatgtaagcagttcctaatggcctacgctgggacgatttgagcaataagataaataaggtagcaatggattatgattcaggtatatatacaataaatattcctgtctacactgacataaataaacagtcgagtaagtaaacaaatagggaacaagatacatctcctgtgcaggagaatttcaaatagtttgtgaagctcttccatcctcaaggaggtagaacataactcctactctgtaagcatggatcgtgcatagtgatttccttccaaagagtaccatatggaaagcttagaaaagagtaactttaaagggtgaaacctgataaacactacctcagccaggtgatcaaggtcaatattaaagtggtaggtcatgttgatagtatgtactcttgtatgatgcaatggaaatgacacttaacttctgtggtcttcctctgcatgtaacaaacatcacactgcaatcctgagaaaagcattaagcaaatcacaattgaggggcattgtacaaaatatcagtacttcttaaaactgtcaaggccatcaaaaacaagaaaagtctgagaagttgtcatagccaagagcagtctacggtggcatgcgactgcaagtaatgcagcaccctggttgggatactggaacagaaaaatagtgtgaggttaataactactaaaatatgaataaagtatggacattaattaaaaattatgtaccaatattggttcattggttatgaccaatgcacctcacttatataggatagaaataataggggagattgggtgtgaagtatatgggaattctactatctttatcacttttctgagcatctaaatcttttaaaataaataaaaagtttattttaaaaaatctcattccaagttttaccccattccaattaaatcagaatttctagggtgtgagaagggatcagtattttttaaacatctcaagtgctgtcaacgtgcagcactggaaacctctgtagtagaagtccctgagctgtggtagctgttatattttggtactccttaattcatacaaaatgtcctgagctaaatgaaaatgttgtgtgttgcctccattttgtacctatgtgaagtcaaaattttaattatgagtatgataaaaataaagtactggaacatgttgcccatttgagcaccacttgatgttacactattggatattgagctcctaactgacaaatgtatcaagcatataattacaagcaatattacatcttaaaatgtctcgtaattttcctccaattgaaatgaaaaaaagaaaaaaggatatgacatgcatactctttcctctgtctgatccctatgctgtctgatcccacattaatatgctttggtggattccaccacgattccatttttctgccgttttttgaccttgtttgtactccaggaggctgactctatggactgcaatcctcaggcctccttgctctctgatttccagttaggtttaggcaagatggaggagacaggtatcatcgttttaacccaagtctttcccttcttcatcatggttctggcagtggctgcgtttgttgcaactccagctcccaccccctctggctcacacttggctctggaaacacagttgccttttctcaccccttcaaactaagagggagtaatggtttcctgctgttgctagtctctaggtaactcaccatcccttttttttttttttaactttactaatatctctgtaaattgtctctttactgaaatattttaactttttgagggtgtcatctgtttcctgataggctttctgactgatgcaattagtctatcattgtcaattctctggaaatgatgactctttctcccccacctctttttaagccaagataacgtcttgcctacttttctggccttaaaaatgttctttgttttgtgaaacaatgttgataatagcgaacattattttccctaaggccttatttggcaaaagtaagagctggcaaacatgctggttccccacatatttttgaaatttcattttcaaaactggagtctgggaaccattgacctaagtgagaattcaactttgaaacattaaggggattcagctatcattcactttaccacaagaatcttacaaatctgatgaaagttgccaatggctgtcacagtagacactcaagttaccgggattcagttgtttgcataacatattgtcccactcctggtaaagagggaagtagtatctgggaaaagtaggaggatcgataaaaattgaagtggttatttttgtatccactgacacagaaggagattttacagcacactatgttttgagtctcaaaaacacacgtattgcatttcactggagatctgatgggggaagggatggagaagaggaaaagagtgcatctgaaagttttagcaagaagttgcaaggactcttcaattaagtatggatgcagtgtgacagtgacttagaacttccatgttcacagatccagcgctgttaactttatactagtctaagtcttttttcttataaataattacaaaagctcattaagcaatacagactgggaactttttttttcctccaaattctagtttatttttaattgacaaatagtaattttataaatttatgggggtacaatatgatattctgatacatgtatactctgtgggatgatcaaatcaggctaattagcattatcagtcatttcaaatatttatcatttctttgtggtgagaacacttaaaatcctctcttagagattttgaaatatgcaatacattattattgcagtcagtatgctgtccaatagaacaccagaacttattcctaactgaaacttcgtatcagctgaacaatatctctcctttccctgtccacactctcacccactgccagcctttggttaccacctttttactctctgtttctatgagtttgactttttaagattccacataaaagtggggtatttgtctagccacgcctggcttatttcattttttttgagaccaagtcttgctctatcgcccaggctggagtgcagtggcgcaatcttggctcactgcaacctctgcctcctgggttcaaacgatcctcctgcttcagcctcccaagtagctgggattacaggcacccgccaccacgcctggttaatttttgtacttttagtagagacgggatttcaccatcttggccagggtagtctcgaactgctgaagtcaagtgatctgtctgcctcagcctcccaaagtgctgggatgataggtgtgagccaccatgcccaactgcttatttcacttaacataatgccctctaggttcattcatattgtcccaaatgacagagttttttaaaatgctgaatagtattccattgtgtgtgtgtgtgtgtgtgtgtatatatatatatacacatatatatgtatatatgtgtgtgtatatatatatacatatatatgtgtatatatatgtgtgtatatatatatatacacacacacacaacattaaaaaaaatccattcatttgttgatgaacacttaggttgtttccatatcttggctactgtgaataatgctgcaatgagcataggagtgcagacatctctttgacatatgatttcaattcttttgcatatacccagaggtagaatttctagatcataaggtaaatctatttttagttttcatatttttaaaacttcatactgtttttcaaaattgttttcaaaattgctgcacttaattgtaataccaccaacagtgtacaagggttccttctccacatacttgctaatacttatctttcgaaatagctgatctaacaggcatgaggtgatatcccattgtagttttaatatgcatttctctgataattagaaatgttgagcattttggtaaatgtatgtcttggccatttgtatgtcttctcctgagaaatgtctatggaaattctttgccagttttttcattgggttatttgttttcttgttattgagtagtttgagtttcttgtgtattttagatattagcctcttatccaatgtataacttaaaatactttttcccagtttatgggttgtttctttactcttttgagattttcctttattgtgcagagtttttagtttgacgcaatcccatctgtctatttttgcttttattgcctgtggttttggcattatagccaagaaatcattccccagaccaatgtcgtgaaacttttccctaggttttcttctagtagttttatagtttcaggtcctatgtttaagtctttaatccattttgagttgaatcttctataagggataaggtaatggtacattttgattattcttcatgtggatatccagttttcacaatatgatttattgaagagatgtcctttccccattgtgtgtgcttggtatctttgtcaaaaatcaattgactgtagatgtataggtttattcctgagctctctgtgctattctgttggtctatgtgtctgtttttatgccagtaccatgttgttttgattactataatttagtaatatattttgacatctgatagtgtgatgaccctggctttgacttttctttctggtcaagattgctttggctatttggggtcttttggacttcatacaaattttagaattttaaaaaatttctgtgaagaatgacattagcattttggtagggattgcaatgactctgtagattgctttgagtaatatggatgtttaaaaaatataaattcttccactccatgagcgcacaatatctttccatttatttgtataattttcaatttatttcatcaatgttttatagtttttggtatacagatcttccacttcctcggttaaattactcctaagtattttattttttttgatactaatgtaaatgggattgttttcctcgtttctttttcagttagtttatggtttgtctataggaatgctactgatttttgtaggttaattttgtatcctgcaactttactgagttagtttatgagttttattaatttttttggttaggtcttcaggattttccatctataagagcatgtcatcagcaaaaagagataattttacttctttctttccaatttggatgccttttacttcttttctcttgcctaattgctctggctaggacttcccgtactatgttgcataggagcggtgagagtggatatccttgccctgtttctgatcttagagaaaaatcttcagcgttcacaattgattgtgacattagctatgggtttggtgtgtatggcctttattgtgttgaggaacattctttctactctgaatttgttgagcgtttttatcatgaaaggatgtttaattctgtcaaacccttttctgcatctattatgatgatcatatgttttttgtccttcattctgtgggcatttttgtttattgatgttttcaattgaatgtgttttataatgtcaagtacatcaaatttagaacagaaagaaaaattttacagtatcttatgcttggatagggtacaagaaacagggcgtatgtttatcacagtttagtctccttgactttaaaattcttctgtgttgggaatatgaggtccttctttgttatgttatgttatatttaatattgagtgaaaaggaattaacacacaattgttttttaaatttttatctgtttaaaaacttcctttgtttttattctcattactttctgttttctgactttaccttaagaaaaacacagagcaatcttttccaattcatttttttcctttgtatacatttaaaagggagttttaaaagggctggatagcttggtcataaagaggagtttttctttaccattacaatccaaacacaagctgtcgtccacatggcatggaataattagagaactcaagaattttctttctcttgacatttctactacttaaacaaaataatggaaactgatttatttcttcctttatctggtgatggaaaccaccctatggaaaacctgggaatggtcagcactatgttttccactatgtggagagagttggtcagtaacaggaaatgaaactgactcatatggagaagcagagacaagagataggattactggtgattttagggttcccgaagaccatctacatatctcccattcctgttgcctgactgttgaaatttttctgattccatgaaataaaaattctcctttttggctaagctattattttgggtgggattctatagggtgcaagtggcaaaaatgtagctacaattagcttaagtaaaaagagggaattgaggagagatccttaggtaactcacagaattaaaggaagactggatcaattgagctttagcaaggcagaagcaagcactttagaagggactcagaacctagggccaagacttaggtaatgcagcagcacacttccctcacgtggcctttgctccttctttctggacactgtgctctctgtggaggaatactttgattaccttatgtgtttccaccagtactttatttaccccataaccctcatctattcattggcatttttatgtgcattgccacagaaggagacgttacagcacactgtgtttttgaatctcaaaagcgcagactaggattgaattcaggctctgaagattaagagagctatcccacgttagcgggaaaaggaaagccaaaagggaaagaaagacagctgagttggtaccactgggaaaggggccctgcacctagtagatgatactgtcactaggcaacacacagggggcatttgtgtttattgttttaaattgaatatgttttataatgtcaagtacagccaatctgtaattgaaacaaaaactttgaagtactctgtgaaattcatctctgaggactgaaccctctgggggaggagcaatagacactcccactgcaccccaccctgggtgacagagtgagaccctgtctcacaaaaaaaacaaaacaaaacacttattttagaattgttttagagctaaagaaaaattgcaaagatagtacagaaagttctcgtgtactgtacacccagtttcccctattattaacaatcttacattctttctgtcacatttctgacaaacagtaacatctgcttaaatacttccagtgactggcaacccagtgtgtcctaaagagccccattgtcagatgattctagagcagtgtgactagagatgtggttctaggaccaccaacatccacacaacctggaatctggttagaaatgaagagtctcagaccccaatccagacctgaatcagaatctacattcaataggatctccaggtaattcatgtggacatccaaatttgaaaagtattgctctagtgttcatatatatatgtatacacacacacacacacacacacacacacacacacacacacacgtgtatttttcccaaaagatggcaaccaaggtcttgcaatcacattgccccattcattaattcatctgtgtattcacaaaacattttttaagagcatatgtgctaagaactgatttaacttgaaactttttttagaagtaagatcttattcctacactaaaaaatttcacattccaattctgccatgcaagaggtagttgaatgaacagggtaatttttgttcagaaaagagaggactaagtttgaagagttgtccctgagagactagcaaatgcaggaaaatgccacaatctgtagaaaactatcacaacagctgagagaataacagagtagaaagagctactcccctttattccagatagagctaggggtggagagaaaacccctctgcaactcgggttagtgtattagtctgctctctaattgctgtaaagaaatacctgagactgggtaatttatagagaaaagaggttaaattgactcatggttctgcagactgtacaggaagcgtagtgacttctgcttctggggacgcctcaggaagcttccaatcatggcagaaggcaaacggggagcaagctgtttcacatggtgggagcaggaacaagagggtgaagggggagatgctacacacttttaaaccagcagatgttgtgagaactcactcattacagcgaggacagcaaagacccatgagagatttgcccccatgacccagacacctcccactcactaccacaagaacagcaccaaggggatggtgctaaactattcaatagaaactgcccccatgatccaatcacctccctccaggccccacctccaacactggggattacaactggacatgagatttgggcggggacacaaatctaaaccctatcaggtagcatggggcagtatgtaggaatagctgcgtgatgaaggtcctcagatctgaagcagcctcatggagttccaacttgcctcagcaaggtgtaggagcagtagactaattcctgagcctagcatagtcatgttgctgcgccttcacccaggtgcccagatcccagaatggtgctggagaacacttttcaatgcacttcagcagggcatcaggggccaggaaggagagtcattgatcctgaagtgacctttggcatggatccatgtagatcaacacttgaaaaacagacaggatgaggagggagatgccaaattcaacaaatgaccaaatatcagaacgtttgcttattctggccctgccttccttctgtcccgtgtcccttgcttaaaattagatgtgaactgaaggaaaagaaatgggagcctgaattcattgaggctgagtttctatcatctagtaaaacaggatctcattgaagaaattaagttcagttgcatgaaaaaattaagccacgctttctgatcatctgcttatgtgacctgaaatttaaattttgtcttctacttcagactgtgttcttatatgcggcagagaacctggctactagcagctgcagcttgcaactgcatatattcaccatctggaaggaaaaagctcttcacctccttgactcttacagcatggtgccctcatccaagctcctgtttgaaaagcttcagagaacaatcttgactggcctttttctagtcatgttctcatcctatttaccaattacagagttaggaatgtgagatactatgatggttccagcttggagctcttgctatgtggcctctgaagccagcatgctgtaactggtagctctgcctagatccatgtgcttggtgttagggaaggaacagtttctctgccaaaagggaataaatactttgatcagaggtagaggaggaggggaacaggctgataaaaacactgaactgcattatctaccttgtgtgcctatactaataaaggtttccttaatgtcacattgatatgatcaaagcaagaaactaaaattatgaacaagatactgactatgtcttttatgactcattagttcagaattagaacctgggctctggaaaaaaaataacacagccatttcattgtaaatttgtaaactttgcagcagtttaaccatgagagttggcatataggtcagggaataggcctggtgggttttgctgtcaaatcccattatactcctgcagagaataaagtgctttgtgcttcgtgaaaattggtttgtagtatgtgtgtaccaattatcaggattgtcagaaatgttggccaatttcctttcaggttcatagggacttaaatctgaaatacttctctacaaaaactttacttagctgcataattctgaaatagctttattctggccaactgcttatttataacagccttttcaggtaatattctaggagttatttctcaagatttattccctttatttttcttgatattctttcaggtgcaaggaaataaaaaataatttggcttatgtatacaatttggataattttgtagtttttcttacactgtgttgctcatttatgagaaataggcaaatagataaagaaaattcggttactgcatgaagtactgaaaaaatgtaaaaaaaattccttggggaagtcatattttagtccacgttctgttgttaattttaatcttggggttaagtaatttttgctcttggtatgagattataaacaaacaatccaattgacttgcctttcaactctgaacagtttcttgatcacagtgtaaatagctgcttgaatttcactgctgttacatagcttttcagatagtcaaggaaatatgattctgccatattcatgccagcagattccaaagggcaaggaaagatgtttcaacagatcaggagtctaaatgagttacacgttgagcaattggccagtgaagagccaccaacagtaactgggcagccccaggcctgtaggagcatctgaatggttctagttcccaggaagagcttccaaagaacacatggtcttacatagatattttcaaatagctgttttcctcccaattattttagtaaacctatgattgttgtagataaattagaaaagtaaatataaacaggaaaataaacttatgcattattccataatctgaagatgcctttgataacattttggtgtatagctcatcattttttcttatgcatatatattttaaaatccatttagattatgctgaatatataattcctataatatatgttctgtggtaatttagaataaaaatcccttcggtatgtgaatttaaaacaaattataggcatataatcattgtgaagtatctattcttcaaatcacttttttgttctttttagttatacaaatgggaaacagtaaaatttgccttttatacttgagtccaatatatattatttgagcaatttctaaatctaagatactgtcataaatactttaggaaatagcgaaacaacattaataagacataacatttgccctcagggcatttatatagggatacgcataagcaatcattagatgaatcagataatgtttcatgataaaatggaaaccaaataaatttataaacgatcatagaccttagatagcatggtcccaatctgggagattacaaggaatattttgttggatcttgacgtattggccaggatctcagccagcagatgatggtggtgggtgatggttgagggagggatgctgtggaatgaaggaataacattcaggatggcatagcatgaacaaaaccaggaagtgaaaataaatgcaaagatgctcttaagtcactgtgagttctctgctgaagcggaagaaaacactggtaaattaagttgacaatactctgagaacgaatttcagttccagacttagtttaaactttatcctgtaggcagtgcagagacacagatgcttttgagcaagtccgtaaaatggtcaaggctgtaccttaagaatatctcatggaaacttaaattcctagaaggaatgacaaaaccattttttgtgtaggtaagtgttcatataactgttctctaaacatctcatatttattttttaatataagttatagatacagttttatttttacttttgtaccccaagaataccttcttagaacttcttagaaaagcataaggatatcctgaagtattttaatgtctaaactttcttgttattagtatttgtttttctcaatttatggcttgacaatagagtgttcgtttgttctgtatgtatttgttcctcttgtctttctttcatagaatgcccctttcattcaaaaagcattaatggagcaactatatgagtagactatcgtattgtataatgagcactataaaaactgtgtgtcctggagaatttgggttaaattatctggctgggcctggagatagcactttagtaagatacattttgaatatcatgaaatttaaagaaaaaattgctagcacttaagatagtcaacttggttagttgatatcaattatcctgttaattaaggattttgaaactcagattctcctgatttgttgttcaatttcctttctaaaattttaaagtacttttcttttattgcttattagctatttggtttaactttaaattgctaaaactttttgaagaatgaaatgtattttacagttaccatttgcatttaatgtgtaaaattgattttaggctttcattaagtcaacttttatactcaaggtttagaattttccttgattacaggtggctcacacctgtaatctcagcactttgggaggctgaggcaggcggatcacaaggtcaggagattgagaccatcctggctaacatggtgaaaccctgtctctactaaaaatacaaaaaaattagccggattagcccggcgtggtggcacacacctgtaatcccagctacttgggaggctgaggcaggagaatcacttgaacccaggaggtggaggttgcagtgagccgagatcactccactgcactccagcctgggcgaaagagcgagactccgtctcaaaaaaaaacaaaccaaaccaaaccaaaccaaaaaaaactactttccattgctaaatgtgtttccggctcaagcagagatactggttgccatttactcaaataagcaagcctactaattatctgcaaatggcatgtcaagtgacccccaaaattaaacatctttatgtaaaaggttttctcttctaatgtttactttggtctcagaatccattatttaattaaacagttatattgtttatccagctaatgcaactcagtgcgtaagaaggcatttacttaaatctaagaatatacttgaatttttattgctattaattgtattggtgaattcttttgtaccatagcacctttcaagtttgaaaatgcagctcttttgctgttagatgtaagtgcctctgtacccatttcataaagactcatcacctattctgagaccttgattttgccaccccatcacccttttcccttccaaaggcaaggacaaaccagagcaattgtagcaacacgaaatcgcaaaagaaagacaaagcttcatggttctctttacaccataataaccgagcagtctcaaatctctcattaaattttagtgtttcgagtaatctcccatggtttttagatggtaatagtaatgtccttttacctctaccagtttgttccagacttctttgatattacaaatgggatacggtgtataaagctggtcaaagtcaagaaaactttggtaaatactcctgtaactatagatactggtggttcctgcagggtattggtattccagacctgaaagattcatacacaatcaatctgaaagtcagagcagagcaaatgcaccataagctgtgaagttacttagtggttctttgactgcttaactgagctggtgaaagtcagggcctgtgtatatatgtttaagtgataatctgcatcagttaattttcctgtttcagatttgccagttcaccctgaccatcttgaaaataagttatctctgatctctgtctgtatgttacttctctcccctcaccaacggagaacaaatgtgggcaaagtaagtaaagcaatcaccacctttggagggaagaattggtcatgttctatggatggtggatcaactctattgcggatactcagtaacatttttactctctaactcatcatttacacctcaaatcttttttatttaaatgctctgaagttgtagctttgaataatagtcttcgatgtggtaggggccttaatcaccatcattctagtctaactcgtctcccatcaaatcccatcctatgacattcctgatgaacataatttagcctctatttaaaaatatctatgatgaagagtgcattgtcttaccagaaagcccattccacttccaattgttgtgagagttagaaagttattcctcagttttggtttaaacctggctccctcttcattccacacattgacattagttcagtttacaggagctacatagaatagtctaccatattttcctcatgactgtctttccaatatgtgaagtgaactataattcttgccttcctcctaaatgtagttttctccaatttcatttggtatgcctattaaaatgcagagtcctgtttctccagaggtttttgttgattaggtttctggtaggcctaggatttctgtctgttttgtagtgtgatctgtgtttacatccgagtagttttatcaggctgtttcttgtctgtggaattttggaggtccaatagctttcttttgtcttgtactctatcctttaaatttcaaagtggcagtgtttccactggtttaaaattctcaagaatcttgtagttttcctgtgtatattagagaaattcactcctgaagaaaagaagcttgtttatagatttttcttagataatcttgtctctattttgggggtctgctgagaaggccgagggggtccatgagtcacctgtttaatctctttaaagagccttttgtgtgactgaatactgatttttatctttctgaggtaatagcaaaagtgttaccagccacacttctggctttttctctacaatgcacttttctggcagcgaatccttaatttttgctgataacattttaagtcatcaagtcctggccacttttggtttcaccgttctttccctaatttttatctttccttttacatcttactataagcagcgagaaaccaaaatgtgccttcaacactgcttgaaaatctcctcagctatatgcccaacttcattgtttacaaattctgctttccacataactgcaggacacaattctgccaagctttctatcactatgtaacaagtatcacccttcctccagtttccaataacacctttctcatttccacctgagtcctcactagcagccagcttttttcttttttctttttctcttttctttctttctttctttttctttctttctttctttctttctttctttctttctttctttctctctttctctgtttctttctttctctttcttctttcttctttttcttttctttttctctctctctttccttccttccttctttcttctttctttctctttctttctctttcttcttttcttttctttctttctctctctccttccttccttccttccttctctccttccttccatcctctgtgtctctctctccttccttccttccttccttccttccttccttccttccttcctttccttccttccttccttccgggtctcattttgtcacccagcctggagtgcagtggtgtgatctcagcctactgcaacctccacctcccaggctcaagaaattcccccacctcagtctcccaagtagctgggactacaggtgcacaccaccacaccctgctaatttttgtattttcagtagagactgggttttgccatgttgcccatgctggtctcaaacccctgggctcaagtgatccacctgcctgagcttcctaaaatgctgggatcacaggtgtgagccactgtgcctggtctccagcagccactttcatgtccgtatttctatcaatagcctgttaataatgatttaggtattctctagggtaatatatatttttctctaccttgcttctcacttccttctgaagaagcagagttgttaacatccatatttctactaaaagtctgtttaagatagccttctaactttctaacttagcagacttttagtagaaatatggattctaacaactctacttcctcagaaggaagtgagaaggtcttgatctgtcgcccaggctagaagtacagtggtgtgatcacagctcactgcagccttgacttttgagtttgagcaatcctcacacctcagcctcccaaatagctaaaattacaggtctgccccaccaagcctggctaatttacaaaaaaaaatgttttttttgttttgttttgtttttgttttttgagatggagtctcgctctgttgcccaggctggagtgagtggcatgatctcagctcactgcaacctccacctcctgggttcatgccattctcctgcctcagcctcccaagtagctgggactacaggggcctgccaccacgcccggctaattttttgtattttaagtagagacggggtttcaccgtgttagccagaatggtctcgatctcctgacctcgtgatctgccagccttggcctcccaaagtgctgagattacaggcatgagccacagcacctggccaaaaaaatgttttttaaatatagggtcttgctatgatgcccaggctggtcttgaactcctaggccttaagtgatgctcctgccttggactcccaaagtgttgggattacaggagtgagccaccatgcctggacttaaccggtttgcccagagaatacccaccagtggcgtctgtagctgtagcatttaccccaagataactttgccaagaaatatgcttttattattattttcgcatccctctggtatattgacttcagaaacaaaagacatcactctattgatcacattctgtttttagtagtgatatttccatttacaaaatatagtaattctcaatccctgaaaatgtcaaatcctagaaaatgtggcattcctatgaatgatgttaacatcattattgaagagttgtttgccaagaccagctcggctggggagaccctaacccagcggcgctagaagaattaaagacacacacacagaaatattgcatgtggagtggaaaatcaggggtctcagccttcagagctgagaacctcgaacagagatttacccacatacttattgacagcaagccagtgataagcattgtttctatagattatagattaactaaaagcatttcttatgggaaataaagggattggctgaagtaaagggatgggttgggctagttatctgcagcatgaatatgtccttaaggcacagatcgctcatgctattgcttgtggtttaagaacgcctttaagtggtttttggccctgggtgggccaggtgttccttgctctcattccggtaaacccacaaccttcagcatgggtgtcatggctatcacaaacatgtcacagtgctgcagagattttgcttatggccagttttggggccagtttatggccagatttgggggcctgttcccaacagttgttggccaaagattcatttgattaacctgatttttccgtaacagacgattccgatgattctggtgttagctctgtttagaaataactccaagaacagtttttatattttattttcacattgaaaatcagtcagatttgcttcagcctcaaagaatgtgtctaatgaaaattaaatgagcgctggcagtgagctgcacttttctttttctaaatggaaaaagggttaaggccttttgtctgatcgaaaacccttaaaacagccatctgactcaaaggcctgacagaaccaggcccaccatgattatctaggataatctcttgcatgtacagtcaactgattatggactttaatgacatctagcgactcctggattagtgtttgattatgtaattggggactgcagcctagccatactgatacatcaaaaagactgtcacggtgtcttctatcacttattccattaaccaaagctgccacctcacataacacaataatttattttcacttgaacatttaggttttaaagggacttattctcagagacatgttaggaatcaaaatagaaatagttccatatcattggctcattgaacacaatagttcttgaattagcagttacaacttacaagttgtaaattgtttttccatgaggacttaaaagtttcatgtacattaaatataaatttcttttggctggaaatggcattggtactatttaaatagtctattgctggctgggcacggtggctcacacctgtaatcccagcactttgggaggttgaggcgggcggatcaattgacgtcaggagtttgagaccagcctggtcaacattgtgaaaccccgtctctactaaaaatacaaaaattacgtgggtgtagtggtggacacctgtaatcccagctactcggaaggcttttatatgcatttttgaatgcaaatttttaagatctgtgtggtaattagacatataatcatagttataattattattttatactgaaaaactttccaaaagacatttagggtatcatggccaaagcgagtcactgttttatttaaaactacagtcagttcaaccacaagcttttctgagtgtctattgtagtggatatatgtgcttttctttgtcaacttccccatcagtaaaagcaccctaattttattttggggttccactttctccctgccctcagtaatttggttaggttaagactcaccctcctcatatcccccattttccaggtttacttggaaaatagtttccaggtttaccattttcccatttacttgggcagtcatcatattccaactctctggccacacgactggtgcggggatgggcctgtaacccatgtaagtcaatgaataagacccagcttggtagttattaagatataggttgattgcttaaaattgtaagagtggaagagtaagaaggaaagtcaaagagaaaacagttgagccggaaagaaaacggagtcattcaaatcattattcgtaaagagtttcaagaagtggcgtatcaatattctcaacttaatagttgggcaatatttatgtttttgaaactaacaactaaaatacttggataaaatatttctcctgatttaagtaactataatttcagtcatgattcattgttcccagcaggatctgtatctgtgtaagtgggcatagtattgattttttttcaaaagagaagataggtgatctcattaatttccttttcacatcaaagctttccttttagggttttttttttttccttctctcaaaaaaaatactgaatgagtcagggtgctaatctgctttgctctagtaaattctatcttctcattgtagagatgtttttcaccgtagtaataatttgcttagctgcttggtatttactcatgtattcattcacagttctttatcaggcttcaggtatgtacccaatattgtgccaggtgaaatgagattcaaaggtgtctcctagcctagaatgtaaattctataaggaccttctcactcggagcacagtattggcacattatcagaaatctatacagatgcatttaggatgcatttctgtaacaatggtcacttgtgaggtgccatgcttgaccttcaagtattgcctgaaactcaaacacaagttgagggtttgagcctttgtacttgtttcctacagggcagttattcttcaaaatgcccaggtttaatgatacttatttttattttttattatttatttacttttttgagacggagtctcactgtcaccaaggctggagtgcagtggtgtgatctcggttcaatgcaacctctgcctcctggattcaaccgattctcttgcctcaggcccccaagtagctgagattacaggtgtgcaccaccacacccagctaatttttgtatttttaatggagatggggtttcaccatgttggtcaggctggtcttgaactcctgggctcaagtagtctgcccacttcagtctcccaaagtgctgggattacaggcatgagccaccatgcccggcgatacttatttttagtagttcacaatgaaataattaattatatttagtgccaatacaatttcaaataatgatgctggaatgacacccgataccacagtaggcaatgattttgatctctattagtttactagttatagtgggttaaatagtgacttcccaccaaaaatgcccacatcctaattcctgtaacctgtgaatgtgaccttatttggaaaaagggtctttgcagatgtaactacgttaagaatctcgagatgagaccatcctgaattatctggttggtccctaaatccaaagacaaatgtcctttacaacaaaaagaagagaagagggcacagacacagaggagaaggcaagtgaagatgaaggcagagactggagttacgtggccacaagccaaagaattcctgaagccaccagaggcaaggaaggattttctcatagagccttgggagccagtacacacctgctgacaccttgattttggaattttagtctccagagcagtgagagaatacatctctgtttgagcattaagtttgtggtaatttgttacagcagacctaggaaactaatatgttagttcgtactgattatttaattaaaggctctttttgtattgttttgttttctaaatagtctgcagaaacctacctcaatttttgtctccatccaatagagacacctgtctgtctgttgagatttggtggaaatccaagggttagtgtttctgggttatttttcgcctaccacagatagtgctgaaagcccatttagtacacaaatatgacacttctgaataaagtggcttcaacaactggtctggagatccaagtgctattcaaaaaagtgacactcgttctgagaggcgattcctatgaaggagaagctccatttgcgaagttatagcaaggttccttccataatgcacagcagctgggccagggagccgggagtcgtcgcttctggcctacccatctctgggctacttcccgcaactcactttccctgtgtgcctggaatgcttcttcctatgaggccgttagtcaaattaagtagaggcctttaaaaattagccatccatccaatctagagaatgtccactacgcttcattctttctcccttaccctgttgatttcttccatatcacccagcgctgatggtaattgtatgaatacatgcttatctgtctgtcctcccacccctaactctaaattcaaggaactctataactgcacctagcatattgtctgacactcctcaataaagacgcatttaatacatagacaaataatgagtgaacattttgagtggagggccggaaaatgtctatttactttggagttggaatcagactgttcaagagtactttcaaaaaaaattttgctacgtcaaacatcattgaatttcaggattgaaagagtggtggtcatatagctcaatcccctccaaacacccccacccaccagatgcgcgaatgccctcttcagccttcctgataagcatgacgaagatgctggcggaagcatccctggtatcaggaaactcatgacctcactagttttgatcttttccatttagctttcttttcccactcctcccagttattgcaaccttaattgtagcattttacacaactgctgctgcagagttctggaagtctgggggtgggagggacgggggaaccccagtgcctatctcaagcctgcggtcaccgacgcgggtccggggtgggggggtactgccagggaactcgcggcaccgcgtgcttgctgagttcgcctgggctctcggcctccctgcgggcaggggtcctccctccccagcgccgggtctctcctcccgcaggcccgcggccacccgcagcggcattccccgccgccgcccccgccacctgcgcgaccgccctagccgctcgagtccgctcctcccgctcaggggcggctgcggagggcgcggggcgcacgcgggcggccacccgactcttccctcccttctccccaccccagcctgctcctgctcagccccacctccccacgcactcggctgccctcctcctctcctgagagttgccccgcaccttgggcgaggagttcggagcggccccatcgcagagcccacggccagccgagcgcgcgcgacgcaggtgcccgagccccggcgccgccgccatctctgccttcggtcgagttggacccccggatcaaggtgggacctgcttccctctccgacaccccctattgccacctcttcccgctctgggtaactcgagaatggggctttgggacgcgcgtggcagacgcggagccccgcgggccgcttagggactgggagtccggggcagcttagcgggaccaccagaggggccagcgcccggcgggcggcgggggtggggtgggtgcgacgccgggcgactctcggctcccgtggggcgaggaagatctggacacacggctgacagcagccggcagcgcctggagcgaacctgctcgggaccaccgagagagcatgccacccggccaacttcttttccaggcttcgtgcctactttggaaactgaagggactgccacctaaaacagtaaaccctggggtcctgaagagaatttgctggttcgaatgacaagagaaaaaataattgttctgtagggatggtttagacctcagcttttgtttcccacctccccccttccctgcaagcaaattaaacaacaacagtagcagcatcagcagcaaaaccccaaacccaatcctaaccaaaccacttactgaaagagatttgtagtggtgagaaaaagagacccaactgaggaatcatttgggaaccgcaggtatggtgccatttaaaaactggttctttctggtgttatttctagaacttgtgtttgcaaacagattagaattctgggctcttgtcagcctaatggagttctttatactgaagggtggcctggggtgtcctctgttaacatttatttctgtaagtattaaagtatattgaaacaaataccctttcacggctctggaattggaatcagaaaatctgagttttggtgtgatttccattttattacctatgacactgtggttcgtttaacctcagtgggcctcagtttcctcattttttcaagttggagggttggattaagataatttctgagggccttttgagaatatctaaggtatgccccagaataaaaaagtataattccttaactctctttaacttgttacaaacattgctagtttcataatttcatgaaataaaaacaatctgtattaatcttggcactagtttatatgcatttatgacttaggcttttaggattttcccaccaaaaggtatagagaaaaacatgtataaagagctcagaaacatatagatttatatgaatatttacacctctcatactaccttaaataatctttaagccagtatttgcaacactgcaacaaaaatacatggctttagcatagcacgtattctctttaagtattgtacatctggaggaaataaaaatgtgtttgaaggaaaacaaacattgcacctttcctatcaattattgttcttgaacagtgctggctactttttagcataaagttgtgggcagaatgttaaaaaattggtttcaggtcacttctgagccgctgtgaaattaagcacaatagcagagatgccaattttagtaatgcagttagttgccttggaatgaatcccagaaaatagcagagattaactaaacagataaaccagaaattaggaatggacacacgcacacacaaaagtgtctacagtgagtatgtactgtgaagggttagtgtacttcatactttctttttgattagaagaaaatgtcgggttgttttagcagacagagaatgttacagtagcttttgttgctacttctaatgttttatcagtagcattttcaagattatttgaaacttagttatcactagtaaggacaggtttaagaatatttctgcctcttttcggtggcttggattcaaaataataaaacaatcttttctcacccacatgtactttgtatgcagtttgggagagtgaaatggatttgaagtactcttttatgagtacattttaacttattttcagtgactttttgcctttgggctggaaatgtcgtaagttactcaggcatttatcttccctcatattctctggtgaagtagagatagtcatctccgttgaaacagatgctcagagatgtaagtaaattgcttgttgagtgaacagggaatcgtagaactcaaatataccctggttgctaagtcatttggaaaacaactgaaactggatggatccaacagctcacggtccacagccaactcattcatggcttgggagtgtcatcatgggtggcagaggctctgttcctcctttgtaatgtggggacttactctctcagcaatttactgagaaaaaagtaatctcttcacacttagatcactattataggaacaaatggtgtgtatttgtgaagtgcaatatttctgggaggtcttggaaataaatactaaaagtatccagaaaaaaaaaaaaaagaactctcttggcagatattgtactgcatttttcatactgagagccaaacacacccacttaaagagtatgtcctgtggagttaaaaatgaagaaaaaggcttatagtctgctctaattcttaagactttatgtgatttacaaattccagttttaattaaattagaaagttgcaaatgttcacctactggccacactcagtatgtacaaccttttggagttgctcttcaaatacgatctgcttatagtttggaatattccttctcaaacatgttttttggagtcttgctatgttgcccaggctgatttaatactttttgtgacttaatagtgatattacctgttatcatcacacataatcttattaatatttaaaatattttaaaactacaaatcttatataaatataaataaaatctttaaaacatttgaactgtaatgaatatagagagaagcatataaaacaaatttaatggttgacagataatatgataaatcattataataattgtaaggcaaatttctcattattcaccacccccaaaaaaagaacattgcaaatatcccaaaacttcttgtttgttccttcttcatcacaaatctaatttacctttttttaaaaaaagaaagttatttacttatttattttgagacggtgtcttgctctgtcgcccaggttggagtgcaatggctcgatcccagctcactgcaacctccgcctcccaggttcaagcgattctcctgcctcagcctcccaagtatctgggattacaggcgtgtgcctccacacctggctattttttttttttttttgtatttttagtagagatggggtttcaccgtgttagccaggatggtctcaatctcctgacctcatgatctgcccacttcggcctcccaaagtgctgggattacaggtgtgagccatcatgcctggcccaaaaaaagttttatatgattatggtaggcattaaatcatagattattttgcttaacattatgtttatgagattaagggatttcttctctctcctttaaaacaatattttttgaaagagttatctcggctgggcatggtgcctcacgcctgtaatcctagcattttcggaggctgagacgggtggatcacaaggtcaggagttcaagaccagcttggccaagatggtgaaatcccatctctactaaaaatataaaaaaatttatccagacctggtggcaggcgcctgtaatcccagctactccggaggctgaggcagagaattgcttgaacctgggagacggaggttgcagtgagccaagatcgcaccactgcactccagcctgggagacgagtgagactctgtctcaaaaagaaaaagaaaggaaggaagggaggaagggagggagggagggagggagggaggattgtctctattccctgtctccaattattctcttcacactgttaaaaaaaactcattcctattaatcttgttttcaatattctgctaaaactacgtcaaggtctactactgtcaagttcaccaatgatactacctttgctcatccagtagtcagttgtcagtgttcattttacttcactactggtagcattgtcacggttattactctgctccttgaaacagtcccttactgacttccaggacaccatgcattcttgattttcctccttcttcactggctgctcctttctgtctcctgtgctagcctctcctcttttcttagaggttttaaccttggaataccttaaggtttagctcttttttctccatgctttttgatgatttcatgcaatctctctatgtgtgtgtgttgatgattccgaaagtgatagctcaagccttgactgctccctctggacttcagatctttatattccagctgtctactgagcatttccatttggatgtctagtaggcatctccagttcaaattctccacatggaatcttcatctttcccaaacctgcactatctgcagtcttcctcatctccatctttcaagttagttaggccccaaaccttggagtcatcttcgattcctcctattctctcatacctcgtttgtaatgtgttggggaattctctgtgctctatcttcaaaacaaatccagaatataatgacttctcattacttccatggctctgttacaggaaaggggtcccaatccagaccccaagagagggttcttggatctcatgcaagaaagaattcagggcaattaggtagagtaaagtgaaaacaagtttatttggaaagtgaaggaataaaagaatggctactccatagagcagccccaaggtctgctggttgcccatttttatggctatttcttgatgatatgctgaacacggggtggattattcatgcctcccctttttagaccatattgggtaacttcctgacattgccatggcatttgtaaactttcatggcgctggtgggagtgtagtagtggggacaaccagacgtcactctcgtcatcatcttgattttggtgggttttggccatcttttttactgcaacctgttttatcagcaagatctttatgacctgtatcttgtcctgacctcctatctcatcctgtgacttagaatgtcttaactgtttgggaatgcagcccagtaggtctcagcctcattttacccagcccctactcaagatggagttgctctggttcagacgcctctgacagctcccaccctagtacaaggtgccatcaactctcacgtgagttattgcaaggacctccaaactggtctccctgcttttattttttgccctcttcaatacattctcaaaatagcaatcagagcactccttttataatgcatgtcggatcatgtcacttttctcctccaaactctccatggatttctggttcacacagagtaaaaaccaaagtccttaggataacctccaaggccctacctgatcattctgcttgccactttacctgtctggtctcatttcctactgttcttcctttcactttactcagttccagccacactgggctccttgctatttcttgactatattagaaaccatcttttcattttagcttttcctgccttgaatgcttgtcctccagatttccacatggttcgctttgttactgtcacttcttttaagtcttcgttcaaatgtctccttttcaatgaggcctactctgattacagtatttaaaattccatatcttcttaccttgtaatatattctttttcctttcctttcctttcctttcctcctttcctttcctttcctctcttctcctctcctctcctttgtgtctccctatagcattattttaccttataaaatactgtgtgactttctaattatcttttttttttctgtcccatttccactagaatgtgaactccacaagggcagaattttgtcctgttttgctcactgttgtgtccctagtgtgtgaaatagggcctaacatgtaagaggtgctcaatgctttttttggtgattgaatgctattgtttgttcatttttattcctggatatattcaattctataaatataacacgttaatttaaaacatgaattctgattatgcacatttagtttccttcctttcttcttccctcacccatcacttcttccttcctgccttcctcccttccttcttttttgccactataaataaagcagctatgatccatctacaagtgtgctagtatacgaagtttctttagagcgtaaaaccaatagacaaattacgggctagcaggacttgcagacttcaactttattagataatgaatgccacacatttttagtgtggattcaccaatttgcattcctgtttttattgctctacaccagatggacaaacttcgtattgccagaacatttaatttttcgccatctgatgggtattatctcattaatagttactactttaattactggtgagattaagcctggtgtctgtgaggataggttaggttatgctgcagtaacagataatcttcaaatctcatgggcttaatgcagttcttcactgatgcaaagtctcctatggactaagacaactctctggggcaacttctccatgtaataacttggaggtctaagttcagggaaactccatcattctgtaactgtaacaatctggaacatggaactttcccatttggtgtggtaggggaaaagacagcagggatggatactcgtgagccatcttcaaatgcttccatctgaaagtgacatgaattattttcaaatgctaaacgtaagtgtttaagatagtcatatggtaatatgacccagtaattctattcctaggcatatacctaagatggatgaaaatatacatccacacaaaaagttgtacagaagtgtcagtggcaacattcttcataataaccaaaaaacagaaactgcccaaatgtccatacactgatgaatggataaacaaactgaggtatatccatacaatggaatattattaggcaataaaagggaatgaagtgctgataaatgcttcaacacgatgatccttgaaaacatgatgctaacagaaggaagccagttactaaagaccccaggattttatttatatgaactgtccagaataggcaagtccataaacacagaaagcagatcagtggttgccggggatggaggaagctggtgaaaggggagcgactgctaatgaggaagaggtgcattgtggggtgatgataatattttgaaattagacagtggtgatgattgctctgttagatacattcactcaatgtactaaacctagtgaattgtatgctataaaagagtgaactttatgatatatgaataatagaccaataaaactgatattttaaaaaatactttaaaaataaagtatatttctatatgccatcaagaaacagaaaatgaaatattttagaaatgcatcatttaaaatgattccaaaaacatgaagttcctgtgaaaaacatctaacaagatgttcagggacttttatggaaaaaattagatgagatttacatctcatattagggaagaactcagtatatggagacagatagtcatacattttaggactgaatgattaaaggatatcaatttccttttcattgttatagactcaaaacagtctcaataggatctctattaaattcctaacaatttttttagaacttgacaagctgattctaagatgtatatggaaagtcaaaacccaaagaatgctaaagcactcttgaaaaagatgcaaaatgggagaatttgtgctatcggatagcaagactcgttttaaatctgtagtaatcaagacaatgtttctttattatttctttttcccttctactttctttgattttttctgttctaactgcttaagtgaatgttcgattaaatgttttattctaacagattataaaggaatgatagcacattaattttcagcctttcttctttttgaaaagtattatttatggctttgagctgccttctacatacttctttatctgtgtgaaataaattttgagatactgttttcactaagatcagtttaaaataggttctgattttcatatttctttttgcccagttattaacttaaaagtatttttctggttaattgaaactttagtcaatttggagtaagcttcttgatttctaatgtttctttttgcattaaagcctattttgtatgatattgatataactccaccagctttcttttgttccgtatgtgcatgttaaatcttttttccatcctttgctttcagatttctacatacttattttaaatgtgtctctgtatcctatatcatttttctgtcattctgcattcaacctttctatattcttatgttttagatgtgtctgtagtaaacagcatttatttcttaaggtattttaaattcaatgtctttccactggagaattttgtcagtttacatttaatacaattactgatatattgaggcttgtatttactttctgctttctttatttgcccataattctggttattttcttttttattgccacattttaggttgattatttttatcacttcaaattttctttcattactttaagagttatacactctatttctattgttcagtaactactgtggaagttaccatatgaatccttaagttatcgaagttgaaaatgaatacactttgagcactaatgagtacaggaaaatacagaggccttagcttactttaacttcatttaatactctcttgccatatattgtgagcatcttgaattccatttatttattcaaatatttattgagagcttactcggggctaagcattattctagatactgaacaaaatagatgagcatccctgtgcttgtaagacataacagagtgcaaacaataaacttaatagagtaaattataccatatactagaaggtagtaagtatatggaaaaaaaactagagcaaggcgaaagagattaggagtgccgagagagggagaaagagaatgaatgagagtgagtgcacataagtacaagtgaaagtgagtgagtgtgccctagctttggaccaatactgtctataaagtttgtggggacatataaatgttttatctattttcactagataacagctgaaaggtttgagccaaatagagagtctcaggtgcttctataatggtattataataggctttaaaaacgtgaaaaactcatgtttaagaacagctgttaccaactatctgttttgtgagggtggaggacaacttagtttttctcagaattaattatactttcttattgtaactttagccgctgttatttgggtctctaaacctatacaaattaagaagctatgaacatgagagaatcaaacaattagatttctgtgcacaccaacagaatttctgaaccaaagtggtttgtgtttaggagatgaaagagatgataaatcatacacacacacatagataaacacacatattatatgcatgtgtgtgcatgtgtgtgtgtgtataaacacagagagaaaacatactggcatacacataagcacctgttaattgtagttgctgttatagtagtaagatgttatctcttagaattatggtatacttatcatattagacctatccaggaggtagctgggtatctagtgtggtgatactatctagtgtggtgtcttgcaacaacactgctagtcataggtctgatttgggggagaaaatatttttttaagacagtgtctcgctctatcacccaggctgaagtgcagtggcatgatcatagctcattgcagcctcagtctctgggttcaagctaccctcctgcctcagtgtccccactgcatgctaccacacctggctaattttttcaaatttttagtagggacgaagtcttgctatgttacacagggtggtctcaaactcctgaactcaagtgatcctcccgctttggcctcccaaagcgcagggattacaggtgtggaccatcgtgccaggctgggagaaaagttttgttgacacaacaaacaggatgcaaagaaacaatctataaaaacagtaatttaggtaagtggcttcttggtcttttgattaataggattctaaacttgcaaatcaattcttatgcaggagttcttattggcatttaccgatgctctttggctgatgtttgtttttactgaccagaggttctgtgggaatctcatttattaatacttacaatgtgcttcatattcctctgcatctttgagggacaattaaatgtccactctatggaatcttttataatttcccaatcataagtaattactctgatttctcctaattacccttttttctaggtagttgtgattctttaagtctaagacagcatggatttttaagctacaccactgatatagtttggataatagtcccctccaaatctcatgttgaaacttgattcccagtgttagaggtgagtcctgaagtgggaggtgtttaggtcatggagcagatccccaaagagtggcttggtgacatcatcacagtaatgagcatgttcttactctattagttcctgtgagcactgatttttaaaaagagcttggcttgtccctcctctctcttgcttccatgctgtcactatgtgatctctgcatgctggcttcctttcccctctcctttgcctgcactatgagtggaagcaactcgaggccctcaccagatgcagtacaggtgccggtgccatgcttcttgtatcgcctgtggaaccatgagccaagaaaccttttttcttcataaattacccagtctcaggttttcctttgttacaacatgaatgaattaagataaccatcatttttgtatcagtaaaaagaaaaagctctgcgtatttaactattatacagtattttttatcatttaaaaatttatacttattcagatagctcactaagaattatatatataaacatttttatttaaatcatgccattctcataaggaaagtataaatcaaagatttcggttaagggattcttattcatattcaaagtctgtttttttcaagttgcttttcatctcagaactgttgatgtaaatattttcccaaacagtatcatactctgggctatcaagaatatttgtgatacagcaattcaaaaaagaatgcctcactattgtttctgggattttcttccaagctggttcattttgctaattttgatgcggcttttaactgatcttgtaagatgtcaatatcgggttttttggagttcatattctttcctcaaatggtctttaaatagtttgttgaccaaaatattgataggttaaaattgtccagttggtcattaagaaagtgtccagttttgatgtatgcaatcaataacaaccagatcacagctgctaccaggccatcgggaattgtaagatgctataaatttaaacaatgatgctgatgccagaggtgttaaaatgttgtgaatcttaaaacagaagacatacaatactactctcttcctttgtatttcctgtagttcaactaaaaatctcacctttcgttggcccctaggactttgtgagtagctattttctctgaaatcccatagtactttatttaatgaaaggaactaagtaataatttggggtgaaaataatccatgtacatggttaaaaaaaacttacttatgtataaaccagtagccctctgctctactacctacactaaagggtataacctgaccctaggaacaactagtttgaaccatttctggttttagtccttcttcctctagggctaaattgtatgtttatactgtctgcttttctttttttttcatttatcatttaagcagataccatagtagaagataatttagcctactcatttcacctccttttcttttttgctcctccacatatattaattttatgagctcctttattggttacatttgtcatttccaccacgatatttgttccattaactacagacagtttctcttgaacccctgcttcatgagtttgggatatttcaccctttctcctctcaccatctctccttgtatattataacacctaaatctgacaactgtgtggtgagagtattgataatattttaggtttagtatttgttattaaattttgtatttttgtctattggttgaccctaaaagttgaaaaattaataaatagcattaaagttattatgaccctgtaaatgttgtttactgcagaatcaagaagtattctacagttacatttcattcagtatggctcctgagccacccaaagaatgttcctagaatcaaagttaaggagattctttctttcaaatggattatttaattctagcatttgctaaaaatttgccatattttcttttcattcatatttacattgtgaatttctgtgacgctttttcaaattacctttattttttcttattgggaaagcatatgtgggccttcctggtttcatccttaataattttcagctttttactttctttatttttttgaatgcattttcttccttttttttttgaagtccactgactcatattctagtggcttcaattttgaattatgacttcctttttccctggtgtttattctgtttttattttattttcaagtttttttctggcttcaggattatattatgtgtcaggttgccttccatctccaccttcctccttgccatctccttttgggggccatctatactacagctgctatctggactagtcatttgaaagtttgcagagccagcaaacttgtttgtaaccacgatttcctgaatgtgtatgtttttgtcgtttttggttttctcctcattttgctggaatactttataaaattacttctggcaaataaatttatactatataaattttgtaagccattacattactaaaagtatatttgtttctctcggatacttctttgactggatgtaaaattctaaactgaaaagaattttctataagtcagttgctggattattttctagtattcggtgttttgggatgaaacatttgttttccattctctttcttactcctttagtgatttttttcttctctggaatcttttcttatattctttttttctttgttgtttggtaatttcttaattatatgtttaggaatgaatctgtttccattcttctttcttggagcctggtagccatatttttcactttgaacacttgtgccttttatctctgggaaatgtgccttttatctcttgtgccttttatctctggaaacacttgtgccttttatcgctgggaaattttcttgtattttttttgtgtgattattttctcctttctattctttttttctggaagtactgttggttggatttgggtctcttggatttatttttaagtgacttctttttcttaaacatttatttcctggttttttttttttgcctttggggggaaatgttaattatgcattttttttaaaaccattgaaattttttttttgtactatgcatgtaattttcaaaagctctttcttgctctcattattcctttgttattttatggatccaaaactttctgaaatgtctctgccaatactcattaaagatttgttaaagcttttttttttttctttaatttatccctgtgtccctggtggttagtttcctttttactttctttttataaaagaaaaatttaacacaatgctaaagactttcttcatgtctttgtgtctccattcagcatggctgttaaatgaagaaacaggaagaatgtgacttctgtgcatatgggcagtgttttatcaactgataggcttcatgttaggcactcaatcaaagagctgccatttatgctaaaggcctgttgcctaaatgtcagggctttaccataccggtgccaagtttacatgaaaagctcaagttctcaaacaacttgtactttttcctcctttaacacataggagtgtatactataatttttaaattgtctttggccatttgacacctttgaatactttgctcgtgtttgaggaatttccacttaataagcccctgttttcccaagcttcctggcagtctgcctgtagagtgtgaagtaggctccatcagttagaggcatttgtgccagattttagatcagaagtgtgggacatgaaagggcagatgagctccccggagctcagaggtagtaggcattgaggtttcagtcataacatgcagtatcctggtatggtgcagggctgtcttctctagagcaattctgcatgggattttgggtgtggtcttggctgtgtgcttttctagcttggttctctggcactcactgaggttcggagagctacccagtaaactttaataaatttctttcctgcttagactagtcaaagttcatttcagttgtttgttagtcactctcctgacagttacatggagctagtttagctgctgtgcaatgtttgtgaggaggtgaattacatacgcagatattacatgtgcagaccaaaatggcctctccttttagccccacctcaccctcctgcccttatcatttagaacatctgcaggtttgttttctcattgttgacagcctattctccaaatatcctatgtagttactacctttgttatacctcattagtctttgctaattgatatggtttggatatttgtcccctccaaatctcacgttgaaatgtaatctccagtgttggtggtggggcctggtgggagatatttgggtcatggggtgggtccctcacgaatggcttggtgccctccctgtggtaatgagtgagttcttgctctgagttcatgcaagatctggttgttaaaggagcctggcatcttcttccaccctctcttgctcccccttgccatgtgatgcacctgctccccattcactttccaccatgactgtaagcttcttgaggccctcaccagaagcagatgctggcctcatgcttcctttatagtctacaggaccatgaaccaaaataaaacacttttctttataaattacccagtctcagatattcctttttaacaatgcaagaatggactaacacactaatgttttagaaatttgtttttctcttttgctgctgatcgctctctcattcactcttgtagtgggttgatattatttactttactataattttcaaggtatctcaggagggaaagatcagtttgttcagtttaccatttttttttgagacagcatctcactctgtcacccaggctagagtacaatggtgcaattttggctcactgtaatctctgcctttcaggctcaagcgattctcatgcctcagcctcttgagtagctgggattacaggcatacgccaccatgcatggctaatttttatatttttagtagagatggggtttttccaggctggtctcgaactcctggcctcaagtgatccgcctgccttggggttccagagtgctgggattacaagcatgagccaccgtgcctagtcccagtttaccatcttgaacctgaagtcccactggtattatcgtgctttgacatgtaaaaaaattaataaaatgttatttcttaaagtaaataaattttaattattttctacatttctagcatcacatgtggtagcttgcattttattgaatatctggttaatatttaaatgagtcaatttatgtagagcttttagattacaccgtaggtaagatgcctactctgactcaactttgttgactttatggtacccacatctgtgaatcatagcttatccttatgcattttttaggaattaatatgtgacaagttcacacagagtaatatcaggaattaaagtacttgaaattatgttttccaagtgacaaatatttatgccaggatgttggaaggttttttttttaattaaaaaataatttaagtctttaacagctacttgatgggaataacatgaccaatttatattccaagtgaataaataaaagttaacatacttaaaatgacaaggctactggaaatagatcaggctatatttattttgttaaatttttgatacttgaagaaatagtgtttttcagttgcatttaaattaaatgtttaaatgcttatttaagtgagagatagacagatgcttctctaacaaaaagtaaaagcaaaaattagtggcatttggagctcattgagttaactcatcaaagcaacattattgtcagaattgcttttcttactcataaactttcctacacactcagagattttttgagatcaatggagcaagttgtaaataattttatttctgctcaaacactgattgagactgttctgttttatatttaagtagaatttgataggtaaaaataacacaaataatcctttacaatagaaattaaacagtctgatcttcctttgaaagcccaaattatgcttattcagtagaatatagatttggattttttcttcatagtaataactgaagagtaagcatgattaatatgcttactgtgctgggcatattatgcaaattaaattactgcttgcatacccatacatcatggatgtatcatttagatcagactgtggatttgtctttgtatactttatacagatttcttcaaatatttgtatatttcaacataggcttttttttcttttcatttctttctaaattcctaagggctgtttttctttttaaacgtgagaataaatatctacattaattatttattatatactttaattgattcaacaactatttatgagtacttacgatgttccagagaatatattaaaatacttgtttttcagaagtctaatatggatgagaaacattgtgcctattctttttttttttttaaattgtactttaagttctgtgatacatgtgcagaatgtgcaggtttgttacataggtatacacatgccacggtggtttgctgcacccatcaacccgtcacctacattagatatttctcctggtgctatccctcccctagccagccaccccccgacaggccctggtgtgtgatgtttctctccctgtgtccatgtgttctcattgttcaactcccacttgtgagtgagaacatgcagtgtttggttttctgttcctgtgttagtttgctgagaatgatggtttccagcttcattcatgtccctgcaaaggatatgaactcatccttttttatggctgcatagtattccatggtgtatatgtgccacattttctttatccagtctatcattgatggccatttgggttggttccaagtctttgctgttgtgaatagtgctgcaataaacatgtgtgcatgtgtctttatagtagaatgatttataatcctttgggtatatacccagtaatgggattgctgggtcaaatggtatttctggttctagatccctgaagaattgtcatactgtcttccacaatggttgaactaatttacactcccaccaacagtgtaaaagcgttcctatttctccgcatcctctccagcatcttttgtttcctgaatttttaatgatcgccattctaactgacatcagatggtatctcattgttgttttgatttgcatttctcaaatgaccagtgatgatgagcttttttttcatatgtttgttggacacataaatgtcttcttctgagtagtgtctgttcatatcctttgcccaccttttgatggggttgtttgtttttttcttataaatttgtttaagttctttgtagattctggatattagccctttgtcagatggttagattgcaaaaattttctcctattccgtaggttgcctgttcactgtgatgatagtttcttttgctgtgcagaagctgagctgtttagtttaattatatcccatttgtcaattttggcttttgttgccattgcttttgatgttttagtcatgaagactttgctcatgcctatgccctgaatggtgttgcctaggttttcttctagggcttttatgggtttaggtcttacatttaagtctttaatccatcttgagttaatttttgtataagttgtaaagaaggggtccagtctcagttttctgcatatggctagccagctttcccaacaccatttattaaatagggaatcctttccccattgcttgtttttgtcaggattgtcaaagatcagatggttgtagatgtgtggcattatttctgaggcctcttttggttccattggcctatatatctgttttggtacagtaccatgctgtcttggttactgtagccttgtagtatagtttgaagtcagttagtgtgatgcctccagttttgttctttttgcttaggattgtcttggctgtgcaggctctcttttggttccatatgaaatttaaagtagtttttaaaattctttaaagaaagtcaatggtggcttgatggggatagcactgaatctataaattactttgggcagtatagctgttttcacaatattgattcttcctatccatgtgcatggaatgtttttccatttgtttgtgtcctctcttatttccttgagaagtggtttgtagttttccttgaagaggtcattaggtattttattctctttgtagcaattgtgaatgggagttcactcatgatttggtgctctgtttgcctattattggtgtataggaatgcttgtgattttcacacattgattttgtatcctgagactttgctgaagttgcttatcagcttaaggagattttgggctgagacgatggggttttctaaatacacaatcatgtcctctgcaaacagagacaatttgatttcctctcttcctatttgaatacccttaatttctttctcttgcctgatttccctggctagaacttccaatactatgttgaacaggagtggtgagagagggcattcttgtcttgtgccagttttcaaagggaatgcttccagcttttgcccattcagtatgatattggctatgggtcataaatagctcttattatttttagatatgttccatcaatacctagtttattgagcgtttttagcatgaagcagtgttgaatattatcgaaggccttttctgcatctattgagacaatcatgcggtttttttttgcatataaatataatagaatattattcagccttaaaacggggtgaaattttgatacgtggtacaacattgataaactttattttattttattttatttattattattattatactttaagttttagggtacatgtgcacaatgtgcaggttagttacatatgtatacatgtgccatgctggtgtgctgcacccattaactcgtcatttagcattaggtatatctcctaatgctatccctccccactccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatacacccagtaatgggatggcggggtcaaatggtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctacataaatgtcttcttttgagaagtgtctgttcatatcctttgcccactttttgatggggttgtctgtcttcttcttgtaaattagtttgagttcattgtagattctggatattagccctttgtcagatgagtagtttgtgaaaattttctcccattttgtaggttgcctgttcactctgatggtagtttctttggctgtgcagaagctctttagtttaatgagatctcatttgtcaattttggcttttgttgccattgcttttggtgttttagacatgaagtccttgcccatgcctatgtcctgagtggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcagtgttatttctgagggctctgttctattccattgatctatatctctgttttggtaccagtaccgtgctgttttggttactgtagccttgtagtatagtttgaagtcaggtagagtgatgcctccagctttgttcttttggcttaggattgacttggcgatgcgggctcttttttggttccatgtgaactttaaagtagttttttccaattctgtgaagaaagtcattggcagcttgatgcggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagctggattcctaagtattttattctctttgaagcaattttgaatgggagttcactcatgatttggctctctgtttgtctgttattggtgtataagaatgcttgcgatttttgtacattgattttgtatcctgagactttgccgaagttgcttatcagcttaaggagattttgggctgagacaatggggttttctagatatacaatcatgtcatctgcaaacagggacaatttgacttcctgttttcctagttgaataccctttatttccttctcctgcctaattgtcctggccagaacttccaacactatgttgaataggagtggtgagagagggcatccctgtcttgtgccagttttcaaagggaatgcttccagtttttgcccattcagtatgatattggctgtggatttgtcatagatagctcattattttgagatatgtcccatgaatacctaatttattgagagtttttagcatgaagggttgttgaattttgtcaaaggccttttctgcatctattgagataatcatgtggtttttgtctttggttctgtttatatgctggattacatttattgatttgtgtatattgaaccagccttgcatcccagggatgaagcccacttgatcatggcggataagctttttgatgtgctgctggattcggtttgccagtattttattgaggatttttgcagcaatgttcttcaaggatattggtctaaaattctcttttttggttgtgtctctgcctggctttggtatcaggatgatgctggcctcataaaatgagttagggaggattccctctttttctattgattggagttgtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctgatttagtcttgggagagtgtatgtgtcgaggaatttatccatttcttctagattttctagtttatttgcatagaggtgtttgtagtattctctgatggtagtttgtatttctgtgagatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttacatatttcttgccttctgctggcttttgaatgtgtttgctcttgcttttctagttcttttaattgtgatgttagggtgtcaattttggatctttcctgctttctcctgtgggcatttagtgctataaatttctctctacacactgctttgaatgtgtcccagagattctggtatgttgtgtctttgttctcgttggtttcaaagaacatctttatttctgccttcatttcgttatgtacccagtagtcattcaggagcaggttgttcagttaccatgtagttgagtgtctttgagagagtttctgaatcctcagttctagtttgactgcactgtggtctgagagacagtttgttataatttctgttcttttacatttgctgaggagagctttacttccaaccatgtggtcaattttggaataggtgtggtgtggtgctgaaaaaaatgtatattctgttgatttggggtggagagttctgtagatgtctattaggtctgcttggtgcagaggtgagttcaattcctgggtatccttgttaactttctctgtcgttgatctgtctaatgttgacagtggggtgttaaagtctcccattattattgtgtgggagtctaagtctctttgtaggtcactcaggacttgctttatgaatctgggtgctcctgtattgggtgcatatatatttaagatagttagctcttcttgttgaattgatccctttaccattatgtaatggccttctttgtctcttttgatctttgttggtttaaagtctgttttatcagagactaggattgcaaccccggtctttttttgttttccatttgcttggtagatcctcctccgtccttttattttgagcctatgtgtgtctctgcatgtgagatgggtttcctgaatacagcacactgatgggtcttgactctttatccaattttccagtctgtgtcttttaattggagcatttagtccatttacatttaaagttaatatcgttatgtgtgaatttggtcctgtcattatgatgttagctggttattttgttcattagttgatgcagtttcttcctagcctcgaaggtctttacaatttggcatgattttgcagtggctggtaccagttgttcctttccatgtttagtgcttccttcaggagctctttcagggcaggcctggtggtgacaaaatctctcagcatttgcttgtctgtaaagtattttatttctccttcacttatgaagcttagtttggctggatatgaaattctgggttgaaaattcttttctttaagaatgttgaatattggtccccactctcttctggcttgtagagtttctgccgtgagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccaagttggtcactttcaggtacaccaatcagacgcagatttggtcttttcacatagtcccatatttcttggaggctttgttcgtttctttttattcttttttctctaaacttcccttctcgcttcatttcattcatttcatcttccatcactgataccctttcttccagttgatcgcattggctcctgaggcttctgcattcttcacgtagttctcgagccttggctttcagctctatcagctcctttaagcacttctctgtattggttattctagttatacatttgtctaaatttttttcaaagttttcaacttctttgcctttggtttgaatttcctcctgtagctcggagtagtttgatcgtctgaagctttcttctctcacctcgtcaaagtcattctccatccagctttgttctgttgctggtgaggaactgcgttcctttggaggaggagaggcgctctgctttttagagtttccagtttttctgctctgttttttccccatctttgtggttttatctacttttggtctttgctgatggtgatgtacagattggtttttggtgtggatgtcctttctgtttgttagttttccttttaacagacaggaccctcagctgcaggtctgttggagtttgctagaggtccactccagaccctgtttgcctgggtatcagcagcagtgtctgcagaaccgcggattttcgtgaaccgcgaatgctgctgtctgatccttcctctggaagttttgtctcagaggagtacccggccgtgggaggtgtcggtctgcccctactggggggtgcctcccagttaggctgctcgggggtcaggggtcagggacccacttgaggaggcagtctgcccgttctcaggtctccagctgcgtgctgggagaaccactgctctcttcaacgctgtcagacaggaacatttaagtctgcagaggttactgctgtctttttgtttgtctgtgccctgcccccagaggtggagcctacagaggcaggcaggcctccttgagctgtggtgggctccacccagttcgagcttcctggctgttttgtttacctaagggagcctgggccatggcgggtgcccctgccccagcctcgctgccgccttgaagtttgatctcagactgctgtgctagcaatcagcgagactccgtgggcgtaggaccctccgaaccaagtgcgggctataattctcctggtgcgccctttcctaagcctgtcggaaaagctcagtattcaggtgggagtgacccgattttccaggtgccgtctgtcacctctttccttgaccgggaaagggaactccctgaccccttgcgcttcctgagtgaggcaatgccttgccctgctttggctcgcgcacagcgcgctgcacccactgtcctgcacccactgtctggcactccctagtgagatgaacccggtacctcagatggaaatgcagaaatcacccgtcttctgcgtggctcacactgggagctgtagaccagagctgttcctattcggccaccttggctcctccccccatcatgtggtttttgtcattggttctgtttatgtgatagattatgtttattgatttgtgtatgttgaagcagccttgcatcctagagatgaagccgacttcatcgtggtggatgagctttttgatgtgctgctggattctttttgccagtattttattgaggatctttgcaccaatgttcatcagggatattggcctgaaattttctttttttgttttgtctatgccaggttttagtatcaggatgatgcgggcctcataaacgagttatggaggaatccctcttttcctgttgtttagaataatttcagaaggaatggtaccagctcctctttgtacctctggtagaattcggctgtgaatctgtctggtcctgggccttttttggttggtaggctattaattactggctcaatttcagaccctgtttttggtctattcagggatttgacttcttcctagtcttgggaggtgtatgggtctaggaatttatccatttcttctagattttctagtttatttgcatagaggtgtttatagtattttctggtggtagtttgtatttctgtgggatcagtggtgatataccctttatcattttttattgtgtctatttgattcttctctcttttcttctttattagtctggctagtggtctattttgttgatcttttcaaaaatccagctcctggattcactgagtttttgaagggtttttcgtgtctctatctccttcagttctgccctgatcttagttatttcttgtcttctgctagcttttgaatttgtctgctcttgcttctctagttcttttaattgtgatgatagggtgtcaattttagatctttcctgctttctcttgtgggcatttagtgctataaatttccctctaaacaccgctttatatatgtcccagagattctggtacgttgtgtctttgttctcactggtttcaaagaacatctttatttctgcattaatttcattatttacccagtagtcattcaggagcaggttgttcagtttccatgcagttgtgcagttctgagtgagtttcttaatcctcagttataatttgattacactgtggtctgagagacagtttgttatgatttctgttcttttgcatttgctgaggagtgttttacttccaattatgtggtcaattttagaataagcgcgatgtggtgctgagaagaatgtatattctgttgatttggggtggagagttctgtagatgcctattaggtcttcttggtccagagctgagttcaagtcctgaatatgcttgttaattttctttcttgttgatctgtctaacattgacagtggggtgctaaagtttcccactattatcatgtggcagtttaagtctctttgtaggtcattaagaacttgctttatgagtctgggtgctcctgtattgggtgcatatatttaggatagttagctcttcttgttgcattgatccctttaccattatgtcatgctcttttttgtcttttttggtctttgttggtttaaagtctgttttatcggagactaggattgcaacccctgctttttcttttttgctttccatttgcttgataaatattcctccatccctttattttgagcctatgtgtctcacatgcaaaggcatgtgagactggtctcctgaatacagcacactgatgggtcgtgactgtttttccaatttggcagtctgtgtcttttaattggggcatttagcccatttacatttaaagttaatattgttatgtgtgaatttgatcctgtcattatgatgctagctggttgttttgcccattagttgatgcagtttcttcatagtgttgatggtctttactatttggtatgtttttacagtggctggtactggtttttcctttccatgtttagtgcttccttcaggagctcttttaaggcaggcctggtggtgacagaatctctcagcatttgcttgtctgtaaaggattttatttctccttcacttatgaagcttaatttggctggatatgaaatcctgggttgaaagttcttttctttaagaatgttgaatattggcccccactctcttctggcttgtagagtttctgcagacatatccactgttagtctgatgggcttccctttgtgggtaacttgacctttctctctggctgcccttgacgttttttccttcatttcaaccttggtgaatttgacgattatatgtcttcaggttgctcttctcgaggagtatctttgtggtgttctcgtatttcttgaatttgaatgttggcctgtcttactaggttggggaagttctcctggataatatcctgcagagtgttttccaacttggttctgttctccccatcactttcaggtacaccaatcaaacataggtttggtcttttcacatagtcccatatttcttggaggcttagttcatttctttgcattctttttttttaatcttgtcttcatgctttatttcattaagttgatcttcaatctctgacatcctttcttccgcttgttcaatttggctattgatacctgtgtatgctttacaaagttctcatgctgtgtttttcagctccatcaggtcatttatgttcttctatatactggtttttctagttcgcaattcctctaaccttttttcaacattcttagcttccttgcattgggttagaacatgcttctttagctcaaaggagtttgttattacccaccttctgaagcctacttctgtcaattcatcaaactcattctgttcccttcctggtgaggagttgtgatcctttaaatgagaagcggcattctggtttttggaattttaagcctctttgtgctcgtttttcctcatcttcatggatttatctaactttggtctttgatgttggtgacctttgaatggcgtttttctgtggaatcctttttgctgatgttgatgctattcctttctgtgtgttagttttccttctaccagtcaggcccttctgctgcaggtctgatggagtttgcttgaggttcactccagaccctgtttgcctgggtatcaccagcggaggctgcagaccagcaaagattcctgcctgttcctttctctggcagcttcgtcccagaggggtacccaccagatgccagctggagctctcctgtatgaggtgtctgttgacccctgctgggaggtgtctctcagtcaagaggcagggtggttaggaacccatttgaggaggcagcctgtcctttagtaaagctgaagcgctgtgctgggggatccactgctctcttcagagccatcaggcaggaatgtttaagtctgctgaagctgtgtccacagccacattcttcccccagggagaatgctgtgtcccagggagatgggagttttatctataagcccctgactggggctgctgcctttctttcagagatgccctgcccagagaggaggaatctagagaggcagtctggctacagaggctttgtgtgcagcagtgggctccacccagttcaaacttcccagagaccttgtttacactgtgaggggaaaactgcctattcaagcctcagtaatgacggacattccttcccccaccaagcttgagtgtcccaggtcgatttctgctgtgctggcagggagaatttcaagccagtggatcttagcttgctgggctccatgggggtggtatccgctgagctagaccatttgactccctggcttcagcctttccggggaagtgaacggttctgtctgtcttgctggcattccaggcactgctggggtatgaaaaaaaaaactcctgcaactagtttggtgtctgcccaaatggctgaccacttttgtgcttgaaacccagggccctggtggtgtaggcacccgagggaatctcctggtctgtgggttgggaaggccatgggaaaagcataatatctgggccagagtgcactgtccctcacggcacagtccttcatggcttcccttggctaggggagggagtttcttgatcccttgcacttcctggatgagccaacgccccatcctgcttcagctcaccctccgtgggcggcacccactgtctaaccagtaggaatgagatgagccgggtacctcagttggaaatgcagaaatcacctgcctcctgcgttgatctccctgggagctacagaccagagctgttcctattcagccatcttgccagccacccccgcctgttctttttttgtgttcttcttgctaaatttatttagcatgagaacagcaatagcatgttctcacataagaagctgactaacagaatgcacagcatataaaaaatgtgctatttgtatagaaataatttgtcaacttcagcaatcagtttgagacccacatatcacctggatgaatggttctcctgcagaatctgattcagaggaaagagtcatgtggtgcggtgacttgaaagagctgtggtgaataattgaattctaagaatggccacagtagactccctgttaatatttctgaaaagtagggttatggagcacatattattaaactgttatttttaatagacatcttatacttgtatctggtctgtaagaccagtcatattagtgtacatttttcaattagtttactttggaagtgggcacaggggtctacactgctcaaatctgtaattataattaccttatgataatttattatggcaataatgggaatttgcttatttttctttgaaaaatgttttcaagctatacttgtttctgccatgatagagaacttttgcaacattcatttttgttgtgagagtagagccacaatgattttctaatgagaattgattaagccctttccttaccctagcccagttctaagtattgtcagtggtgattgggatagagggtagtctgtttggcatgtttccatgtcatgtgaggatgtcaaccctccgtctttttgaatgactgctaaggcacattactccttttaactgtcaacagagaatgactactactgtggtctgaatgtttgtgccaccacagaattcatatgttgaaacctaattaccaatgcaatagcattaagaggtggggcctttaggaggttattaggtcatgagggtggagccctcatgaatgggattagtgcccttataaaagaggctgcagcggagcttgttcaccccttctgccatgtgaagacatggcaagaaggcaccatctatgagaagtagtccttcaccagagattgaatctgctggcatgttgatcttggactttccagcctccagaattgtgagcaatacatttcctttctttataagccactgagttcgtggtattttgttatagcagcccaaatgaatgaagaaaactgcattccaggggaatgttaggcagtattatctcacctcttcatagtgtgatgtctgtgactggctcagttcatgcagctctacttgtggaatgtgcattacatttatttatctatatcaggaattcttaatcctggagaaatttcaagggattgttaaccccttgaaattatagccctaattttagttgtatgtgcttcctcatggcgttgatacacttctttcaccaaattctcagtcaggtccatgttccaaaaaatggttaagaatcaccattttgaaatccttcttgctattatgccagattctcaaacagctgtatctggatgataggagaatgcctctttgaaggttgcttttgtgcatgttggcatgggggaggtgctaaaatttcagatgggatggccagggcaggctcctttagaaggtgagttgagtggtggggagagcagtggatgacgagtgggatctgggaccttgtagtcctgttcaggacttggacttttactacaagtgacaggagagggctgtagtgctttgagaaagagagacatgatctggtcaatgtgttaataagatcactgtgactactgtgttagagagacatgatctgatctgtgttaagaagatcactttaactgctatgttgataactgactgaactggggagcaaggacagaagtagagagcctcttctgatagttccgggaagaaataattgtggcatagaacagggtattggtagtggagagggtgacaaattattaaattttgaaattgctttgaaactctggtattattaggatgttcatgaggatgttagctgttattttataaaattaatcaataattttcttagtgttaggattatttgtactcttctcctaaactgttcatttcattttaactactcagaatttataattgaacaatacaaccataagaaaagttagaacaaattaatggttcatccttaggaagtgtcttcatattaatggtgtttggtgtattaggcttattttggtcatcctatctttaattttccctttgcttcattcttttttcaccaatttaaaaaatttctgtcactttttctgtcttttatttagacagagtctcactttgtcatccaggctggagtgcagtggtgtgatctcagctcactgcaaccttcacctcccgggttcaagtgattctcttgcttcagcctcccaagtagctgggattacaggaacacgccaccacacccagctactttttgtatttttagtagagacagtgtttcactatgttggccaggctggtcttgaactcccgacctcaagtgatccacccgccttggcctcccaaagtgctgggattgcaggtttgagccactgcacccagcctctttttctgtattatttgtgttttaaaaaacttctttatattcctttttgtacagtttagggtgcatgtttctctcattgaatctatgtcagataccacctttcactgtctcttcaaggttgtgtctatgtcctttttacacttgtgattgtttctctgttatttaagaatgaaacctgattccacgaatccaaaccatcagaatagtttgtgttttgcatggaacattaaataaagaagtggttgttttatgtaaggaaaactgctgatctatttgatcacttaactgaggagaccaggtgagttaaaaacaagccaaatcatttgttgaactgaattactatagtcactagtaagtttcatcaaagcaatccagtgatatgttgtatctgtgacacatcttgactataaaacttgcccttgagtttattttatgagaacatcttatatcaagaacaggtagcataaaaagcagggaggaatttgtactcatttaatataattaaatcatgagggttccaaacagtgtactgatttctagaaatcctaaagaaccattgtgatatcagtgtataaagaacaaaaattctgatgacaaacttgtagtgtgaaaaacaaatttactggactacccactgtttatactcatttattttcttcctgatagtaagttgtaaaataaacaaacacttttttccatttacttatcatgtggtgccaattctcacttatcatatggtgccaattctcagatatgagtcatgagacatgtttcttaatgtttttttttttttttgaatcagaagtttttttttttgttttttttttgtttttttttttttttatactttaagttttagggtacatgtgcacattgtgcaggttagttacatatgtatacatgtgccatgctggtgcgctgcacccactaacttgtcatctagcattaggtatatctcccaatgctatccctcccccctccccccaccccacaacagtccccagagtgtgatattccccttcctgtgtccatgtgatctcattgttcagttcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattatggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtgtaaggtgtaaggaagggatccagtttcagcttcctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtaccagtaccatgctgttttggttactgtagccttgtagtacagtttgaagtcaggtagtgtaatgcctccagctttgttcttttggcttaggattgacttggtgatgcgggctcttttttggttccatatgaacttgaaagtagttttttccaattctgtgaagaaagtcattggtagcttgatggggatggcattgaatctgtaaatgaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatagaatcatgtcatctgcaaacagggacaatttgacttcctcttttcctaattggataccctttatttccttctcttgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagggttgttgaattttgtcaaaggctttttctgcatctattgagataatcatgtggtttttgtctttggctctgtttatatgctggattacatttattgatttgtgtatattgaaccagccttgcatcacagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcctccttgtacctctggtagaattcagctgtgaatccatctggtcctggactctttttggttggtaaactatcgattattgccacaatttcagctcctgttactggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcctttcaaaaaaccagctcctggattcattgattttttgaagggttttttgtgtctctatttccttcagttctgctctgattttacatatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttgggttggagagttctgtagatgtctattaggtccgcttggtgcagagctgagttcaattcctgggtatccttgttgactttctatctcgttgatctgtctaatgttgacagtggggtgttaaagtctcccattattaatgcgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttcattggagcatttagtccatttacatttaaagttaatattgttatgtgtgcatttgatcctgtcattatgatgttagctggtgattttgctcgttagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctgtaaaggattttatttctccttcacctatgaagcttagtttggctggatatgaaattctgggttgaaaattcttttctttaagaatgttgaatattggcccccactctcttctggcttgtagggtttctgatgagagatccgctgttagtctgatgggcttccctttgagggtaacccgacctttctctctggctgcctttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagttttttccaacttggttccattctccccatcactttcaggtacaccaatcagacgtagatttggtcttttcacatagtcccatatttcttggaggctttgctcatttctttttattcgtttttctctaaacttcccttctcgcttcatttcattcatttcatcttccatcgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagagacgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccgtgtgaggtgtcagggtgctcctgctggggggtgcctcccagttaggctgctcgggggtcaggggtcaggaacccacttgaggaggcagtctgccggttctcagatctccagctgcgtgctgggagagccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttggagcttcccgctgctttgtttacctgatcaagcctgggcaatggtgggcgcccctcccccagcctcgctgccgccttgcagtttgatctcagactgctgtgctagcaatcagcgagattccgtgggcgtaggaccctccgagccaggtgtgggatataatctcgtggtgcgccgttttttaagtcagtcagaaaagcgcagtattcgggtgggagtgacccgattttccaggtgcgtccgtcacccctttctttgactcggaaagggaactccctgaccccttgcgcttcccaggtgaggcaatgcctcgccctgcttcggctcgcacacggtgcgtgcacccactggcctgcgcccactgtctggcactccctagtgagatgaacccggtacctcagatggaaatgcagaaatcacccgtcttctgcgttgctcatgctgggagctgtagaccggagctgttcctattcggccatcttggctcctccgtgaatccgtttcttaatgttttacactattctttgtggtaaagtgtggtttccattttaaattacatctctcagaataataggcagctctgaaaggggttgtagagaccatctaacagtctgatttgtagatgaggaacctgaggtctagagtgttgaaaacccaagtcccacagctgattaccggaagagcttagcctggcacccaacactcctgatgcctaattcaggtaggttttcatccaaagtccaagccacatatattaaaattatactactatttggatttatgacatagtagtacaaataatcatatttgtgatactccaacttgagtagaactcataggaaatcttgtctctgaagtcggacttcatgtgggtatattaagccaccagacttttaattattctaactctccaatattacctcatctgcaaataaacaataggtttccaaaggtctactggtaaaatttctcctctttattggaaataaataggcagttgttacctatgcaataattatttggccttacaatatcatagtaaagataaagactttagaaaacagggaaattttaagacctgagcatgaaagaaattgaagacggtgatattaatgatgttaaattagctgttacatattttatcaacattgtgagcacttgcatttagttaaaatttcagtcttatcccgtgatacctgtcctggtttgttatggcataaaggaacattcagtttaaattttttcgacttgtatttttaatgatgtaagataggatgcgtacaggaataaatctgtagcctaattttacgtgagatatttctcagatattgatctagagtatcacatgtaaatttagagacttatctataatccctttccttttatgttttccacagacaacttatatatatgtgtttttgtttttgtgtgtgttctgattttagatttaccttttccaggtgtacttctctgaagtaagatgatttgtcaaaaattctgtgtggttttgttacattggggtaagttatttgctcatttgctgttttaatgcccttaaacatggtagagattttgcctttagagatgctgttttatttattagctaacagaatttcctatttctagttaggaattctcatacatgcttatgattaaaaatgcaaaccatagtataggtgtatcagtgtgaaaacgaaaacccttcccaacctcctaaagacaacctgatggtgtatccttccagaatcctctctctctctcacacacacacacacacagactcacacacacagactcacacacacacatacacagacacactcatatctatagctgcaaaaatagcactggtctgtacatgttgttctggatgtttatttttccatttaacaggtttccaatttatcatgatggctttttacctttatcagtatttaccgggatacttattagtttaatggttgcatgacaatgcactgtatgaatatatataaaattattagtctatttgaccaattcctgattgatagacatttctttttctgtaacaaataatactgcattgaaacttcatgtgtctttgtatatttggaaaaatatttctgtagattaattcttttttttttttttttttttgagacgcagtcttgctctgccgccagactggagtgcagtggcatgatctcagcccactgcaacctctgcctcctggattcaagcaattctcctgcctcagcctctcgagtagctgggactacaggcacgcgccaccatgcccagataatttttgtatttttagtagagacggggtttcactgcgttggccagatggtctcaatctcttgacctcgtgatctgcccgcctcggcctcccaaagtgctgggattacaggcgtgagccaccgtgcccagccgatacattgccaataacttttgagcatactgttctcacgtgtttcttaccacattctggtgacattctgatttccttaaaccaaatcatctaagttagattgtgttccaagtttttgaaattaaagttagagtatctttaacaaaacttatgtgatttggcaattgtttatctagctttctttaacaaaacttatgttgtggcaactttatctggcagctgttacctgtgtgtcaactgattctgagcatctccttggctaccccaatctaaaggggctcttctaagcttccctataggtcttccttgtggtacatacttctctttcattgcagccatctgtatatttccagaaaataacctagatagctccaccattacagatttccaaaaaattatgccacaagggactatcaaagagaaataactcattctctttttatattctctaattttattagatatatttaagggaactgttcattctcttttataattctctattaattttcgttagactctagtgttttacattgactttctggaaggtttctggtttgatcaagtttttgaatcaaaagaattcctgggatattgttacctgataagatatgccttcagatgaaaattctagaccatctttagagtttaggattcatttggagggaaagaaatatcatttgcaaagttgcatgtggataaaatagactcatcttttaatttaactgcatcaatagttgctatgtttttaaagttcatcattacattttacatttaaatacttctgtgaggattttaggctaattcatttcaagcaactgaatcctctatgtagacctagaatatataatgctgtaaattagtaatattacatattcttggttttgtaaacctcctccctcaaaaaactattctgttttctttgaggtgttctgattttagaaacatgttagaaggagtgaagtccaaaggaacataattgtaatatggatttacttttggtaatgttgtgatacctaattgttatcagtatggccatagtcacatttgtcacattaatcactttggcctcaatttttgcatctatacctatttatattaatttatatctatagaaatctttagaaaccaaactattaacagtcattacctatgtattgtttgaatattttcactgataattgcttttgtaatgaaaaaatacatttgtgaattgattaaaaattttattttcttacatttttaaaaagcctttattttttagagcagttttaggttcacagcaaaattgagaggaaggtacagagattttccgtagactccctgccccacacatttataaccccccattatcaactatcccccctcagagtggtacatttgtcacaattgatgaacccatactgacatatcattgtcactcaaagtccatagtttacattatggttcactcttggtgttgtatattgtatgaatgttgactgatgtatgtatagtgacctttatctgcagctttagaaacatacagaagaatttcactgccctacccatcctttgtggccttcctattcctccctccttcttacctaactcctgggaactgccgatctttttactgtttccatagttgtgcgttttatagaatgtcataatgtcatatagttggaataacatagtatatagtcttttcatactggtttctttcccttagtaatatgcatttatgtttcctccatgtcttttttttcctctttaaatttttatttttttagattcagaggttacaagtatggttttgttacatggatatgttgcgtagtatgtacatcacctgaatagtgaactttgtgtacaatactacttataagtgagaacatgtggtattggattttctgtttctgagttatttcacttagaataatggcctttagctccatccacgttgttgcaaagtacatgcttttattcttttttatggctgcatagtattccatggtgtgtgagtgtgtgtgtgtgtgtgtgtgtgtgcatgtgcatgtgtgtgaatatgccactttttttaatgcagtcattcattgagggacacttaggttgattccatgactttgctattgtgaatagtgctgtgacaaacatatgaccgcaggtgtctttttgttacaatgatttcttttcctttgagtagatacttagtagtgggattgctggattgaatgatagttctacttttagttctttgagaaatctacacattgttttccatagaggttgtacaaatttacattgccaccaacagtgaataagcatttccttttctctgcatcctcaccaacatctattattttttgactttttaataatggccattcttactggtataagatggtatctcattgtagttttaatttgcatttttctaatgattagtgatattgggcatttttttcatgttcattggctgcttgtatgtcttcttttgagaaatgtcttcatttcttttgccttctttttaatgggattatttgtttttttcttgttgagttgtttgagttccttctaaattctggatattagtcctttgttggatgcatagttctggaagagtgctggaacctctgtatcttttcgtgacttgatgtctcatttctttttagccctgaataatatttaattgtctggatgtaccacaatttacccattcacctactgatgaacatcatgtttacttctatttccttacattattacatttgccaaactcttcaaaattctcatttcatacaaatccatacaagattctcagaattcgtattctgcattagtgtctatataagccaacacaattgttgcatcatttgggtaacttactgaaaaaacaattatggagaattattttattttcaaacaaatatttaaaaataagtttggctgggtgcagtggctcatgcctgtaatcccagcactttgggagaccaaggtgggcggatcacctgaggtcaggagttcgagaccagcctggccaacatggcaaaaccccgtctctactaaaagtacaaaaattaaccgggtgtggtgggaggtgcctgtaatcccagctactcaggaggctgaggcaggagaattgcttgaacccgggaagcagaggttgcagtgagtcgagatcatgccactgcactccagcctgagcaacaagagcgaaattccatcttaaaaaaaaaaaaaaaaaaaaaaaaaaaagacaaggtttaacttttgcagatcttttggtacaggattatataattgttcttaatttttatatttaaacagtgataatttaatcagcagtgggcatttcccataagaagtctattcttttgcatcattttttgtgtaatgtgctaagggcatgtcttatatgatgatgttttgtatttggaggatcatgggaaaattcaggagatcatcaagccatcatcatgttgaagacaaattctttctaaaagtgctcagcgaaagcagtgttaatattttggtgttactctcttaaatacatattaaaatagcactttaatgtttgtttatataattgcacatccagatatttatttatcatttatactggatattatatttatcatttataatggaagctagaataatatgctttagaaaggaaaaataaaatattcagtgtttgtttccttttattaaaacataaatataaaatgtcagcttaaagagaaaacatgaagtgtgagtcttcaaaaagaaaagagatgtcagaaagtggagtaatttctacaaatgaatgcatcctcttgaatgtaacacattgtacaatggaagcacaaagttattcattagacactcactgaggacttagaaagttaaataattattgagcactacatggtttaatctcagatactttctattcatgtcttagtcaaaatgattacttttttctatgtgtctttttaatatcctaacagaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaataggtaagcattagctatgttttaaatgtattgaacaatgttttttaattctttgatacctgtatgaaatagatgtcttatggctatgattttaacatacataatcatttttatatggataataaaattaggattcattatgtgaacaaactaataaataatttccaaattatcttgtatcccataaaaatataatgagggaattattttacttttaagtacattccttgtagtcttctaaatttgctttgaaatagaaaaacacaccttatttttgttaaatgtataaaatatcaaatgactgataatattgttgaattggttaaattttaaaatattcatgaataataataattcttcaggcaaggaatatctctgaaagaatatacgttttaaagatgggtttttcagaaagaatagctaatggatgctgggcttaacacctaggtgatgtgatgatctgtgtaacaaactgctatggtacatgtttacctatttaactaacctgcacatcctgcacatgtacccctgaactaaaaataaaagttggaaaaacaaaaaaagaaaagaaaaaaattctttttttttgtttaagtataatgcatactgattgtagctagtgtagttaaaaattctgcatctggaaatataaacaacaaaattatcccaagtcttttggaaaagctaggaagagtggagtcaattgactcatccatgtagagagacctccagtatgaaaatacaggcatatcttttcctcccttaaaagcgtgatgattgggttttcacatgtatgagtgagatgtgcctccctcagaccttgttatgatgttggcacattacctgtctaatgttaaaaaaaaaaaaaaaaggctgggcacagtggcttaactgcctgcaatcctagcatttaggaggcctaggcgggcggatcacttgagctcaggagttagagaccagcctgggcaacataatgaaaccccatctctaccaaaaaaaaaaaaaaaaaaaaaaaaaaaaattaactgggcatggtggtgcatgcctctagtcccatctacttaggagactgaggtgggaagattgcttgagagatggaggctgcagtgagccatgatcacatgatcatgccactgcactccagcctgggtgacagagtgacaccccatctcaaaaaaaaaaaaaaaaaaggaaagaaaaagaaaagtgagaactgagctaggtgagttttgagctcttttgtcctatttaagtggtttgaaattaaagaaaatttgagaagcaataattgaatttaattctattactttagaaaaaaggaaactgagggccagagggactaagtgatgggcaaacgcatgccactagttaaagcttgttctttttctctcagaataggcaatggaagttgtatcagaacactggtaaatttgatttagctcttctctttcactgagttgttcagatggtttttgagatttcatgtagttgtttttttttttttttttttttttttttaaattcagatgcaaactggaacatacagtgctggctaaaaggagacttaaaattattcatctgttatgtggagtcattatttaagaatctattcaggaattataactataaggtccatcttttatatgttctgtaagtaccaaataattaatttggcatttctaatacacagtttttttaaaagagctttcatatacggaagtagattataaacctcttgcatccctacatttcctattatatgttttattttttaatatagcattctgctctgttaggtttcctcttttctcctcctgctaattgaggtagcaagacagtcaggtttagggtcacgattgtcaggtccatgagtataccaaatgttcagttcaagttcaggttctagctcacactgaggtccgaagggagtgggtggatgggcaatagctgaacgaacactctgggggccttaaacaggtgaaacgtagttttattcagcagctctctatcagcagcttactcaaactaggtctctcattagcagctctcttagcagcagctttctctcactgtctgctctgttttgactgcttgggccagctgctcctatgcacagctgcacggctggctctctcttgccttcagggtcagcagcttaactctttctctctctgggcatgaacatgaaccatgctgtgccatgttgtgccatgctgagccatgccctggctcccctcgtcagagcaagactgacagctctggtactctctctctgggtacaagagcgcctgtacaagaacatctgtagagtgtcagcagggcaattataccttttacagacaacagtggcatatggccaagggatggccttcccatgttatggctacatggctgtgataacagatggagttatatgcctgcgcactactcgctgagtcatgcaggcctggacatctgccttggcctgattcttgaccgaagcacatccatgtaccttacaaagatattgcaggtataggtgggcatgtagtctgaaagaagagtgaactcagttcaggagtgctagatatttgagtggaaaaggaaaaaaggtgcgttttatatttctttttcagatgatttttcgtattcgatctctttataaacttaaaaatatgggtggctaatatttgtgctagaaagagaacaaagatattgttttcaaatagccatatacttataactcaaacagcgaatatgtcattaagttttctaattactctagtgatgatatacaccatttttatgtcaattttaactctttaaaattctttctcattaattcttctatttgatgcttaaagtctcgcttccttcagttctgcagttattgagataataccgttgaggagcaatgtgctagaaactgtccctatacaaatgaatagagacagaaagtaaagcggggctgagaggagggggaattggggagttactgtttaatggatataaagtttcaatttgggaaaatgaaaaatgttctggagttggggagtggtgatggttgcataataacgtgaatgtatttcatgtcattgcactgtacacttaaaatggttgaaatgttaaattttatatacattttattacagtaaaaatttaaaaagaaacttaaagacatgtaaaaaaggatgaatggttacgatcactgtcctttaggtgctcaaaggctagcagttgggacctgtatgtacagagtttcagtttaagtggttaccgatatgtatttggtaggtacataatgtcatgggagcccatcattgttgtgagatcttagatgggggttatctagttaagctggtgagagaagagaggaggaaaggtttcctaaggaagtagatagctgagttgagtcattagagataaataagagctaatgagaaaatatgtgggcagtatagtgttgggaagagatcagtatcacctggaaccttgttagaaatttaaatttgcatgctaaatgacgagttaatggttgcagcacaccaacatggcacatgtatacatatgtaacaaacctgcacgttgtgcacatgtaccctaaaacttaaagtataataataataaaaaaaatttaaatttgctagctcacccctgtgaataaaaaattagggggggtggagctcattaatatatgttttgccaagtcctttgggtgattctgatggaactcaagtttgaaaattcctgctgtagaggttaatatgacagattttagagtcagactacctggctgtaccacttactaaatgcactcacaaagcacttgctatgtttaacagttgttctacctctagaaattaacacaatggaaatatttacacaatgtttaaaaattatttgttgaatgaatacatattgccaaaatgctttctaaaatattttccaatttaccctccagaaatgtcttaatgagccaaaaagttaataaaaaaataatattgtctgaaggtgtgagtagtgagtagtcaacggtcagatatagcaggaagatataataaggtctgaatgatatgtacggatttggcagtgtgaaagtaatgggtctttaggcagagctcattcgggggagcggaaggagaggttgccagaacaaagggaaacttgaagaaaggacccggaagagctgatctttatgctagttcctcattcagttgatggggggacactgcagagctggaattcatatatccaaggcatactatggctggtgctgagaatatgaaaaaaacctggttactgggaccaactgctgctgcccaggtgaggaacctttggctggagtgatatttcaagaatggtaggcaaaacaggaaggatcaactcccttgtcactccattattctagtctctttctagctcccccacaggtagaatttaacaagaatttaggtagcagaggagaactatggtttgcagagttccagccccagcatggtgaaacagagcatagggtgcatttgaagatggcagtcaatagcttaaccaccagcaaaattcacttcattggctcattggctacttagaacattcacacacacctttctacgcatacctacctttccctacaacttccttataacttcatgctttcacttaattaagtgcaactatactttaaaaaaaaaatcaaaaagatcctttatttcatgtgtatgtagtatcataattcatcaaaataatttataatagttaactgcccctcaaatattgttttataaatgatgccttctgaagttaaacataatgtagattcattttttaaaaattgtctgtttagaacatactaaacaaatgataagttaaaaaaaaatataattctctcctgtgaagtcttctaagaaaatcatggcaagttcctgataagataaaaaccattccatcattaaaggggattaaaaagaggcataaataaatttgaataggaacatctgtttgctgagttttgtcattgtgtacaaatgaaactctagagttaaaattatattctgatttccttctataagcaagaaattccttaatagaagctcagaaatgacctcagtgccttggtgaaacatacttcttcatctgcggacactcagtgctcccatctctatcagatctgctgtgttacctctgttaacattcccaggcatctccaggaagacgggagatgtcatcctctccaagatggctctaccaaaccaaggctttcctggcaccaacaacgttctttctaaagccctacacttcacagaggaggcaaagcccgacgaagcaccatttctgccacggtgtccaccttaagcttccaactgccactgttgtgaggaggagccatcacagattgccatagccacagagtcttcctgaccctgtggagccactgctctcaggcactgtccagctgacgtctggtgtagccaattattttccccaaaggtccatgtctgcctgacccatggcactccacgagttgtggtgggtctgatgagctagtttctgtcatacctagacaaagaagatggtttaaaaccaattcatgctcttcattataaatccagatctgatttgggtccccatgctcacaagtcttaagcactagtaggcctcctttccaacttgggcagccctgagccaccagacatttgttggtctggaggtgatagagccttccaagttgaaggactttggggcattttggccctctactgataaaagtgggttgctgggatttgtcatgggtcccagatatctgcatctttgggtaaatattacccaaataccattcaaatgatttgcatcctaacttctttctcaattcaacatgctcactgatggttccaaagcttttcctctccagattaagtcttaaggaaaaatactgcgcctttattcatccagccagacatgtgccagctgcaaaaagttgtgttcatggcatcccggccttcaggagatccatatggtcccctttttttggaaaatgtgtcctactgtagagcaaggcatgatgaagaacttacctccacacacccagatctgaaatgttatttccaagttttctcctctccagatatccatgccagtatcatactgtccaagttcctggaaatactgtctgttcctggcaaacaatcctccagccattatcggtgactttgttggtgctgtggctttttctgctcatcctagctcagaaaggggaacaagctcctatttgaagtgcagccctcagttgaatcctccacggacaacagaggatgagctgtaggctagcgtgttggcactaatgatatcaatcactgagaacatcatggtctgctagtccacacagatgacagccagcaagggctgctgccacatcacattcacttcaattggctgtctaggaacacaaggacttctgttgtgtggactgctacactcattcttccttgaatcaatccctcacactttatgtttcttataccttaatttttccaaggaggtatttttggacatattcatctcgtcctcctttcaagtcatcaaggtcgctaacaacatccataaagatgatttcatgaagcaggtttgctggcatgcaatttgtgacaatgtgcagcatctggagacagggcagaaaaagcttcattgtggaaacagataacaattatgtaagcaactggcaggtcaggaggtaggactttacatgctgtattctttgtccctggcacatctctgtggtagcctgcagttactgataagcatattaaaagcacatttctgatagcccgtctctcaactcctgagcacgttaattaaaaatcatgcctagttcagaagacaatttcaagtggcctttttctggatcttcaatatgaccatcacatcatcaattttgtttgcttcgaactgtggctctagtaatagacttggaccttgagtgaatcaggaatagaattgttttggaaatggtccatggggtccaggccccttgagcacattctttttttttttaatatagtttaagttctgggatacacgtgcagaaagtgcaggtttgttacataggtatgcgtgtgccatggtggtttgctgcacccatcaacccgtcatctacattaggtatttctcctaatgctatccctcctctagcctcccacccccctacaggccccagtgtgtgatgttcccctccctgtgtccatgtgttctcattgttcaactcccacttatgagtgagaacgtagtgtttgtttttcggttcctgtgttagtctgctgagaatgatggttttcagctttatccatgtccttgcaaaggacatgaacttatccttttttatggctgcatagtattccatgatgtgtatgtgccacattttccttatccagtccatcactgaggggtatgtgggttggttccaagtctttgctattatgaatagtggatgagcacattcttaagtggctgagtcacttcaccgaagttgaaatgaacaaaaaccaaaactgcacaggtcacagatgtaaaaatgtacccataacagaaatattgaactgtgacacttcccataatagacttagcataactaatgggccattttcaatttctgcagcactggcagtggccttccaggactcaggctgtggcatctttcctcctgccacagcccctgtctgagccacaggagctgcccagggggtgaggagtggtgggctacactttgaacaaaaggagacagtcttattctctctcccaaatgggatgatgctatgtcacagttgtcattatgttttctgtgcaacatgtacagtattgctctctgggcagtattaattgctcctcacattcaatcactgtttcacctgaatgaatattgtggaagctaaatataaaattgtaaatttaataattccaggaatccttatataaaataatagggggaaggaaaagattgagaagaaattagttaatatatagaaacacacacacacacaagcatactgtaagggaggaaatatgcacagctgccactgctcttctttctgtattgattaccaggctgtagttaatatttattactagtgttagaccactggactaattctttaagtcacccagaggaggaacccagatatagtgccactgccatcatatctggacattgaatgtccctgtggtcatcatttccacatggaggtcacctgatgccacgactgatgaacctacaagcccctgcatctttgtgcaatcgtcatgagggctagtgtctcagatgtagttatctagttggtgagaaggtgctctagctgccagtgtttcagccttgtatgatggtagattcttcagtcagatattgggcaaccagcaagtagacaaatgtccttaacaaaagtgactgagttataaatctctagaggcctgagaagcctggctggggttggaaagtggaggtggaagactaatggataatgaatgtcccagggtggataattaaaggatgaaatcatgagtttgtttctagtctatagaaagtgacccagcagggagagaaaagttgataatcgaaggggagccattgaagatattttattgagagtgaataatggaataggccaattccatgaaaagagcacagggttggtcttaaagaaggtttacctcaacttctgagtattgagagaagaaaggaagccctatggtggatgaagatatatttgaagctcagggcagtttcctgctttattgagcaaaataggctttagctcagagaaaagtattcctttgcatagtagtaccttcttgcaatgacctaaatgctttggatgtgattaaaaattctcacttgggtgcctactctagacaatttctgatcttatcagcaggttaaggcaaaatgctcagttttaaagccccgtgaatatgtgtaaggtcttaaattctattatgtatatattataattatgatgaggtatttttctgaaaaagataagtatatgtgtaatatatagatatatataatttcagagcattataaatttgaatagttacttagttatagctgagaattttagcttcagtttagtcagccaaacagtcattggtctattcttctaaacaataggacccagaagaatgagaaaattaggtaaattaggtagattttcaaactttcttacaagatgatttttaatttggtcttcttttacttggaacctaggtttctaaaaatattagcacagtaaaacctgtcataatttcaaggaatttgagaaacagtctcccatttttttcctgccacattatatacctctatgatttggttaatatgttcattgcaccaactatcacatgctgtttctgcctttaattgtatttttgtttggctcttaaggcaatgtatctccaaacaattaaataggactctaattcaatgggtagagctggtcaatataggaagagctggtcaatataaccaatgagaactccatggaagagaaaatccataatggtgattactatagaaaagctttgaatcagactcacctattttggacatcagagaattcacaagagaaattttcaaatgcttccatgtgtaaaaaagtatattttaaaagggataaaatctaatgtttgtaagggatttaaaaccatataaatatgtcccttaagggaaagctttgtttgggctcagatattaatgtttgtcagagagtctgaaggacagatactctagaaatgtaatattttgaaactgctctgagattttctcttagatctaggaaggaaattctctttctttattaggtgcctactgtgtgttccaggcacggagctgagcatggggaacaaggttctacaacacagactcagcccttgccctcctggagctaacattctgtggtaaaaacagaagacataacagcaaagtttggaaaggctgtgctgtaataaatacagtgccttgtggaaacaagtactagggatatccagcccaggtgaagagggggcagaggagaatgagccagagagtgaagaacatttgcaaaggcccagaggcacagataccacatggcaggacttgaaaagttgagtgtggtgggactgggaagctggggaatgaagagaaatcaggatggagggatacacaagggtcagattatgaagggccctccaggtcatgcttggagtttgggcttctataactactaacacctactttactttgttttcacaattactcctgccagcattcttgatgatttcagcatccatgtgattaatcttcagtttcttgaatgcttattttcaatattcttgtattttcacaccactttgttcaccccttgtcatggacatgctcgagactttgtcatcaccaataagcatgctttttctataatctccatgtcaagaatcctgctctttgaccatctccccttgcacccttcatgttagtttattccctctactactcaacttcaggaataattctccatggttcttggctcccccttctgggtgccaggttctggcctgagtaaccctctcttcttcatgaaaagcagcccatatgcgcatctaagttgttttcacagcctgctttcctaccagcacaatttttaatggttgaaaggctttttttttttttccattttgttctgtctctgtctctttctgtctctatattagcactatttctgctaatacacttctctcacaaaactacctggacctccagtggatctctctggtgttcactccattagatatgataaaagcctgcaaatctcctagagatcttttctctgtcttctctttgatctttgctcagaaggcatttcttaattttaacagtgtttgctatctggagaggctagacacttcaagactatgaagtcctctttccttttgtttaagggccctttcttcaatgtatatctctcctcttacagcaagaagaaaccaagagacatccgcaacacttgctggaaatctccttaaatatatcattcagttcaataggcacattctatactttccacataactacagatggtaatgttaatgagctctctgctactacacaagaaggaccactgttctccagtttccaataaattatctctcacttccttttgtgccctcactggcagagtctttgaagtccgccagatttctactaacagcctgttcgaggcaatttaggttttcttcaccatgcttctccaaatccttctagcctctgtctgtccgctggttccaaagccactcacacattttcaggttttcattatggcagcaccccactttcaagttccagtatctgcattagtgatctaatgtcatataataaattaacccaaaacttagtggcttaaaacagtaatcatttattatctcacaatttctgtttttaaggaattcagctgcagcttagtgtggggtggaatgggaaaggagtatctgcttcagggtctcttacaaatactgcactgaaggtgtcagccaccaggactgcagtcatttcaaggttcaacttcaggaggagctagttttgagataaattcttggggttccaagttcttcatgggatgttggactgagggcctcagttcctccctggctatcggctggagacctccttcagttccttgttatgtggatctccccataggacagcctgcaccattgcagctggctttcctgagagtgagccagagagactcactgatgatcttgctttttattttcactgagacaacagaagcaggtggagtttctctaatgattgcttttctcacccaaatctaccaggctgcctgtatcagtgcccatgcacttttcctctcttcttttattgtgaataaattctttgagttctgatctaaggcaaaccctttgttacgtgttctgagtcccatctcttattgtcaactcaaggactttcttgccattatcctctattttctgcaccatcatgtttctctctcagctaatagacacgatataataactcccatttaaaaaaataaattttctctgttacacatttctgtcaagtaaccaccccatttcactacttcttttaaagaaaacaaagttttgaattgtatgaatacattatatcttcaaaagttaataaaaaagtcaacaagtgactctggccacgagggaataagagggtctggattactctcctgtgataaacaactagaaaactggaaaaaatgtaggaaataattattttcagacattggacaaagacagacagaactgtgattcctaagagaaggaaacaaaatgagtactcctagtacttaggctttctgaactgtagaaaattcccagaacatggcacagagctgaggaactcaagctgagcccaacaatcttgcagagataagagttcagagagggtaaggggctcaagttcatggggcagagtactttgaaagcaggagcatacagaaaaacttacagtggggccactttaactctttggctgaatatcaatctggccacaatgttgggtaagaaaaacttctagtaagagaacagttatcagggagctataagctaaacaattcacagaattcatagaggtctgggaatcgttcaagttcccacaaacgagattggagagaccttaatgggtatcagtgacatttcataggaactccagaagagctatactttaaaggtggggccaaattagccttagagtcaaggctacactatactattccccaaaatgcttaaaggatgccctaaaagattcaaattagtgctcaagtaacttaactgactttcagaacaaaatccaacactcttcaaggcaaaataaaacaatgtaatattcaaaaatgaaataatcacagtgtctggcagccagtaaacacatgctagatatatgaaaagataggaaaatgtgacccataaccaagagaaaaagaaaaaatagtcaatagaaacagacccggaaatgacagagatgatagaattggtagacaaagacagctatcattaatatgctctacatgttcaagaatgtaaaggaaaatatgaatataatgagacaggaaattgaagatgtaaaaaagaacccagtgacatttttaaagatgcaaaatgcattttttgtaaacaaaaatgctaaatattaatttgggcatttagaataatgttattcaataaaatagtatttatggtgtgcagcccatagtgctaggctctgtaaggggtgcacttttcattctccttcccttctttcctttctatcaggatggactcatggattcttattttagtttgtgggctacaaaagttacatcatttattttattactgaaatcgtctttctttctagcagtataagatgtaccaggttgatcttatacttttcctgatataacactggaattagccatttctccaaggagccatcgttccttttgttgaagaatggtatttacaaaccagtgtctggaggatagttgttcgttgttattgtttctagccctctctgtgtgcagagctagttagtgcacacaatatatacacaatgtgtgtacataatatacacaaatctatatatctatatatctctgtatgtacatgtattaaagggtgtgtgttcatactaatatgtcccattctaggccaaaactgcacagtccgttctaaacttcttttctttctgttttgtaactttcttctccagcagtgagaaagaaacctggcttccctttcccacagtgtgttacttatttgctcagtgctagaatacacacaaagcagttttagcattgctatcccatactgctgtgaaaaatgaaaacaagcgtactaactgaagtgcaatattgtttacactcattttgcctttactaaggctaatgggtacatggtcaaatattatgttccaaagttaaataggataggtcttccctctcccttcaggtggttatattattaacttggtagacattaagttctgtttgtttcagtttgcattcttctttttttcccactttctcttctctttgttgattttccatttatttggtgatatcttacatctgaagagtactttgcattttacaaaatgcttcttaaactttcctccttgataagatttatctaggtcagcactacttacttggcattcaataggtctgggtggaactagattgcttgcatttattcagaacatagattgcttagctctggaccttctgaattcctcatggggtctaggaatctattttttcacaagttctccaggtgatttttatgatgagtctagtctgggacaataactcagtctcaaattattttggattggcaagagaaaattttgaggtaatgtttttatagattaccaatctgaaatttaaaataagtgacttgattaaatgatttacaaaactaatactaaattttctaattccacttcattggtttgttcactattttgctgtcagtttacattacaatcagaaaattaggtggcaccaatttggtgttattcctgtaataatttagcatagaatttgcttggagaagctttaatatattcacattttctgggaagaaaaattggaccaaaagtcagaggacagaatgtgctttctttctaaaccatgtatggctaccaaaaatgaaattccaatactaaagaattatatctctaccttttgtgtaaaaatattaccaaaaaggcaaaaatggtaaagagacaaaattttaagttcatttgacaactgttttcatactattttcactttcaagtaaagtttatttacatgtagaggtattaaataaatagtggcactgagtttgtatatgtgtatgtatactggtaaggcataaaatattttgttgcatataaaattttcaagaattccagaaattcttaatgtttgcttgttttaagccaagtatatctcctgttacttttaaaatttgatgatccttttattctcatactttaaaattatcaaatttgttagagtatgttttgatattagtaaaaacagagttcttaacttcttatactgactttggcatgtaacaaggttggtggattccaggtttcacacaaacttgggaaactcctctcacaaatacaggaaatagctaatgtttttccttaaagaaaagaatcatttgaagtaattatataattctctaattttccatttataaaaatattgacatgattcaggttataattattttttagtcatggttactatggtctttattgatctctaaataaaatggtgatgataacagtgaaatttatcttgtgacaataaggcacgttgggtgtaatgaaatgaatattgaacatgatgcacaagacttcagttgagttccaggtctaccttctctccaaatctcagttttcttacctgtaaagtagatgatgttagttccctcaaagggtgctttgaaaaactggattagataatattactaaaggtgtttcatgtaaattgtaataatgaaatttgatgatatatttaatgtgctttctctatttttgtgtcctttgcccatcaaatacccaccagtagggagtacaaaatacttttggcttatacctggggagggagaattttcttttttcttaaagggccaaatagtaaacattttggggtttgtggaccatcctgtcttggtcacagctattcaactctgtgcttgcagaaaaacaattatagttagtatgtaaattgaattaatgttactacatttatgggcactgaaatttgaatttcatgtatcatgaaacagtcttttttttttttaattgaaaatgtaagtaaccattcttagctcacaggctgtacaaaaacaggcagatggctggatttggcctgtgggccagagtttgctgatcccaagcttagaacattttgaaattagttttagattgatgctgatagtgtcatgatggggttagctgttggcatggttacagaaagcttttttaaaaaccaacaaacaatgaattactataatgcatattttataatgtagatactatatagtcattattaaggatatatactctatatgatgttttgcatgtgtattacaattattaacaaaatgaaaaagagattgaataaatagaaaatacatcagtgaagggatgaggaaaccatagagttaatctgattttaaattcgcccttttttacaaatattcagtgtatttagaaaaggatggctttggcaagaccatctaaagtaagatgatgtgattctaacttttctttttgtcttaaaatatgactaaaattttctatcatttaaaatgttagcagagaatatatttgttgttttgtgctcaacttaggcaaatattcttgctttaaaattctgaagtttttcagccaaagcataataccttgcaagaatgtttccgacataaaacaccacaatttattcaatttgttcacagactttttgtaaaagcttttattttaatatttgaaaaacacctaaaaggtctggcttgatatttttaaaaattacattttgtttgctttgcttaaagatttagataaaatcgaaagtgctaaatcaggctacctctaattcaaaacaatattttatgggtggatagcattttacagttctcaaaaatacttttatgtgattattgtctttgatattcacacccttgtaaacatagatggttcggggattgtcttggttttattgattcaggaacctgaggctcacaaatataaacttacttgtccatgatcctatggctaataagcaaacagaagtacttgattttagatctcaatgttaatttagtgtgcttttgacactaatatcccctatacagttcccagtagattccttggcacattaaagccatgcaaatgttgtttcagggttgattttttttagtagtaaagtaataataaattctattacttgaaaatatatcataattcaaaacatttcatattagtggggtatgcagagaaagactagggtctatttttcatgttttttatatctggatgctcatatatatgctagtttattatagcttctaaagcaacacttttccatactgatttttaaattattacatttgttaattacagtgttttccctctacaaggactgcaagatttctgaaggcagtgatcatgcactatctccctatccccaggttctttgaaaaacagtgtggtttcgatatgaggtagcagatattaatggatagaatggggcagcacaggtgagatgggtagacagagacactgttactccacactcttctccccactgctcttattctatagtcacttcatttacaccaagacttagactccctaaaggatgaggcagatttataaaaaatctagtaagtaagaaataacaactgtctgttcttggttgcatgctattattttttatgccctgtatttggtaaccctacccagctaattataattttttttttaagattgacctacttatttgaaggtttaaaatgataggcaaggtattgcttacaaaaatttcctggattttctttctttttgtaaatagttttattgaggtatagttgatatataataagctgtacatatttaaattataaatttgacaaatattgatctgagaaatcactcataaaaccatcagtataataaagaaagtgaatatatcatcaattagaaaatttcttcctgctcctttgtaatcccaccctcatgctcctaccattggtacttcctcctcccaccccacctctgtccccagggaatggctgatctgatttctagcacatagcctactattactctagcattttttagaactttatataaatgcaatcatacagtactttgttgtgctttcatatacatgattatcttgagattcattaatgttgtttatatcagtatttcattcgttttgattgctgaatagcattccactaaatggttatattgcaatttgttcatccattcacctgttgataggcatttaaattgtttatagtttttgactgttacaaatgaagttgtcacaagtgttagaattgaaatatgttttcatgtctcttggataaatgcctgggcatggaatgggtacatcatgtggtaggtgtgtgtttaacaacttaagaaagtgccaaactgttttccaaaattgtatcattttacattcccatcagcagtgtaagagttccagttcctccacatcttcaccaatacttggtgtagtcagtctttttttaaaattttaaccattctagtatgtggatagtgatatctcattgtgattttagtttgtgtttcttgagtgactaatgatgttgagcatcctttcatatgcttatttgccataactatgatttatatggtgaagtgactgtgtaacattttgcctatctttttaactgggttgtttgtattattattatttagttttgagtattgtagataccttatgtatacaaatcttttatcagatagataattggcaaatatgttctctgtgtatggtttgtctttttgttatctttcatagtgcttctcagaaaacaacttttcaattttgataaagtctaatttatcagtttgttcttttatggatcatgctttttgtgtcatatataagaaatttttaattaacacaaggtcacaaaattttttacttatgttttcttctagaagtttcatagctttaggttttacatttagatttatgattcatttggaattaatttttgtatctgatgtgaggtatggattaaagttcttttcttttattgcatatagatattccattgttccagcacaatttatcagaaagattatcatttttccacagaatttcttttgtgcctttgtagaaaatcagttgtccatgtaagtgttagtctattctagactctattctggtccattcatttacttttttttgtttttacatgaatacttcattggcctgattattgcagctttataatacattttgaagttaggtattgttattcttcaaaatatgttcttcagtttcaaagttgttttggctattctagattctttgcatttccatatgaatttttagattcatcttgtcaatttgtgtaaaatagcctgttgagattgtgagtagcattgcattaaatctgtagataaatttgaggagagctggcatattaaccatattgagtcttctgacccataagcacagtacatctctcattttagttaggtcttaataatttccgtcaacagcatttcatagttttcaatgtgcagatcctaaacatcttttgtcaaatacattacaaagtatttctatttttgatgttattgtaaatgatattttaaaataatttctgtttcatcagttatccaatataaattcagtatcataaaattattcatatttccttattatccttttaatatctgtagactgtgtagcaatatcgtgctttcagtttttatattcttaatttgtgacttctgtggtttttcctggtcagtctgtgatatggtttggccatgttcccacctaaatctcatcttgtagttcccataatccccaagtgtcatgggaggaacccagtgggaggtaatcatgggggtggttacctccatgctgttcttcactattatggcggttacctccatgataatgagtgagttctcatgagagctgatggttttataaggggcttttccccacattcactctgtacttcttgctgccaccatgtttgcatgtccttccaccatgattctaagtttcctgaggcctcctcagccctgaggaactgtgaatcaattaaacctcttccctttataaattacccagtcttgggtatttcttcctagcagcataagaatggactaatacagtctggttaaagcttctttcatgttttaaaatcttttaaccagcttttggctttcttgatctttgtgtattatttttctgtattctatttcattatattctgatttgatatttatgatttctcatctgttttaaagtttggttgaatttgctcttttttttttttcctagtttgttaagacggaagctgaggtcattgatctgagacttttctttttttctcatataggcagttagtgcctatatttagtgttaaacacatttccctggaattattgctgtaagcaatatcctaccttaaagaatatgttgtattttaattttcatgtacttaaaaaatccttctaattttttttgatatgttttttgacccaggaattatttagttgtgttcagtttccaactatttagggcctttccaaatatctttctgttattgatttctgttattaatcctatttttgtgtgactggaatcctttaaaatttattgagacttgttttatggaccagaatatggtcttccttggtaaatgcttttgcaaagaatgtgcattctgctattgttgcatggagtgttcttgaaatgtctattaggtcaagtcagttgatgcgttgttcacgtttttatccttactaatttctgtctatttgttatatcaatggagaagaatgttacatcaatgatgaaatgaaattaatcaataattgtggattagtctatttctccttaaggttctctcaatcttttgcttcatgtattttgaaactctgttattgggttcataaatgttttggattgttatgttctcttggtaaattgatccctttttcattatgaaatgatcatctttatcccatggaatattcactgctttgaaatctactttctctgatgttaatataaccattacaactttcttttgactaatcttataatggtatatcttttcccgttcatttccttttatttgtgtttatagttaaaattgatttcttgtaggttgtttataattgggtctttttaatccagcatgataatctttgccttctaaatgggatgttaaggctgtttgcatttagtgtgaaaattgatatgtttaggtttaaatctttttatttcttttcttatcctattttattatttgtttccctttcctctttttatgccttctttttgattttttaaatgattctacttaatatcctttgttgcttattaattatattttcttgttttattattttagtggttgctttagcatttataatatttgtcttcaatttattatagtccaagagatagtatacctctaagtgatatcataccacttcgtgtaagaacattacaaatttctcccctcccaagcttggtactaatgccatacattttacttttacctacgttgtaaactccacaccacggatctattatttttgctttaaacaatcaataaatatttatcattttagttaaatttaatttctttgtgtgaaaccacatttctatctgctgtcatttttttttttttttttttgcctgatggattgcctttagcattttttatagtgcaagtctgatggtgacgaattatttttgctttggtatgtctgaaaaaaaaagcctttatttcatcattattttgaaagctgttttcgctgggtataggattttagaattgcagtttttcttttattttagtacttcacttttacgtcattatctttttgcttatgttattcctgatgattaacctgctgtaatctttatctttgtttttctaatgtagggtttttttttttcagataccctttaagctgggtgtcccaaatagtttacttcaattagtatttagtatcctgctttaaaagcctatccagtattttcatatctgttttaatatttagctcttatttttcaatataggcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccagtcacctctaatgtcagttcagcccataaatatgggtaagttatgcactaaaatgatgataataggtctaaacatcagtcatatataaaggttaaaaattgcttacaaaaatatttgctagcttatctcactttgcttaacactgtaatgatggtagatgtagtactgggggtattaagagtggcttctagaatgatttaacaatggtatgtatatctctgccattgtcacttaaattctgttttgaaaactgttttctttcaatcctggatctatgtaatggatgtatattgattggatatcactttttcacatctcagataactatttttgaaaatagtagcatgtttcttgcctgaatttattccttcaataaatatttcttagaggctcatgtttgtcagagactgctccaggagctggaaaaagagtgggacattagacatagttcccacctcagagagcagggacaaacaatagtaggcagagacaatgataaaagagtaaatgagtaatttactgtacaaacatgattacaaaaaacttcaaataatagacaacactctgttttctttgtgcaaagatcccccaaatctctttttatcaatttaaatatacaattacaaatgtgaataatacaggaaaatgttagcgctatgtatttaatttattaatttcatttaattatgtataatttagcagtttttctccacttatatttcctgaaacaattatatgcaaactctttatgtctgattttgcatcattggttttgacatcactagagctgcttttccaagtatctgatacaattttccatacaactcaagctttacttctttctaagttactcgagatatagcactttttgaaactgtgtatgacatcatattttaacatgaagactttcaaataatttgtcctgtagggatatagttgtgatctccacaacataattacaatggcatacaagcaattcaatcgtgaagttataccatagagaaaaaagttacaaaatctttattcaatatcattttcttttctttgaaaactaattctacctgatgattttttagtagcatttagagtcaacattgagtgcattgtttttcaaaatgaagtaggtaagggaaagtgctgtggaattttaaagaacttgaaagctttcttaattttgtctttatgcagagataattttggggaaaagtatttccttctatttgaatatatattataatatccccaaattatatgttccatgaaaaaaataaaactggtgtgatggagtgtcagggactattatttctactatgtagatcaaagaagatctcctttaggacatagcatttgagctgaatgaagaagagatatccatgcaaaaatccagagcaaaaggtgctccaagcaggaagaacaatattcacaaaatccctaagatacaatgaacttggtaatttgaggaacaaaacagaagacctttgtgctaggagtgaaagagatatgagagtattaagggatgaggtcagagttacctggtccagagcatattgtaggccagggtggagaagtaaagaactgttttggtttggatctgtttgtgagatggtgctgactggactgtctagtggatggagttgtagagtgtgaaggacagaggggtatcaaggataacctttaaatttagacctgagcatctaggtgaacagagacaccagatactgagatacggaaactcagggaagattaggtgtgtgtacagaaatcaagagctctattttggacacattgtatttgagatgtctattggaaacctaagagacgttgaataagaggttggacatatgagtctaaagtttaggggagatatatatatttgggagttgttagcgtatcaaggtttatagtattgtatgagatcacctatttagagttcaggaagagaaagactgaggggttatcagtaagaatgaaggagtaaaagagtatgttgttgtagaagccaagtgaaaaaaatatttcaagaaggagggaataagcatctatggagtgctgctgaaaggccgagtaaggtgaacaggaaattgacattgggtttatttttgtatttctaatattaatgcatattaatattgtcaacctaaaatgtatgacagataccaactctataaagcaaaaagttgatttgggagtagtaggggattgcagttctagacatgcatgctatggaatgactatgacacatccacaggggattggagtaaaggggaagcttgaaaagacatataggagacctccatgtaagctgttttgaacaaagattattggttacaagagcttgctgcaggggtggcattagctcattggtggagacagccgtagttaggcaagtgtctctgtgcaagcggcttttatggaatactgtggttttgaggaattctttacgttgttccaatgtaggcatacatatacataaggggactccttcatggcctcccaactccattgtgttagggtttcacactagtaactccagtttgatactgataacttttacagtatgcagataggaaatgtacaatagcttgtaatattgtaattttacttttctttggtatatattgttttctctttggtcatggaaacacagtaaatttcacctgctgtttccagacttttgtgtttagctgtctctgctttaaagtaactgaaatttataatacgtctcataaagtaaaacctcattgattttgactaaaagaggaaaattgtgaccaaattcttgaaaatatagaatgtgaaaattatcttatgctctttatttattgaaaataaaattcaaatcagtgtttcaatttaatgataatttctatatatatgaataattcctgttaattgtaaaaaccttgctaatatagagatgaacaaacaagaaaatgcatcgattttctatcactttggcgatctttatattttaactatatcaggaatccaagtataaatgtgtgttaaactttcaaaatttaaacattaaacatttttaatattctgagaaacttcatccctacttctgatgacaagccagggactgctgatgctgcatttattgcatgggaatatttatgctgtcagttatttgagtaggtttgtctagattatagtgatctaaaattaatagacaagctgaattttgggtagttttgtgtatttccaaatagtgttctgcaaaatgcttttttcctttttaaccactaaaataattgaagtgggtgaggttcaggggagacttcagataagttttaggatgctgggtttaataaagttaagtgggattcttacaaggggaaatcacatttagcaaaataatctcatttactgattcatagtctttaccacttaaggggagggtaatgaatatacatggattgctatgataaggtacaaggacgagacccagtattcaagcttgtttcggttctataattagtccttggataaagtcaccttttaagtacttgaaaggcaagatatgatgaaaatttatcttgactttattttattcagctataattgtcatgaaaattacttgacttaaaagtattctcttttttttccttaagtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagtaagtatattttagtaagtaaaaggaaaagttgagaagtaaataaagaccctcttaagtcccatagcaattaccctctgcatactaaatatatacatttcttctaaagcagaatgaattataattcaacatttcatattatatatcatatatagatagatatacgtatgtatatatatggctataggaaatctagttacagaaacttgaattcataattacaattattttccaccaacagaccactgatttcatcttttttttaattgctcaatctatttgaatgtttttctgaatgtggcaacagaaagatttttgcttggctaatcattagtcgagcttctgaatcttctgctagcccgatctgtgcacattcctgtaaaatccagttttagcaaagaactctgctaggtcattttagcaggaacacccccaccctggatatctgatgaatatttgatcagatttctcatcctccaccattccccaaatgatgtttgatcaccatggcctgtcttcagcaagaattctgttaggtcagtttagccagaatccctcttaccatgatgtttttgcttagtaattttctatctactccctccttcttggctataaattccctgttgtccatgctgtgtttggacttagcccacataccccgacccaccacaagaccccattgcagtgctccatatacctattgtgatgattccaaataaagtcttccttacttcctttctctttttctttaacagttcgttccgtaagtatttattgaacacctgctacatgcctggaactgttctgcttgcatcaggatacactgagatagcaggacaggataagaggaatctgggggtgctggtagggaatggaaggttgcaataataaatggaggttggggagggtgacatttgagcaaggatgtgaaggagatggtaatgtagatatctgggtagttgggttctaaacagggagaacagcagtgcaaaggatggtgtggctgagggcagtgaaggtgacagcagtagtggttgaattcagaggccagcaggggaagagaatgtggagctcaatgaaaggcctcttgggccatgtgaatactttggcactttactttgtgaaactaagtttcatataatttagaagtaaaaatcagtctttttagaactggcaaaaaaatttaaaacattttattttcacaaagagaatgatgggaatcctcagtgtcacatatggagaaaacagagttaaggcttctgtgggtttcagctttcttatctgtaaactggagataatttgtgaacttgaggattttaaataggagttattaatatctgatgttgttttatgcattcctgatgcttttcataatttttagtctgtgacatgctccccttaccccaagagcagtcattagagccagagaatttattaactttggagtacatttttgggaagctgaattttgatctcctaggctcaagtgatcctcctgcctcttttttttttttttttttttaagagatgaggtatcactatgttgctcaggctggtcttgaactcctgggctcaagtggtctacccacttcggtctcccaaagtgttgggattacaggcatgagccaccatgcctgaccaggctcaggttcttaagacttttcatgctcttctgtacagggacacttgtagttctttgtctacccctgcacagcattttctaccaggtgtgtgttataggtgtcagtagtggcttaaagcttcccacagattttagctgcatttcttaaaattctaaaggtcatatattcatcatgattcaattaacagtatttgttaattatcattatgattttttcttggacccatgggctatttaaaattttattgactaatgtgcaaactttttttttggttattgatgtttgttttaattccgctgtggccagataactactgtgtaagatattaattctttgaaatttgatgagattagcttatcctcacttttagtaaaggttccacatcaacttgatgttctgatgttttaatataatatttaacaggctgacaagattgtctcagctacatccctgctagtagacagtatacttcctgggtcttcgtatgaggttcaggtgaggggcaagagactggatggcccaggaatctggagtgactggagtactcctcgtgtctttaccacacaaggtaggttatgtaatagccacttctactgggagggaaatatatttcctgaacttgcctttgtatagtataagcatcttacattttgaggccttaaaatgaaaggaggaacacagtatcaacttccttgtttaaactttgaacaggccaatttgtgaattaaaattctgtcagagcctctaggcttgtgtgtttctattgcagtatattgtaggatcacttttcctattaaaaagaaaaaattaatataacagctccaaattaacaaactcagaaagccatttgtattgataattccttaatttacattttaaaaccaagcatatttatttgacataaaattcaaatattaacattttactttatattatataataaatgaattatttttactccagatgcttgcttttgagagttttcagtgccaatgttcatattttaaaggttatttttagcatcggaacatctacagttcattcacagcttcttcatgcagctgatgcgcaaagttttgcatagaggctccagaggcttggaatggtcctagacctgttgcatgcaaagttgggactatagaaagacaatagtcctttggctggttgtccgatctgtcaaaagggcaaaatttttcttgttcagacttactgagattgattatggcctgtacagagataacaggtaccatgcaaatatcaatccatttaacaagtttacttgttgattgcttactattttaaaagcattgattcgtcaaaaggcaagtagcaatagtagtttaagacattgacttcggagtccaacagaagtttataggagttctggctccaccacttatttggaaagtttcttaacctttctatgccttaatttccttatctgtaaaatagggatgttttacatggatatgaaatatccatataaaattaaataatgaaatgaaataattaacattggtcatgtgaagaaaaccattattgttttcttattctgcaaattaaaaattgcatagtatgtcatatgcagataaaatgtgtatctatattattaaaattttgcaaattaaatattcaatatctcatatcaatttcaataaatttatccagtgtaaatttcacaaattgtcaggtttttattaacttagttttcttattttaagctaatattttagcatctaatcatgtaaaaatactatgactttaatcttatttctcagttaagccttactatatgtatttgatttcaaagtgaaatgctttgaattttcttgtcatctttaaaatgaaaaacttcagcttaatccatgaaaactcaattatattttttatttttaaataagaattattctgagacttttgaggcagttgagtaaggaggttgtggcgcatactgaaggtaggttaagataggttaatgtactaggtacttgtccacagtaagtaatgtacaagtgaagcttgagtgccacctcggctaggattatactcagtcacgctcataaatctaatggtctggctcctgtgcagtaattttatgctactaagttttttcctgtttctatttgattatggacatacaaaacacaaatgttttgtatgaattgtaaatatatagacattgacgtttaccatgctattacagaataaagaaaacttaataaaaaccaattaaagtatttttgtttctgtttttaagggtaatcccaagatatgtgtgaaaacaaattttcatagtctatcaacagaaaatggtttaccttaactttacaactgaaatgtactgacgtttttgcagtgcactgtggtggaaataatttcttcctatgtaaaccatcatttacttgtatctcgcatgtctttgaaaatgataggcaaatgaaatttacaacaacagaggactttaaaaatagtatagaatcatgtgtaggcattaaaaaaatcatgttttaggaaaatatcgcttccctttaccctcatccataggatattggcattaaataactcaaaatgatagtacaaaccagtatttcccattttctctgctttgtatattgctgcattatcattcatacgacattcctattttttaatttatatctcgtatctttacctacttacttgaaatttttatgtatccaaacaagacaatagcggcaatcatttttacttcaggatttggcttcatagtgatttgctttaagaacttgtcctagtttcactgattcccaaagcagggtctgttggaaaatatgtcattgttgaattaagctatattttgttttagtcactttcctgcctatcagttagcaagtgacaattactggctaaaacatattttatgatgaataagcctctgtgtttagaagatagtaaagacattcatggaagctcaactcactttagaatgagagcactcgggacactagataactgtacacaaacaggtaatttcagcattatccagtttttaaattacactcattttatttttggcagtgtaactctggaatgtgttgtgaatatttttcgatgtggtacaaattacttacagaatgttttgtcttcatctgatatcctttcttccctcattacagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattggtaagaaaacagaggttttgttcattttgttccacaacttgaattttcattatggaccctccttatattagagtcctgttaaagatgtaagaaaaaatttttttcattgaattttttggagtttttgctttatattaatattttaatatgtttcaaatagatgtcaatatcaatatctcatgtgaaactgatgggtacttaactaaaatgacttgcagatggtcaaccagtacaatccagtcacttgcggaaagcactttgcaattgaggtatcataggtacgtattatttttgctgttttgtttttctgtgggcacagtgagataaaaattttctttagaaatattacaacagtagtcttacagattatttgcttcctgaaagaggaaagtataatataatgaatcaggaaatttttgagggattatataaattggtgattcttgaaaaatattcacacctgagattaaaaaattgtaatttgtttttacttcaaattatcttttctgaaaatcaatcaattctgaaaaatttgtattttaactcttgaatgaaatgcaagaaaatgtagtttatatatattttaatttgacttagttgactagaggagaatgtgaaagattataaaagtttcgtatcatttggctaaagattaatgttttggaaaaaagaggtaaaaacagattataagagataatatgaatggtttttagaactgagtgagattacttaggaaataaatacttatggttaataaagggtaatgtgttctaatgagaagtaatttgtgcttgtttatttttactcttctatgttttaaaaagaattcaaggcatcgtcttatagtggtccctttctttctaaaatcattttatctaaaatgatacaacccttgattatataatagatttttatttttaaaaatatcccatagtagtagtcaagtaaatatatactgctgttaaacactgtgtcccaatttatatttttatttgtagtggagactttcaatttgtataacatgctcatttattcttaaaatataaattttcaactagaaaaataaatcccttctctcaaatactgtgatctgaagtctattcctaatgctgccagtctcttcttatgtagcgttaggaaaaaaatgtggcaattcgtacatttctcaaatagctgccttcatcctacctaatatgagtattttaaaatcagtagaattgttcatgatatgaaattttacttttataatctgtctttacattcttttcatggcattttcacattagaaaaggtgtttatggaaaactattatgttaagccccatgccttgtttctcttattaacatttacagaataactatgaaactacatttacttgggtgagtttcttaacttccctaagcctcaatttccttgtctgtaaaacagagagaataataggacttacagtgtttctgcgagagttaatgacatatttcatctaattataatcacatggtataatttctccttgtaaatattcaatatatggtttttgctgtcatgataatgatgccaacttttcgatttcaagtgtactagtactgtgcttctactttgttcttattttctacccccagatgacccctcactcctcattttcatttttgcccacgcaccaccatttattcacacacacacacacacacacattcatgattgtaattttgagaagacaagaaaaagaagtggtatagaaaatagaaaatgacagaagaatatagattttttagcttcttctaacttcctcactcccatctctttggaaagagtaattgctacttcagctatttaaatatagtattcagagcaaacattggcccaagaggttatttcaaagaagaggaaaaagactttatgtcaagtttgtccaacccatggcctggggcccccatgtggactaggatagctttgaatgcagcccaacacaaatttataaactgtctgaaaacattaggagattttttttgcaactggtttttttttttttttttgattcatcagctatcgttagtatattttatgtgtggcccaagacagttcttcttccagtgtggcctagggaagccaaaagattggacacccctgctttatgggttctgaggtggagtgttggctaggactcacttataaaattttttttaaattttcttttctgagaaaatgaggaatatacatggttatataattcacatacatatctgaaattggtattatattaacttatattaatttgaactagaaaattatattcaccactcatttgtggtgaaatttaattctttcttcaaagtgtgaggaatttgccttccttgccatctcaggaatgctccatgactactttcatctatattttaaatattctatcactaatacataatgtttgtttaattttcaaattattgtaggttctgtctctaactggatcattttcttctttttagagtatttatttcatttgcatccctgcttagtgtctaatgaaatatttaataagagttactgtcagtttctgtggaaagatatagaattgggaaaaattaaaaaatgcctttctaataagaatgtctttttttagatggagtgaaattgtctgtattttatttattttaatttaatttaatttaattttattttgtttttgagacagtctccctctgtcgcccaggctgcagtgcagtggtaccatctccgttcactgcaacctccgcctccccagttcaagcgattctcctgcctcagcctccctagtagccaggactacagatgtgcatttgtagagacagggtttccccatgttgcccaggctggtctggaactcctgggctcaagtgatcagcccgcctcagcctcccaaagtgctgggattacaggcatgagccaccgcaccgggccttctgcctgtcttttaaacttggggtccccagtccctgggccacggaccggtacctgtctgtggcctcttaggaacccggccacaaagcgggaggtgagagagcagcattaccacctgcgctccacctcctgtcagatcagcgcagcattagattcttagaggagcagaaccctattgtgaactgggcatgcgctcctcatgagaatctaatgcctggtgatctgaagtggaacagtttcatcccgaaatcctgaaccatctcccatcccccattagtggaaaaattgtcttccatgaaaccggtccctggtgccaaaaaggttggggactgctgttttaaacaacaaatcagaattctcagatatcttcttgttgcttttattaatgtatactaattgactatttttgtatcttttaaaggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtgggtatgtcaagctgcgttgtgtcttcatttgtgttagcagatttgtatgcagattgatgcagatttaatgttatattttgccattttctgatcacattagattttgaaaaaaaaattgttcctgtttacagtggtattgagaaaatcagccttaggaagttttacagttttgaattcatttcaaattatttatagcagactttttttagcaataggaatattttctgcacactattagatgaaatacatgggtcattatgaatgaattttagtagtgtttttctaaataaggcattattttatgtttttgttccaatgtagttatgaaaacatgtaatatttgtaatccaaacgtttaatttgaatattctgaggttctcaataatctgagtactcataactcaagcctttaatttgtgaggctatgtagggcacagaagcatttaaaatagctaaattgaagtggaggaaatagacaacaatgacatacattatattttaaacattcttttcaaaaaacttttgatttcaaagatattaagagagcccttggaaaatgtgatatattctttccggttcattgtgaaatctctgagaaatgattgtgcaacaggaatgcaaaaatatcttttggtgctgttacatatgtataactaaggaagcttttgtagatcttttctaaatgtttgttttcaagataagatgtctaaaaacaaaacaaaaatgggattttcagtgaattttcccctcaaataaaatattcctcagtaggaaacatgttagaataatgttccataaaaatattaatatatactattttgttgggggattatgtcaaaaatcaatatttgagtcattatttttcaattaattaatacacatttgaattaaaacctataaccaaaaaatacacgataagattgtcttaattataagatttctttttcaatgtaaagtcccaatgaattctctccccactgtttaattccattttaagtgatttttactgcagtgatacttaatatcccaggatagcaaggaaccctcctacactcccccaaacatgcacagataataacacactcacttataagatatgacaaatgaagcctggattcagtaacatatgttacttgaataacctatggtgttatccttttcaaaactaaaataacgagtttaggttgggcttatattgcctacttagtactagaaagtaactcaacgttgggatccaaataccatctccacttattactagcctttaaatccggactagccacacaggcactatgtgtctgttttgtcatccataaaatgtagacagctcctcataccttcccagcatgggtattgagggaatcacgtaaactattgaacttcaagcatatcctttctgcagactggatattcactgccagtctgcagaaaggatatgattcatatgattcagttaattgcaaacacagatttaacctcttacagtctcttgaatattgatacttcctttcctgacaagaaattatcaagaggtgaaatacagtatatatcatcttcctgggttggtggagaatgtctttttgttctatgaagaattgaataatcatgataaactttacatgacggaaaaagtttaggtatttttgttatcaacagtcaaaagtattattgttgattgcttaaaaatgattttaaaataccatatgaaagggagactatacctttacacagtgttggtttttggcaagtgagacttggagcaagagaataataaacacccatattgtgccaatccaggtattaagttttccctgtgaatcataacagtagcatgatttataagacatggggaaataaatcaagaaggtaaaccctggaactctatcgtcagttctctcttaatttttcttacacagagtgtctacatttggccttagttatggtttgggttatttaggtttctttttgttggtggtggtttgttggttggatggtttcatacattagcccttcagcttccctttttgctactgcagttgtttcctgcatattccagccaagggccatctctcactttagattgtccactggcaggggtgactgtcaaaataatgaccaagaggagggccattccagctgcaatcccagaggcctctgctgtaccaggcattgaccttttaggttctgagccgtgggcaggtgtggagggcatccaacctgagcagttctggaggagatattcctcaggagagcacctctttaccagttggtatggatgtacttaatatttttaacaactgttttgacataccaactgaatatatgtcctctaaatggaatcttctagtcttagtgcagataatcaagacatgactatgtaaatgtagtgtgtatcataaagttgatgcttggagtcataacagagttagggcttcagagacgcactgttatgcttgggctttcaggcttttagtttaaaatatgccacatttccatattgcctgttattgtcaggaagattggccctcaaagttaaaaattaagaacttgggggaaaacttatgtagtgaatctaagcctaaggtagtttttactttagctctgaaagcagcatcataaaaaggtgataggaaaacagggaagataacctttttctttgcatttctatgatttttacattacacctttaaacatgtcttgttatgtacatatacgtatctattttaaaaatcacttgctattcagaccatctttgcctctattactgcccattaaaagcctgttttcctcagattatagaaaaccaaggctttgctctgagagactatctctgaccttgacctagaaatatttaatgatacacagcagcataagagtttcacactcacacatatggaaattgatgcagtccatgggttttttttttttttgcctttaattaaagttcaatggagaacagtttgttattgatatttagcatgtgttcagcatggtatctttttttttttttttgagacggagtctggctctgtcgcccaggctggagtgcagtggcgcaatctcggctcactgcaagcttcacctcccgggttcatgccattctcctgcctcagcctcctgagtagctgggactacaggcgcccgccaccacgcgtggctaattttttgtattttttagtagagacggggtttcaccgtgttagccaggatcggcatgttatcttttgcttgcagagccaatggttcaatttctaatcaggtactactactagctttcagagtaacatgaataatgtattgacttttttcagtcaagtctatatttgcgaaaaagagataaatccctcttttaatatatcacataaagtaatagggaaacaaatgagataatgagtgagaaagttatgaagaagatattgcttgatgaatacagatgtatgaaaatataacacaatgtttttaggcattattactatttaaattaccatcacttaatactattgtaaaaatttctagtgaagccactgcctccatccagtgtgaaagcagaaattactataaacattggattattgaaaatatcttgggaaaagccagtctttccagagaataaccttcaattccagattcgctatggtttaagtggaaaagaagtacaatggaaggtaccttttacttagaacttcagctttcctcattaaatgctatttttataatatgtaagagtttaattgcattagattaattttattggcataaaagtacattctcctgtattgtgtagctattttcattaaatagatttatctaagtctaacttttttaaagaacaaagtttcctgaaatccatcattccctgaagtgtgttttatagaacgttggttgcatattatgttccttggaaaaagattaaatggctaaatcagtttaggaaaccctgtatcactgtatcttccttgtgtagtcacggtatacatattacatattcaaggtttggagaggtccttcattaaagaaaaatttgtgaccttatttcatctcatgttccccaaactaatttttccaaggaactgttgtttctctaacatctgttgatatcttttagtacatacatgtttagtggaatgcattttggaagaagctgcttttcaaacaaacagagtcattcccgtagtggcaagtgtgcctatcatggcattccacatcagctttgtgacggcagcctgcaaagacctagaaatatcagaaacccttattgtatcattagatcacaatgatatcaactaaaacaaatgtgacagtttagctgctattgaagaatactgaatatcagcgatttgctacagtaggtcctatctaaccaatacgtttaaattctttttaaattcttaaaacatctttgtgggtagaggattagtggacagggattagtaggagggtaagagagtgtttgggaaacaaggttgcaagtaaaccagttcaaaatcttgtcatcatcagcaagggagtgacaagataaataagaaaatccttgacttgaaggagtttacaatccaagcctaattgtgactatttctgaaggcagagaacacagaatcagttctcttaattttggaatagtgttaaggtttaaaataaaatgtacttcagggccctttagatacatatgtgttggtaatgatcaatctaatgctttgacttattttacagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaaggtctgcagagattttgtaaatgtgttttgaaagtgcataagtgtgtgcttcaaatatggctgaaaagtatttcttcaaaaacatatacacaacttgtcattttgcagttcctatgagaggacctgaattttggagaataattaatggagatactatgaaaaaggagaaaaatgtcactttactttggaaggtattcccaattttaatattaatcttaaattgtatttttatactcttaaaaatttacttcatggtccataatcctgttattaatcttcggaaagctcaacaatcctgtattttcattgcatttatgagatgtatttaaagagagctaagatgtacagtggctgaagcactggcatagtgttaggagactttcattctcttcttagcttcacatattatagttacgtcagtactatttgggcaaagttacttagactctttgggcctcagttttctcatctgtgtaaatgtaatattgaactagatgataggcagtgtttcttggagtctaaaaattgtattcatatttaatcctgaacaatgtaaatgtcaccttccccgcacaccccaagggcatctaacacatgacagagtattccatttatgtgatggcataaaaacagtggatagtcccatatatgatggctgtttagcctagtaattttcaaagcatcctctcccaaatgaactgatttctatttcaagtgaatagtttatttggtcagtaaatgccaaatttaagattgacttgggaatacaacacatgaagtcaaagagtatttctgtcactccaaatgtgaattgtaagtttaatacccaaggttgaatgagcacatgtttgaaaatggtttcctgatgtaagaccaaagcctctgtaaaagttgtggtatataagaatttatgttcatttggtttctaaatccagttactctataatttcatttggtgaataatcaatgcaatttctaaagtcttccatttcaatatttcttaaaataattttttattcttttatttcatttcttttatcattgctctccttaaaaaatttagtttcttttgttattgctctcttttctttttctagcaaaccattccttcaacacattttaatatttccaacttaaagttagcattagaactgacagacatttatgagccatttattgtattctgaacacttcatacagatctccacctcccggggaattcaggacctgtattctgagagattgagtgggcggttgaacccaccgcggaagggggcactgctgaataagaaacaagagtcttgcccgacagattatttttctcatatttttggttttatctccatgggcactgttccagatacctgcaaacttctacagtgaaggacaggcagtgatgttcccatgtttgtggtagggccagctatgagcagaatttaagtagcttttctttttctttgatttgtcctctcagagctgtagtcaacagccctttggcctaggctacagctaccctctcccattgcaatatactctagaacaaaacagttgtctttctccagacagttcttatgttttcctcatatcatggattccacatttcctcagcaatgctgccaatagaagtttctgtaatgatgaaaatggtttatatctgcattgtccaatatggtagcaaccagccacatgtggttattaagcacttgaaatgtgcctagtgtgactcagcaactgaattttaaattgtatttaattttgattaatttaaatttaaatggctgcaagtggccagtggctatctttttggacaacaaagctctatgggttctttaggggtgatttgtgggagggagacaggacccttgctaatctaccatctttgcagaaccttgaatgccttttattagtcaatttgcctttcattaattttgttttgtgctgttttgttgtgttttcctaaactgagataatagttcaatgattacggttctccaagcctatgcctcttaaaccgggataagatttgcttaaggagtaagccacaaggccacaggataagtatggcactttttaaaaaatatcatttctctggcatttttaaaataataaactttacgttaaggcagttttagagttacaaaaagacggcaaagatagtacagagaattcctatgtattcccacaccaagttttctctagtattaacatcttaggctagtatgatacatttgttacaatgaattaaacaatattgatatgtcatcattaactcatctgtaatttatttcaaatccaaatttccttagcttttacccaatgttctttttctggttcaggattccatccaggatagcagatttcatttagtagtcatacctccttatgcttctcttggttgcaaaagtttcttagatcttctttgtttttatgaacttgacacaattgagaagtactggtcgggtattttgtagaatctccatcaaatgggttttgtctaatgttttctcatgattaatttagggttatgtgtcatacctccttatgcttctcttggttgcaaaagtttcttagatcttctttgtttttatgaacttgacacaattgagaagtactggttgggtattttgtagaatctccatcaaatgggttttgtctaatgttttctcatgattaatttagggttatgggtttgggggaggaagatcacagatgtaaaatgccattccatcacatcatattaaggatacattctaccaatgtgacttaccatagttgatgttaaccttgctcgtctggctgaggtagtgttgtctggctgaggtagtgttgtctggcttcccactggaaagttactcttttttctcctttctccattttagttttaaaaatgaagtccccatgcttaaggagtaggagtcatgttccacctacttgaaggtagaggacctacatatattatttagtgttcttctgcatgggagatttgtctgttctcccacattaactattttatttattcaatcatttatttatattagtatggacaatgaacatttattttagacttggtttgtaatccaatactactttattttgttgctgaaaatattcctgcttcagtcattgggagctcttttaattgactcatgttcctttgacatgcccccgtcattgtggggttttttattttaatttttgagtactggtaagttcgactttattaaaattaaaaacttctgatctgggaaagactgtcaagaggatgaaaagttaaggcacagactgggtgaaaatatttgcaaaaacacacatctgataaaggacttataaccaaattacacaaagaaatctttaagattcaacaggggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaaaaaaaaccaagtatctgaacaaaaacctagccaaagtagatatacagatgacaaatatgaatattaaaagatgttcaacatcattcatcactaaagagttgcaaattaaaacaagataccactccacatctattagaatggctaaaatccaaaaaaaaaacctgacaatacaaattgctggtgaggatgcagggcagcaagaacttttattcattgctgtggaaatgcaaaatggtacagccactttggaagccagtttggtaatttcttacaaatttaaacatagccttaccaaccacatgatgcaacattgcatcctaggtatttactcagctgatttgaaaacttaagtctacatagaaacttgcacatgaatgtttaagcagctttagttatattcaccccaaactagaggcaactaagatatccttcaaaaatgaaacgattctgtatacttctgaaatggtgggtatatagcactatgcatttgccaaaactcctcgaacttcatagcacaaagagtgaatcttaatgcatgtagattaaaaagaaaatcatttaggaggttgaaggatcccaggattgactgtaaactgtgacaaaggaatctacctgtattacaagtgtatgaagcaacttcactgaaggtggtgggagaaaaggccactttggaacttgagtggagttgttggaaatgtgtggaatcttaagactaaaggcaaaagaaactgtacataagcactgtactctagttgatacagttctcacagggctatgggctaacaattatggtactgctctacatgtactctggaaggggacaagcaagtaaatggatggtggatggtgggacccagatttctcactgttggattgggaggttacacacaagcacaggatgatccatgtggcaatgaattagagttggggatataggtatgaacttatatctagcttaatatagatatagctagattctggtttaggatacatgtacattttcttgatttgtaaggtaagagggcctaaaagtaatgacatccagtagtaagacatgtgcccagacttgtttctaattaccatcgttcaataatagaaacaagggctattggaagaaatggctaattttagggttggggcagaaaatatacgagattagcctggaggatcttgtagtaccagaaagtaaggaagcttaacattctcttacttgatggttaccaaaaaagtattcattaaaactgacatgtttttttttcaaataaaatgcaacatttgcatgactttgaaacatttctttcttgcggtggctgctaaaatcttactttcaacctatccagatgattccaagttttgcagggatacatgtatatgtgtttatttttctctgccatttctaacttagaggcatctcaccggcaagaaattgagatgtactgttctagtctatgatatacagtccagccttctctgtctttataagggattgccagcatttaatcttacctgccataggtgaagttgattggggaaatggggtacactgttaacctctgtggaatataagaatagaattgaactagacacttattttacattcggatctttaatgacctgatattattatttttaattatatgacagaaattctggggtgccatagacactgttttgatggcctctgttactcattaacctttgcagacattcttacattctagataatcttccaagagtatcagaggaaaggaaaatgaatgacaaatcttactatgatcaatatatgatgattaacaccttcacagctcttgttgttgcttttcattttctgagggttattccttgtttgctttttagatgaggaaactctctactccttatgtctttcatttctctaaaattagagtgaaacttcttggtagaaaagtgtcttgatcatatccctactttattatcttcaagtgatttattctctgggccttaagaaaaaaacctcaaaaaggggaaaataagtttgctatgctccataacgatccagacaccttcatggagactgtggcagaggcaaactctatcccacccatctccccagcctctcagccttgtaatagtacctgccctgatctggcccctgcctcctaataagaaatgtagaatgagagttatgtgagctcagttagtataaaaagcactgcagcccttaaactaatcaatttctatatttactacagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaaggtaagaagaggtacagagtggtaatccattgcctcttttaatatttaacttttgcaaactctcctattttaaattatctttcaagcagcctgcaattctctgcatctgaaagtctctctttcacctttcatttcctttgtctggaaaaataacaaagtacattgtacaatgatcacataatacagtccttgagctttcatttgggagaacattgttgtaatggtgttataatatatgagaatgttttagtgaatctaatacttaaatcttttggaccaatggagatctttaggtcaataattctctctccctatgtacatatacatgtatatatttatattcatacatacacacatataaatatgtaaaaataagtatatatcatattaaatatatatttaacactatgtaaaatagtaatagcatgacatgttatatggatgcaggttaattgctgagacttaaaattactatggacttcattgaatgtgagtagcaaaccttcttgcattaattttgatatatctgattaatcggagaattgagacccactttcaataggaatttctagtctagattacatattcaaagtgtaaatttttaatggaaaatacaaattttctgtgtctctaccaatctataaaggcctttccaactgttacctcctttatgaaatctttgcttattgctttaattgaatatgccctatctcttctttaaatctcagagtgcttcctgtctttcttattttatgtcctgtttacattatgattacctttgtatttatagtgttaagcatcgagttccatagcacccagctcagtgttttatgcttaacatttcctaagtatatatattctagaaatatctgtagaatgcgtcagtggggtaggtagtgggaattgtaatgtgagaaaaactataatggttggagtgtccagagcctaataggtaagacaggtattaatgaaataatcatacaagtgaatgtctatttgcaaactgagagataagggcctgcaggaaaggaatataattttatgaaaggaatgaaaaaaaggaacctgacctggcattgagattcagagaagccaccttgaggaagtggtactgaactgaaatctgaaatgtgagtaggaattaaacttccccaaaagatgtaggggagggcaggaaaagcattggctcctaacaagagcagccagatcaaaagtctatggcacaggatagaaaatgaagaaagaccagggtggctttggtgtgggaaatcatggaaggcagagaggtgcgttgagacttggccctcagggccttgcaggcatgataggaattttaccctcaaatgtagaaatccgctggaggcttttaagtgggatgctgtgcagatggtgttaaaatgaacagatttgtgctttgagagtatcactccatcagtgggagaggatggttaataggcttgtgcagtattccatatgagaatgcctttttgaatatatcaaaaaattgctttttaaggttttagggagtatcatgtttctcttcaatgtcatctattcccatatctctctgtttaaatgactctcatgatgcaaaagtaattgtcatgtatcatatttatttgtgtaaattgtctgtcttctcttccttattccctttagtaggttataagttcctcaagagtattagtagatttttattaatttttaatttaaaaattaatttccttcttttcccctcagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatggtaagtttactatactttagtaagttgctctcatggattaatatgacactacagattattaattctattaatatagccagttaatgaaaacttcaaaaatatagaggatactaccatcctaatacatataatcctataacctttatcaaaacatttaattctcttcctcttctcttctcttctcttttcttttcttttcggcagggtctctctgtgttgcccaggctaaagtgcagtggaacaaacatggctcactgcagcctcaaccttctgggctcaagctatctttccacctcagcttcctgagtagctgagactatagacacacaccatcacacccagctaattaaaattttttttttttggtagagacaaggtctcactatgttgctcaggctggtcttgaactcctaagctcaagtgatcctcctgccttggcctcccaaagtgttgggattacaggcatgggccaccacacccagcctaattctgtttcctttgacattttctcattttaacattttatacaggggttatcatatcatatcatatcatatatcctatcctatcatatcatatcaattttctcctcatttctttctaccattatttttaatgatatagcattttattccaaagtccacttaaactgtttgagattctttatgttgcttccagctttatcttttcttaaatcattttttaacagcttctgatatcttctgccaaattgtttcctcaaactgtgtaccaacttataatgccactaacaatgagtgggaatgctagcctgaaggtctgaggagctaggactgggtgacctagaccagggtattctcccaaagttagaccagttattccaggaggtgagtcaagcacaaagtataagtgcacaagacagcatttctaagtctgagtaaggattgaggaaagttaactagggaagctaaggattgctatgatcttattatacaatatcattctaaggactcataccattattttattccagggacctagaatttagcatcagggtaaatttatttacaaattgttgaactgaatttagttcatcaccactgatgcgcaggtagtttctctctgtgcttttctttaaaccatgaggatataaaatttaggcttcacagagatctctcttcttctggatatattcttctagaagaatattcatatattattagcatttgtgaaaatcatgatggatccatctggagctttgctatagggttggtcattttccatggatcaaaatcccagatcttgcaaggggtctcgtggtctccaccaccattttgtttgcataggatttcacaagactttagtctcccagctaccttgaatggaatggggaaactaagtaagctgaattcctattaaaaaaaggagtattgcccactttgggggtaagggagaggtagtagaacatattgctctggaaaaggaaatgaaggaaagaaaaagctcatacaccctgcacttgaacaaattggctatcactggaacatgcctttgaaaaattgcaatcttctgtctctggctaagatttttagaaaaatatttggaaaactattgtcatgactagataattagaagtgcttaagtttgttttgaaactcccttgataatttaatccacaaataataagtaatttctatgtttggaaatatatgatagtcactttaattcttttttaaaatgtatgttccactcattactattaattttgtataaatgagccttttacgtatttttctcctcagatcattttatccccattgagaagtaccagttcagtctttacccaatatttatggaaggagtgggaaaaccaaagataattaatagtttcactcaaggtaaaaattataattttagtttccttttacaccaatgtgtgtgcctaatttgtttgcagtaatattgccatctgattattctttttctgatagaatcatggaagagtccaaagtcttctgtagatttttcatggtgaggttccaaaggaaatatttttttcctctaaaaataaaactggagctatagaaatagagtcactgggcctcttatatttctgattcatcttactgtacttggaataccaacattttgattttgttattactttttaaattgtcttcaaatctaagcaacctagcaatgatatttcaagagataaacatttcatttgttgttagaataaaaatcattaaaaaaattcatacatgtattatccaacagatattaattgagcattgttctaagcactgtggattgaatagtgaacataagtttctgcccttatggatcttaaataccagtgctctaattgagagtgatgggcaaaaaataattatataatgtcagatagaaataagtgccatgaaggaaaacaaaagcaagataaagggatggcattaaatgtggcactttagttgatagccagaaatggtctttctatggaggtggatgatattcgagtaaaaccttgcaagtacagtaagaccctacttgatatagtcaatagattcttggaaactgcaactttatgcaacatgaactacaggaggtccttgaataacatcattttgttcaaggtagtttcattataatgttgatgagaaaaaaaaggttttgttatacattgccatttcacttaacattgcagtttccaagagcctatcaatgatgttcagtgaagacataactgtacaaatagcaaaagcattccaggcaaagggacagtgtgtgaagagcccctaaagagtggggatgcttggtggttcaagaaacagcaaggaaatcagtgtgtgtggagtgaacaagatagagattggcaggtgtggaaggttgggtcctccaggagtagatactgagacagtcatcataacaagtttgacactttggcccattataatgtaaaaatgatcaggtagagaggaatggcaaataaataaatttgaaaaaatattttgctaatttacagtagatatgatgctgaacaaaataataagtattttattaatgtgatcacaacatatttttatcttcattttttatttttatatttttgaaggtaataagagatttgtgatgaattcagaaaatgtctactataatttttgatacagaaagaaattaatatttcctcaagtttctgagttgtgtaaattgtatttctttttcagatgatattgaaaaacaccagagtgatgcaggtttatatgtaattgtgccagtaattatttcctcttccatcttattgcttggaacattattaatatcacaccaaaggtattgtacttgaggttaagaatctttacggcaaaagtccttacgcgtattcaaaccctgatttaaaaccttctaaattaggaatattaaagtcttctaagtgcttttatatgtagtctgtatacaattaagatagcataaaaaggaaaggcctgttgtgaggaaatggcattccattttgctaggactgtaagagttaaagaatgaggaaagaaacacgaaacacagcttaacagttaaagacaggttttctttagataaaacctgaggggcttctggccaattttgttcaggagcccctttctcttacagactaagagtatgtattggttttagggtgagggggcttatcacaagcttggaatgtttatgtgtgagggagaagtttatggcggggttggaatgtctctgggaggaggggaggttatcttggggctgacatctttccagctggatggggagggttatcttggggctggcatgtgcctggtcagggaggatggaatgtttctggttggagatgttatttgtggtttatggtaatgctgaccttagccattaggctgatgccctttggatttaggtggtttttgattaaggggaattttaatatgaggtgcttgtccatgatggtgatgctcctgctctgtcaaggacaacataacttcaaggaagaatttagttttttaaaaaaaatgtacatacattcaggaaacaacaagcttataacaggaaatcctaagcagtatgttcttggaggtggcaaaaatggctttcagagttctgcagtttgggttaaggacgttttgtggtgaagtgggtggtaaaagtagccttttagtggtgacctggagcagtcagttcatttatgatcagcaggcactctgctttttagagatcagcactgtgtggctccagtctgcttggcttgtcaggcaaatgcctgagttccgtggatggtggcatgggtgccatgatactctctgtgctgagaagtccagtgtggttattttacacatgccaaatctctgtagaaaccatcgtcttcaggcaaaaaagagagagaggagattttagaatctgaatttatcttgtagttaagtgagttgatggggccacatcaaatggaattttttctggtacccactttgtgaccatttttaatatttcaatttctttgagagaaatctatccagtgtttagcatggtgcttggcacacagctttcaataagtattggctatttctattattacagtgattttcagcttgggtctagataaaagtttggtagaaatcttcatgggctagcatgtgaaaatgcatctgaccctacggaggcatagttgatctggtggactaatttctagcttgtctgttcactaactgttcacattttcaatatggatgtttttctctaattttgatgccctgtttatcctttgtagaatgaaaaagctattttgggaagatgttccgaaccccaagaattgttcctgggcacaaggacttaattttcagaaggttgctttttcaattttttttaacccagaatatatacgattgcaatctagacgccatatgacttatagagcattaagcatttttaagatttaaaaggtcatattttattcaattcatcttaatatatctgttattatatactttcaagaatagcaggatgcagggatttgaaatcaggaagaaacaaatttcagcgcatagtttatcgtatgagagttcacaatatacatatgttgcttctgtgtcacagtacataataaaataaatattagaaagttaagggtcaatctgatggagaacagatatttggatacactttttttggtataaactgtatttaggcaaaaggctggaatcaatatttttaatgtctataattatctccataattatttaaataaattagaaaattatataatcctcaaacattacaatctgaaaaatgcagtgatcataataaaacttatatttatgcagaagttccattcaagtacaagtactttatgagagttagtcaactataataaaataatttgtatttacttctatagtaggatttttcagaaagctctaaatttagtgactgttttattaattctcataatgtcccttgaagcaaagctagctttccactcataaaactggaaaaatagaattcagtcaagtcaaaatatacagatttttaaacaatacttatttggaggttattatccaggtttggtgattgcatctttatcattagtcacttgttaaaagttttcaatggtttccttttgaatacaagatataaactaaagccccctgaagctattaatagtactcaaggacctctttctacaatctgttatcaacctacctatacgactttttctatccctgggccttgatgatacctttactgttcccatccaccttcacagagccttccttgtacatgaagatcttgctctaggcccttctttcctcaagccttcctttaaccagtgtaattcaaaagaatttctaccccctttaagttcctagatcattgtactgtttttttaattgtggatagtgctctgaattcaaagactgtattttatccatcacaaatatttgtagtactcctcctgctgttctttatgtgcaaagcactgagatacatattcttacatttattaagatttttacttacattctcaatgtttcagtttcctcttctgtgaaataggctgcttaccttattaggttgtttgcgggactaaagaagatggtacttgtgacatagtaaggtctcaacaaatattaattattattgtacatatttatgtattttatattactattattattctttcagttaccctatgggacaagtgttattctctctattttgcaaaagagaaagctgaagctcatagtggttcggtaacttgttttagaggcaagattagcttaccagtttgtctggctttggagcctgttctaatagcagctgttctctatagcagtggcttctttttctttctttcttcttcgccatgacccacagtgaaaaaaacttaggttggtgcaaaagtaattgcagttttggcatttttaatgtataaatacgttttaccttccaacctagtacaccatagatacagatatgcaagaccgaaatgaaagatacgcaaagcagctttacttcttgcttgaaatagaatgttttaaaattctattttatttgttaaaaatgctggttgcaagacactaaattgatttcacaacattcgaatggcctatgatttgcagttagaaaaacactgttctacagcttatcaatgaataagtaaacaactaatattgtagacataatgaacaaagaaaaagattgaattgtaatttttcagcaggagaaagaatgccctgtcttcagaagcagcagtagtgttgttttatatacgaacaattctttttatagaaacttcgctttgcctgagtctaatcagccacactcctatatactcctcacctgtgctgttgctcactaagccagagtcttctttcattaaaacagtgttgccgagtttttcaagtaaatattttttctctcatttatcttttactaagaatttatacagtgacattttgtgtagttgtgatgatatttcagagagagatatatatatgtcgttcattcatttgttcaacaagcacatggtgagtatttatatgtaaggcttggctgttgctagggtctgggagaacagatttttcttaccatatgagaaataagacagtgaggtcagagaagagtggctgggttgaaagtagaataggaagagcttgtctccttttgcctctctaaaatagttcttttctattcatttcatccatatattcaatatgattgaatacttaccctataccagtcactatagtatgccctggcattataaggataagaaaaacactatgtgctcctgagtatacagtttaatggggatgataatcattaatacatttatcatggaaatagcattactttttttttgtacaaatttatggggcacatgagaaattttgttacatgtatataacatataatgatccaatcacaaccttatagttgtaaactacatgttgtgaaagaaggggttccattgtgctgagcgcttataatgtgggaacctggcttagtgtatccgtgggggtgagtggataaagttaagcaaattacatttgggccaagatctggtagatgaacaatcattaactaggttttgaggcagagatgtggtgtccagctaagtacctgcaaacactaagtcatgtggaaggcagtacctagcatattcacaaactggaaataggaagactataagactttttcttaaatatgagggttttatgtcaaaaaacctatatacttatctaagtaaaattgccaaattttcagtatataggtatatattaattcagggaatgatcatcttactttttaatgtcacttaaaaagaggctgaaacactctctcttcagcatttaagctctgaaatcttacctatggaccaccatgaagtggtttctcagtgttcaggagggccatgaaatgatcaggcccacatcagcaaaatgcagtttaaacctgcagcaaattatttttcccttttccagaaaatgcctggcacaaaggaactactgggtggaggttggttgacttaggaaatgcttgtagactacgtcctacctcgctgccgcacctgctctccctgaggtgtgcacaatgctgccacaggtcatctgacagaccttatatacaagtagattgaaatattgccacattttttcaagttctggtaaattaaagaaatgtgaagaatttttataatacagtgggtgtgaatgttcttatttgtaggactgattttttaaaaatctctggaaatatttgactttctaatcttataaattattttttaagcacagctaacccacaagatgcttagtttattactagggctgaccaggcgcataaataacactattaggaataaattaggttttggaatataatagaacatttaaagagtaaaggagaatataacttcaaagattttattaatgataaaaatcttctaaaattcattaacttttttctctttagcctgttgttttaatctcctaaacaattaaaatgtacccttttctttttgagacagggtctcgctctgtcacccaggctggagcgcagcggtgagatctcagctcactgcagcctcgacgtccttgggctcaactgatcctcccacctcatcccctttagtagctgggaccataggcgcgtgccaccacgcccggctaatttttgtagatatggggttttgtcatgttgcccaggctggtctcgaactcccaggctcaagtgatccacccacctcagcctcccaaaatgctggacttaacagatgtgagccaccacaccctgcctaaaatatgctttttaaaggaaaaataatatagtgtaactcactttatattactaaacaggaaaaggcaaatttaccatccaccctatgtttcatattcatgttatttaaattatttcatagggctaatagccttatattttctgatgataaaactgaggcccagagtggttcagtagcttgtcttgctcacccagcctgtccatgtaacatctgtggttcaaatccagatctatctgactcaaattgatacccgtgccatcagttccatattaacaatgtatttcttaatatgcttaatgccactaaattatacacttaaaaatagttcaaatggtaaatattgttacgtatattttaacatcataaaaatgggcaaatgatgtgaataggcatttctccaaagaagatacacaaatagccaagaagcacaaatgaaaatatcctcagtgtcattagataatagggaaacacaaataaaaaccacaagatgcccagtaggatggctataataagagacagatagtaagtgttggtgagaatagagagaaattagaattatcatatactgacagtgggaatggaatagcaactctttcggtaaatagtctgacaattcttcaaaaggttaaacatagaattattatatgatccagtaattccattcctaggtatgtactcaatagaaatgaaatagcaaatccacatgggaagttttataagaatactcatagcagtattattcataatagccaaaatgtgaaagtaacccaaatgatgaataaataagcaaacaaacaaaaaactcacactatattgcaaagaaagcagaccagaggagcctattgtttttaaaaataattcaaatacaaatatagtattttttaaaggaagtaataatttctatatcaagtgtttcctttaatttgttctccaaattcagatattttgaatattgattattatgaaagtactcttaacctgaaatttctagacatctaacatgattttcaaaatcttccctaaaattaatctattccacttttgaagctgtcattttccttccccttggtttatattaaatctaaatcctgaacctataattatgttaatcaaatgtgtttttaaaaatccaatattttgaatgtatttctaaaagaaaaatgaaaagaaaacatttatttaaaaccactatatgccagacattgctaacaataggataataccatatgtgattaaaaataattttgccaatataatttcctgccagatcttttttcttttgtatgttccacttccttttctcttttaaaattagtttttctggataatataaagatgaaaatataggacaatatgaaaacagctctatattaacacaatattttaaaactttctgcattttcttcatttttaaaataaataaaaactacaggtaaagtttgtcctgcttgttccactatttccggtccctcctcttcctggaggaacccatgatttcaagaatgctgtagcctgtgtttgtctagtttgtgcatttatactttcctactttcacatgtgtgtatccatgaccaatgaagagtaatcctttgaagtactgaaaatgttaatgtacctttcatattattccaaaaatatctctgaacattgtgttttgagctctctccaagttgatgtagttaatttagttcacacatttggactggtctgtagtattccattatacaaacatagcacaattcatttattcctctactggtggatgtttaaggtgtttgaacacttttttatatttattacaaaaagtgctgcaggaagtatggttgtatatgtctctttgttctctcatgtatatgatatttctcaatatttaaaattttttgaaaaaatatatgtgaatgacttaataatgaaatgttacagttaaatatttgagtttggaagaccacttcatgaaaaggacagtccccttttccacccctccgtacccttagtcttgctctccaaatgcctctttagttaactgtctgacttttggtttttctggtatgtcacctttttatttctaaaaaccatatgcttatgccactatgaaatgtagacggtatctattgatttctggctacaacgaggatttactcccacacattattccctccttgtgtttctacccatattgtcttgtcacttttttcaattccttaagtaatcatttctccaacctcagaaaaatctacttaaacttccatttcttgttcttttaaacagaagactatttcttggagctcccctgctatttttttttttaaataaaaacattagcactcttacgcttccctccatttctccctctactttccaatctctaaatctaagtttatgtttttccttaagtcagggttgatatgatgttctgtgttgtaatttgtctgtggtttatttttaaaaatagaaaaactaataaactgaatttgcattgttatgattatgtaaatattgtgacttactgaaccaagtatttaataatatgtgattacacttctcagtggttccgatgtcaaaggggaattttttaaaaaatatattagatatattccacctgttgatcaaaattgtgccgaattttagttagcttcatttttagtttttatcttttttcttttccttaagtttctaattgtcccttccttcctcttcctccctccattctttcatccattcatccctctctccctccctctctttctttcttttcatgctgtctttctttctccttccccttctcttccctcccctcccattatataatctatgctgttatgttacctattttatccactaccccatctttactggaggtgttgttctagtggactctccaggaactcctctatcctcctacttcaatcaggactaggctttctctaaaattactataagccatcactctaaactttcccttaactggtttctggttagtactgtttcctggattcctttccttcatctttcttaactacacccttaagtaacctcctaagaagtatgcgataagtctccatctctccatgcctgaactgccttttattctgccctcctcgattgttagtttggtggagtatcaattcttagaaatagcctttccaagagaacattgagataattcctgccttaacatatagtatccagtgttgcttctgagcagtcagatactattgtgatttttactcctcactgtttacttataatttcctttttaaacagatgcttgaaggcagcatgttcgttaagagtcatcaccactccctaatctcaagtacccagggacacaaacactgcggaaggccacagggtcctctgcataggaaaaccagagacctttgttcacttgtttatctgctgaccctccctccactattgtcctatgaccctgccaaatccccctctgtgagaaacacccaagaatgatcaataaaaaaaaaaaagaaagaaaaaaaaattctcctcatttttgttgttttgaattttcagtgatgaatctggagtggttctttttttatttaatgtggttattttttgaagagactttcaattccatgtctcctgtcaattctaagaaattatattatttctttgataatttcctctcctcttgtttctttgtttctctttctagaatctgtatgttggatgatggaccctctgcgtagatcttccacatctcttaccttttatctcatattttcggtttctttgttttgtgtgtgtgtgtgtgtgtgttatattctgagaccttgccataccctcttcttccagtgcttctgttggatttttatatactattatttttgtaaatttccaagtattctttctcagagtattctgttctggttttatgcatattttcttaaatgttgctagaaataccaattcgaggatttttgttcttttattttaaaaattcttttttcttctattccctgaattctgtgttccttctaggtcgtgtgttcctgttgtttatcttggcctctcttttattatctcagactttcctcctaatatctggtaatcctttgttttcctttcatgtttaggaatgaaacagtagacaggctgactgggagcccagtgtatataggcagggattgttgccctgggtgagtaggcagggttctggccagatgaggaaagatgtgctctcagctagcaatattccatggctgctgtcttcctccccagacagttccttagttgcttttgagaacaaaccctcagtctggttgtgaagggtagttcttacatggaggctcttccatgttcagcagaggagtagaagagccctattccatatacagaacttccattaggccccagtttccagccacagttctcttgtcttcatgtgtttttacgtgccatttcttcacgcactgtctccgctgtatacggcagggctaattttctttctcctgagctgcagctggatatattctggtcttcagctttctttgctcaccttctttgatctatactcttccaattgttttctatcttttagcaatgaatgaaaattacccacttctcattagccctctcagatcatcttctttgtggtgggtctgtatttgactcatttacatactgccattccaacagaatctctatagagacaagagagaaacctgttcagtcagccatcttgaatcagaataccatttctgtttataccttaaaaatcagaatcttaaacatatattgaatttttgttgtaagaaaatgtgttatgataactcattagccttgcttttcttccaattcaaattttagagtgtaaaagaactattacctttcttactttgttttgcacctttttaccttagcatttctgcctaatttgttaaatttcttctaaatccaaatcacctgggtttttcccttaaagatattttaagcctctttaattcattttcaatttgttccactcctttttattctttattttacaatatttttctcattctctgttttttgtttgtttttatccagccatgctcctgtgtctacatttatgccagctttcacaagagtttactccatttaacaacttcctttagcggggctaaagctagaaacaaatagatttttccttgggatctaaaaactatcttagattccccagtcagccctaggcctccaaataaagcagctcaataacccgtggcctcccagaacaccatcctcacagatctgaatcagaagcatccctaaagttgctagatggccttccaaatgtgtggaagagctggtgcattttcgagttagaagttctgtttagaagtagccatctcccctatgcccagaaatgcacattactgggcctagaagtgtgtatttcactcccctaaaaatgtaacctcagttttgtttattttcttgttccttatagccctcaggttatgaggaaccaggagagagtataaattaatcagctgaactttgtcacagcgagtagtaaaagggaaacaaagaacatgttcttctgcctatttgtgtttgggacaacctttcatcttctgttgtgttatagaaagattgttggactagaaaaaaagaactaagtcagggtcctccctctactctaattagccatgtaacctttagcaaataatcttggcagcctcaattgctttgtcagaaaaaagggagacacttggaccatataatttctgagatcttatttctagattttaaaaacccatggtaatgaatggttctgtgattctattctttaccatttttagcacttctttctctttattttttttaaatttttcttttcactgctctcctcttttattttttcttgttccaaactatcctatattgctgttggttctccctctttaaatttttccagctcgttgttcttctctccttttacctattctgttatttccctatagtttttcccttcctggggtaattaaagctgtccttagagtgtgatattaaaacattcattaagaaaatgggagaagccaccttagttcaaaattttgccctttcccaaaaggatgcattattgtaacctaacacaaaaatttatagtccagaacccatgcttgacaatgttttttgaaatcttttatctttttctttgtgagtgattttttattttgctttcttattttgttttattttatctaaacagagaacggacattctttgaagtctaatcatgatcactacagatgaacccaatgtgccaacttcccaacagtctatagagtattagaagatttttacattttgaagaaggggagcaaatctaaaaaaaattcagttgaacttctgagagttaacatatggtggattatgttgatttagaacttaaaatagatgtgtaaatttgggttcaaaatgtagatttgagtccagtttggatgtgtgattaattttcaaatcatctaaagtttaaaagtagtattcatgatttctggcttttgatttgtcatattcctggtcataaaacattaagaaaattatggctgttgctgtcattacatatctattaaatgtcatcaaatatgtagtagacaatgctgtaattaggtgaactctaaaactgcaacatctgacaaatagctttaaaaatacaatgattataagtatggaatcagtgaaaatatttagtttgtatttttatgtccaaacttttccattttagattcctttatagacacgtcagcctaaaaatcagcctattcgggtgttcttttgaatatctcctggcatttttgtatctaactttgttcaatctgggaatttcagttttcaatatccttgaaaatggcttaagtgataacttccgtttcagttaaaaggaagcccgaagttgtgtttgtgctgcccacaggacagtgggagttacagttcatatcaggatgaccctacatacccaggtcagattgacgggaccagaagggaacatcgacttctaatccagctttcttgtttaattatgacctaaatctaatttacttccactgaaccatccaagacctctggcaggcagggaaatgggcagtgatgcaaaaaagggagactctttggagcttttatgaatagttcatggtgaggacagaacttttctactttcagacagactgcttgctagttttatgaattcagcacacgaattatgctgcgttgctcacattcaaaccaaaccaacgactatgtttaatgaactcagtattcaaatttattatatatgcgtatatatgtatatatggatcccttatatttagatttaactcgtagttttatttgaaagtagaaaagaactctacaaaaacgggaagaatgtgtctttcttcccttcttgacttctaataggtgtcattgaaatgtaaaatctaagtatgaaattatgaaaggacattctttaattactgcccactcaacacatatttaatatgtgcccagattattctaaaatcttaaaaaaagatgcatatagtgaaattttttaaatggatatacttttaataaagttttataactcactgacaaaacatatttcaatagtatatgagtatgagatttcttatcaattatgagtgaaatattctatctgaatgcattggaaggcatttacagtatttgctttcaacagttactgagtatgacattttagcatgaaatatatcaaacacatcatttgaaggacatatgtaatcttgactatggttatggtttttttgtatgtattccttgttttcatattgatagcatctaattcttttgacaatcttaatatgtaggttcatttaaattttaagacagttcagtgcatatatagtagaagccttaagaaaaaagaaaatgagcaagcaaatatttgaagaaatgtataaaaccatagatttctttcagaaaaaaaaaacaggcataggaacagttttctcttcatatattatgattatgaataataggaaagttgtattaattcagtatttgtcattatgcagtattttaatacctacataagtctattccattattatattttgcgcttggcatatttattcctttatgcttttaatcactaacatattttacttaagagtataaaactatgctaaataaattgtattgtatatggaatatgcttgccattatgaagaacagctgggtataccattatttcaagtaataaatctgaattctattagtttaaaaattgtaaaattcaagttaaatgacgtgtatgatatataagctgaacacattttctatagcccttaatttagttgtgttaatttttcaaggtgatgtatcaacagctttttttattttgcatttgttttttcaatgtgtttacattgtatgaattgagctttttgcccacagattcttgatttgtagttgtttggcaggatttttctttgtgatataatcacttctataaaaaatatgatgtacatttgtcttgtgtatttgtcttcatttcacatgtccatagtaaatatttttacgtgaagttatttataaggaatagtaatttaccagtttgtgatcatctctttcatcatcattgttctctacatatgatattattagctcttattttcagatagtctcaagcagattctcagtatacagcagataagtttttaatagtcaacacaattattttactttcataccatatcttatttcacaacatagttattttaactgtttttagacaagttattttggtcatttcatttcaatccacttttttctattttgggctaacatttttagtttatgggaatgtaatttgctacaaaatattaggaaggaaatatcttcagaagatagcattttccaatgacagtaaccaatctttcctgagagctaagcacttgcagacactaatttatttctagccacaataccatgaagcacatttttagagatgatgaaattgaaaggcagagaggttagtgtacttgttcatggttgtagaattggaagaactcaagtctaagtctgtcttgtcccactttcaaatgctatcatcttaaacgggctcttccttatgctttttgatatatgtattttagtcaaaaactagttaatttgtggttgacttatgttctttattattaacttaacacacttccatttctgccagtatgacataatgaagcaaaattttttaacataattgagccttaaaatgtgtcttttcttttagccagaaacgtttgagcatctttttatcaagcatacagcatcagtgacatgtggtcctcttcttttggagcctgaaacaatttcagaagatatcagtgttgatacatcatggaaaaataaagatgagatgatgccaacaactgtggtctctctactttcaacaacagatcttgaaaagggttctgtttgtattagtgaccagttcaacagtgttaacttctctgaggctgagggtactgaggtaacctatgaggacgaaagccagagacaaccctttgttaaatacgccacgctgatcagcaactctaaaccaagtgaaactggtgaagaacaagggcttataaatagttcagtcaccaagtgcttctctagcaaaaattctccgttgaaggattctttctctaatagctcatgggagatagaggcccaggcattttttatattatcagatcagcatcccaacataatttcaccacacctcacattctcagaaggattggatgaacttttgaaattggagggaaatttccctgaagaaaataatgataaaaagtctatctattatttaggggtcacctcaatcaaaaagagagagagtggtgtgcttttgactgacaagtcaagggtatcgtgcccattcccagccccctgtttattcacggacatcagagttctccaggacagttgctcacactttgtagaaaataatatcaacttaggaacttctagtaagaagacttttgcatcttacatgcctcaattccaaacttgttctactcagactcataagatcatggaaaacaagatgtgtgacctaactgtgtaatttcactgaagaaaccttcagatttgtgttataatgggtaatataaagtgtaatagattatagttgtgggtgggagagagaaaagaaaccagagtcaaatttgaaaataattgttccaaatgaatgttgtctgtttgttctctcttagtaacatagacaaaaaatttgagaaagccttcataagcctaccaatgtagacacgctcttctattttattcccaagctctagtgggaaggtcccttgtttccagctagaaataagcccaacagacaccatcttttgtgagatgtaattgttttttcagagggcgtgttgttttacctcaagtttttgttttgtaccaacacacacacacacacacattcttaacacatgtccttgtgtgttttgagagtatattatgtatttatattttgtgctatcagactgtaggatttgaagtaggactttcctaaatgtttaagataaacagaattc

SEQ ID NO: 93 - DNA, 15292 bp, Homo sapiens
tcgggagacatggcgggcgttaaaggtacatcgcggtccccggctcgcttgtcgtgtggtggggttgccacctccgttccggtcaagcctggggctgcgccttccgcgcgccgttggggaacggcctcaccacccttcccgcctctccggttcgggaggcgatcgaccgctcccttcgtcccttggggtgtgggtggagcggcgtttcgggggagccttggccctttttgcaaggccgctggccttcctgctctccagtggcggcaccagacccctccccagcctgagccctcggcgagagcggcgccctccacctctcctgagtttttaaacaaggtttccacttcttgacgccaccctaacgcctttcttctggttttctgcccctccgcagtttcctatttgccacaaaggaccctttgtctccagcgttcttagcattgggaaacttaatcctctttttcctaatgatttttccaactgggcagagttgaccgcgggcgggtgtcaatggaaagcacccagaaagacggtgtttctcgcagtcgtggagagtagattacgtgtaattttaatactgctttcttcggtgttttctctgtttatggacagagaagaaaccagtgtgtgtgtagtatgtgttttttgcatggggcagttggtaaaaacaccgcgtcccttatctgtatggcttcagagcaatgcgagacggaaaaggttttttgcaaggcttcctgtattttggtaggaaaacattccatttctaatctgtcgaatagagtagcatgacttgtttttatattggcttttatatcatccttgaaatttgcacccaaagatatccccagttaacatctgctataaacatgtagatagtatatatacgagtacgcctctgttcactatgaatttatccgagtatgtgagctgttagcagcagacattttatcgttatttctggctgacttttatacttaatatcagtttagtaaacatggtttacttggagagtgtcgactgtgttatatatccatttgaagccaatgccgaaaacagatgaaaagtagtgtctcagtactacacatgatcagaaactaccaaatcatgatcacgtttatgtgtgaatgtgttagaaaattgtgatgtagtgaaaaaaaaggaagtctgaaatggaaacggactaagggaaggaagcattttacagattgttcaacttttattgaggaactactgtatgccagagacttaggatacaaagataaatgagaagttattggtgggtgacagagctggaaataattatattactatgtcagtgtttatgttgggctcagatgcggtgggagaacagatggtgggttggattttgtcctccaaaaagatgtgttcaagctctaattccctggtacctgtgaatgtgatcttatttggaagtagtatctttgcagatataatcaaattaaaatgataactggtttaaggtgggccctaatccaatgactggtgtccttataagaagaggggaatttagacatagagacatacagggagaataccatgggaagacggagacagaaattggagtgatgcagctacaaagtcaggagcaccaaagattgttggcaaccatgctggcaaccactgagtgttaggaagaggcaaggaagggtgcttccctacagccttcagagggagtgtggtggcgctgctgacaccttgatttcagaagtccagcctccagaactgtcagaagataaatttctgttgttctcagccatccagtttgtggtactttgtaacggcagccctaggaagctgatgcaggtgggattgattcccctgctccagagaaaggactgttttcacagaagaggcgatgcttgaactgaatctgaagggatcaatgtggcttcccttggcaaggcatggagtgaaggtggagtatatcccaagtggggaggacagcacgtgacatggcgcagggcttatgaaacaacatgccttcttctcttcaggtacttaagctacattagtaagaccagaacttagtggtgagggttgaagctggctggacaggcagttaggagtgagtcaggcgatggtgagcctccgtgccagaacaacttgtaggctgtggaagcaaccgcaaagggatggcagcggtgatatatatagttgaaagatcactgtctgctgtgtagaggatggattggaagagtcacagaggcaggaataagaggttaagggcctgcaccagggctgtagcagagagtttaagaagtctgggagattgagtcaccttgacctactgattcattggaaggtggaatgcaatcatggtgtcagtcctctaagataggacctttaaagtgtagggatagtggtttggttttacacgtgttacacatgttgaatttgaggttcttgttggcggtcaaggcagagaagtccagactggaggtggaagtacaggcctagttctttaggacctactctgggctggagcatcagttgcggccgggcccttgtggtagtaggagctttgggttgaacataagttttcagcaggagtgcgtggagtgaaaagagagatggggttggatttttggtcaactccaactttaagagattcagaggatgtgattcctgaaaaaagaggaaaaaaaagaccaaaaagaatcaaacagaaagatggttgtgaacgttgagaaactggtatcagaacagaaggaagaggtctgcagtacctagctttgacaggcctcatggaggagggggtactgccgatggtcaggcacagaggagaggagcaaagcctgctgggaaaagatcatctgaatgaaatagtatgtggtatttgctttccatccacacatgggcattttccattaaagagtggaaatgtaaaaagatatgttaaaattgacagtgtttctttgtcccttaacatgtgtatactttcagatgttttttaaaaagcactttggcaccttcctattaaagagtctctctaaatcttctctcaagtaaaaggaagcaatcaaaaatgttcattggcttaattaattagtttaatactaattatgagtattatggacttttttcagaagaaaatttggataagatagtctcctatgcttttgatttctacctttatcaaagaacattgctaaaatgagtagatacctgagtcagtcagcatttatttggctacctccttttgccaagcactttacatagattatctcatttaattcccataagctcaataaggtggcaccattatttccattttacaggtgagaaatcaggttcagaggattagcttctacccaaagtcataagaccagatggtggcagagttaagatttgactcatgtttgtgactcagagctcaagattttgtaacaaccttgatactctgtttctcactcagcagcacaacaagggcaaatacgttcctactcccgcagagactagtgtccaatagatacagggaatacatattttattcagtgcacactagttgggaattgtttcctacaaagacatgaaaacaatcttcaaatacttgcagtactgtggtttggggaggcaaaatgatcaaaggtatatattacagggaggcagttctggatataatttaaagaaggagggctttcaacatttagaagctgttggaattaaatgacttgccttgggaggtagtgagttttccttcactggagttatgtggaccaactggctgccctctggtgacaaatacagagggaattcatccattggataggggttaggtactggaattacttgagacctttgtatactttatgatttcaaggtggcagacatgggtcattgtcttaatcagtttgggctactataagaaatatattttagactgggtggcttaaacaacaaacatttagtttccacagttctgaagactgggaagtccaaaattgtggtgcagtcagatctggtgtctggtgagagccagcttcctggtttgcaggcctgctttctgctctcacattggagaacagagggagagaaacacagagagagtgtgtgctctactttctctcttcttataagggcactcatcccatcgtggagaccccaccctcatgacctcatctgaacctaattatctcccaaaggtccacctcctgatagcatctcacggtgagagggatggagccgggaaggtttcaacatgtgaatttgaaagggacacacataatgcagtctgtaacgggtcaaatgtaacctcaataaaatgagtaaattgctacatttgcttgaatttgggacctttttttctttcttttttattttagtaaatgtttttattgataaatgattcacataccataaaattaacattcttaaagtgtaagatttcatggtttttagtatattcagaaggttatgcagccatcactactatctaattccagaaaatttactcatccgccaaagaaactctggacctattagaagtcactccccatttccccaaaccctctagtgcctgacaacctctactgtgggaactttaacttttggctttatttttcacagctctcgtggcattatccttcagtggggctattggactgacttttcttatgctgggatgtgccttagaggattatgggtaagttatcatttcaaaaagaactattcctctttctgtgtctttgtcactattagtatgggtgttagagagttcggtcaatttagcaccaagttctaaccagtgagttagtggagcccagtttatgaacacagtccctttgtgggtcaggtgtacttttgcagagggctctgttaaaaattgatgtattcattccataagcatttgtttaacacctactctggactagctggggacacacaaatgaagagagagtcctgtcctcaaagaggaggtaaagttctagttgtgagtgagagacaggcaaacggtctagtcagtaatctggcagctgcagtggagatgccagcacagtacgctggagctcggataaagtgcacctgagtttcagtgggacagtcagggaaggctgcatggcagaggttgtatctgagccaagactaggtggatgaataagagtttttcagggtgatgagtcaggggaggacattccaggcagagggaacattctacacattttttcattcaaccattgttggttgaatgcttcccatgtgccagctactgttatgggaactagggattaagacataagaaaacaaaggtcctgctctctcagagtttgtgtttcagtgggggagacggacagtaaacaacaaaagtatgcatactgtcagaggtagaaatggtacaaaagatgaagagcacagaagctgggaagacagtggtcagggagggcctctcagaggaggtaaaaagtgagaagaaatgtcaagaaaatcagcaagcaggccatacagatctctagggaaaaagcactttaggcaccaggaaagctgaatgctaaggcccggagacatgaaagtgtatatagccttttcaggaaaccacacatggtacattatggtacagcataaattgtagtggagtggcaaaagaagggttagtcaagagtgtaaaagtcagcacttagggctctatatgcctgccgtgtagaggaggttccattttatacatcagacaatagaacctgggaaaatatcttgagaatgggtttggaggagggggttatgttaaaatgtcattcttgccataacgtgagactagataggaaagagctgagactgcagtcagggagaatagtaggggactactatcataaatcaagcaaaattgagggctggggcagtaggaatggaaagaaaaggagagtgagttaggaaaccaaaccaaccaacaggttttgttcatcgatgtcaggattcaacaaggagggagagttcttagatgtctcccaggtgattggcttgaacaactagatagaagatgatgtgattaggccaggcaccatggctcacgcctgtaatcccagcactttgggaggctgaggcgggcagatcacgaggtcaagagatcgagaccatcctaggcaacatggtgaaaccccatctctactaaaaatacaaaaaattagctgggcgtggtggcacacgcctgtattcccagctacttaggaggctgaggcaggagaattgcttgaacacaggaggtggaggttgtagtgagccaagatcgtgccactgcactctagcctggcgacagagcaagactttgtctccaaaaaaaaaaaaaagatgatgatgatgtggttaagacctattgaagtgagttattatgacagtgatgaattcaaatccatcaccgcagtcctggccaactattacagaaattgtttaaacccaagagggatccagatataagcggtcacttatatttgtttagagccttcacagcaattactttattctagcttttggaatgtaatacggtattattatcctcatttctcgctgggaaaccaaagcccagggtagttaaagacttacccagattgaacagcagtaagtgacagagcccggccgtggtggctcatgcctataatcccagcactttgggaggcaacggtaggaggattgcttgaagccaggagtttgagaccagtctgggcaacaaagtgagaccccattctacaaaaaactaaaataagccaggcatggtgcctgtagcagggttgggaggctgaggtgggaagattggttgagcccaggggttggaggctgcagtgagctgtgatcacaccactgcagtccagcctgggcgacagagtgagactttgtctcttaaataaaaaagtagaaaaaaaattaaaatggcagacatggaaatggagctcatgttctgacgcccttgaccaaacgtttttccactattccacaaccaactgtaaatctaggagttttaattctctgtgatacactgtctttgtaaggtaagaaaatgactcattactgctactacaaataagtttgttttctatctttattttaattttttgttttttagagatgccacaacacccagctgattttttttagaagtttttgtagagaccgagtctctctgtgttgctcaggctggtcttgaactcctggcctcaagtcatcctcctgccttggcctcccaaagctgtatcttgatagtgaaccaggattatcatctatattggaagtcagcaaactgccacatataacctgctacctgtttttgtaataaaggttttattgaaatacagccatgctcatttgtttatgaattatctttggctgcttttgcattgctctgccaattatctttggcagagttgagtagttgagatagtctttatggcttgcagatcctcgttatttactctttggccctttatagaaaaagttggcccacccctggcctatgtatttattgaattgtatatatttaatatttacattttatatataaacaaggtttcttgtacattaatatttctcttagttggatatcggtggcttactatgaatgaaaacatagagtcagattgtttttcacaaaactgtcactgtattccaggaaaaattaagagttcttggctgtggatatgtaaggtgacatatctattccaaaccccttcccctctctgtgtctcctttctcactgttgaaagaagggctttgaagtagagaatgtctaagggctacttcccacaatattgtttggtgattcttgaaacatactatcatccctctagtttaaaatcaggggtccaaatccactgtttccatcctgagtcctcttgaaggacacattcccttcttgccttttggttgcctagatctgtggctggaatgggaggctttcattagtgtggcttcatcccaactcctgcttgtaggtgctgtctgggcgtatctgtgtgattacagtattgtggtgatatgaattattgtagtgtatatataaaaatgagcagagactttttttttcttaagaaatgaagcataagaaatgtctgatggagaaaaaaagattatttttgaagtactgatagagaaaatactgttggaaaccagatggcaattttttttttataattgcaaaatgttgaaatttgggaggaaaacagttttgttttgtttttgcattacactattaattgtgagctcttataatgaagatcaaagtacatctaagcttttcactagtgagcatatttattttcatgccttccgtacttaaaatttatttattattttattcatttaacaagtataaatggagtacatcattctaggccctggagataaatggcgtttgatcaagactaatctatcagatgggaataagtgttgtgcagaaagttcaaagagggtggtatgttcgagggtgacctggggtacattagaatagatgaccagggaaagttctgcttttagaaaggaatctgtcagtttagatcacatggtatgaaggagtcagccaatgagaagatcatggggaaggacattgcaagcagggggcacagctagcgcaaaggccccaggataacagctatgagctcaagagtgttcaagggacagaaaaaaggctggtgtggctacagattaagcaaatgaagggaaaagagtacaaaatgaatggaagaagtagataataccagaccataaaggctttgtaggctagggcaaggaatttagggtttattctaagctcttaaaaggtttcaagcatgcgtgcactcaaaagatctttaccgaactagcttttgcaagacactctactatgttctatagggaaggcagaaatgaccaagttaaaattctgtctttaaagaaattgtggctcagtggtacagaaaacagtaaagtttctagggtatatattatatagtggcttcttaacacaatataagctacctacatagtaattttaaaattatcactacttatctatccctggtagaaatcatcttatgttctaatattcacaattaattaattttttgacctaaacatttaaaatagcaatgattttgaaatagtagtatgtctttcatttaaaatgtaactgttacttttctttttggattttgcctgggtccaactgacagcgtttactggcccttattcgtcctgattttccacgccatctcccccatcccccatttcattgccaaaagagtcacctatgactcagatgcaaccagtagtgcctgtcgggaactggcatatttcttcactactggaattgttgtttctgcctttggatttcctgttattcttgctcgtgtggctgtggtaagttttattttctattgttttgcccaaccgttgctgagtttacttcagaggcctgtgtctgggacctccatttcatgctcattacttaggctttatactcaaggccgtgtgtttttagtttctctgttcctctactttagacctgcctaacagtagttcggccatgccttcagagtgctttctttatttctcttacaacttttagccagacgatatgatttcttactttttctactttaagctattctctggaattgttcttaaattcctgcctcttaaatcttacagtaatccacagatactatgctagcagtacttttctagttgcaagatgaagatatttcaaattcttctcctgcaaatgggatcatggactcaactctcaactcagtataataggtatatgttgagggacaactgtgtagcttccagaaaatgcagtgaataagttgacatcttcacttccaagacaaaaactttctttttgtcttcagagtacacattgtaggtataatttattcaattatttgctattcactgtctttcctactatttgattttattccctccaattacgttctattttaattttatgaaactcttatttgaggcattgaatatcagataagcgcaagtcttgttcattcaataaatatctttgcaacaactgctacttgtaaaacaccagaaataagaaataggtactgtctctgctcctgaggaacacagaaactagcttgctgggtaagtatactataagtgtactaagtgagacggttgaagcatgatcagaatgccataggggcaccaagaagagagaaattccgactggcatttgatatgggcctctaaggataaatagcatttgtattgaggtaggatggctgttgtatggaatgacattcaagtgtaagaatgcagtatatagaataaagaagaatccagtgtggtagagctaaaagaaagttgttgaggttaaggctggaagggttgtgaaacctgattagcaatggtcttgaaccccatgccagtttgatctttgtctagataatggggaaagattgaaggtttttgaatacaacaagattgtcatgactttatttttcttgtgctttagaccagcccttcttaagcgctgcagtaaatatttatattttttcctttcaatactgccatcatattttgtgaagaaactttcattgatgtttctcttgcttaaagtaaaacaaaaaatgcccactagagggtactctcacccccaaatgtgcttctgtaaaaccatctacaaaccatctactaagctggaaagcagttttcagttgtatgaagactattatttaaagtcttttcttgcctagaaaagaaacacacaaatttataactctacaatttttattttccatgaaagaagttgatgtgtgcagaactttcagtacccaatattgtaattgcactatttataatcttaccacttgagttttacttaaggcaatcattgtcaattaaaaacaagtagagaaatatgtctaattgggaacatgttaaggatgataccagacttaattaacaagcatcacagaagtaattagactcattactgaacagttcattgtctcctgttacattattaagccttttagcagctttgtgtaacatttcattggatgtttctaatgcagaaaataatagggattgcaaagagtacaatatgaaggaagtaaggatttaatccttcttttcttgtctttcagatcaaatggggagcctgcggccttgtgttggcaggcaatgcagtcattttccttacaattcaagggtttttccttatatttggaagaggagatgattttagctgggagcagtggtagcactttattctgattacagtgcattgaatttcttagaactcatactatctgtatacatgtgcacatgcggcattttactatgaaatttaatatgctgggttttttaatacctttatatatcatgttcactttaagaaagacttcataagtaggagatgagttttattctcagcaaatagacctgtcaaatttagattatgttactcaaattatgttacttgtttggctgttcatgtagtcacggtgctctcagaaaatatattaacgcagtcttgtaggcagctgccaccttatgcagtgcatcgaaaccttttgcttggggatgtgcttggagaggcagataacgctgaagcaggcctctcatgacccaggaaggccggggtggatccctctttgtgttgtagtccatgctattaaaagtgtggcccacagaccaagagcctcaacatttcctagagccttattagaaatgcagaatctgaagccccactctggacccaggacattttgatgagatccaaaggagttgtatgcacatgaaagtttgagaagcatcatcatagagaagtaaacatcacacccaacttccttatctttccagtggctaaaccacttaacctctctgggtgttacctgctcatttgtttaaaaaaaaaaaaaaagtctcacctgctttcatgctgaggacaagttcagatgttcaagcctataatatttaggcagttcctcaaatttatgaaaagtgttctcagaattgggagacagtcaaagggtacaaagcctcagttaggaggaataagtgtgatttttttttaaagatcacttgcacagcatgctaaatataggaataattgaatgtatatttcaatattgctaagagagtaaatttctaatgttctcataaaaaagttaaatatttgagatcatatgttaattagtgtaatcattccaccttatattcaaaaatcataaaaccgtattgtaccctataaaaatatacaataatttgtcaatatataatcaaaataaaaaacaaaacatactctctcccccaaaaaaacatctcagtggggaacagatgtatcttttcatctgaaagacaatgctgggggaagagctccactgagatgcgggcagggaggctgggctcgagccagcccctgcgttagcaggagggggagaacagataggtaactcttttacatttcctttatgatctggcacttctccccagctccttccctctgccccccacccctactcctcaacagttctggtttgccctgacttctctacggctctggcttcttcccgaagagatataggagccatgtaagcacgcagtgggtgaactgcttaatttcactacgtgttgatgtacttgtcttccgtcctgtaggtcttttctatataactttatgccacccttaaatgaatcattgggtatacctgtcatgttggatcctgtaatcacagttttccctgctcacctttttgtctaagatctattgagaaagggaaatatgggaaggagaaccatttgatcagaatacaaccaatagtctttaagcattgttaaagtatgaaactgaaatacattcaaaacacttaatccttgaggcttgtgatctgagtaattagcaggtatgatgctgggactggaaaatagaaagtaataactaaagggttaatgtgcaacgttattttttggccttgttcatgattttatgttttcagtgtcctgtgtacatatagaattgttaaagttgtcatttccaatatttatattagaaaaattatttagatactttataattttaaccggcatttttaataatgacacttgcatttattgtattgtaataaatttcacttttaactttaaaagtttaactttaaaatttttttgtgatgttgccttgcctgaaaagataacaaaaatgagagaatttcttgatgttttaaaatgggcagttttgagcaataatctgtcctaacagaacagtagcaataagttttaggataccatcttgaatgtctagttggtgtgcaatagcttttctttctaagatggcaataatgattcatttctactacattttgcaaaagtgtttttgttgcttatacacattttcaataaccaaggtagccttcatatgtagccttaaagcattacctcttgattgtatctttagattgatataaagtacttgcatatagagtatttgaagtgatagattattagatttgctctatgtctgaaaagagagctattctgcagtgcctaaatatcatttaaacagtaaatattaataggaaatattgctatatctgaatatataatacaaaagtttgatcatggtgacacaaatgttggacatttttttccttataaaaggctctttttttatatattgtacaatatatttggagattcagagcatagtgactatagtcgaaaactgagattgcacttccaaaattggccacaagtaaataatcttatgaagggattctttatcatgtttcaaacaagtgggttacaagcagactttgagacacttttccacagaaacaatactatgaattggtgattgagttcccaggccaagcctccctcaacaggttcaactctaatatacctaacctgtgatactgaaggtgcctgcctgagttttgggtctctgagacagggtagtgtgagtagtttggaggaaggacagtgcaactttccaccccttttcctaagaacaaggtctttctccttttaatttttccactcattttcacctcctaatgcccttgagatccaggtacactcctgggagttttgttcacctctcccaactgagaaccttcccactgggctccatcctccctcctgaggttcttcatattccagagtcacccacccttctcctcccattagtcagttctctaagtacagctgatgtcatgtggtgctgagaagaaagcagatcacacttcatcacagaaagaatgccttgtgattatcttctccacatctgaaattccttttgacacctgcattgggccgactgccattcccatgactgctgcacctgcgtttttagagaatgcctcataacccactgattctcattcacagagaatgggagaacggaatgaagaaagattccagcagcttatagaaggatagcaatattttgggacagggaaaatcctgtcatacctcatctcttcctcaggaggagttctgagctggtcctgcttttcatagttgtttcttttcttccacttaagaactcatagatttttcttactgtcctaaggaagtccttacctctgaggtatctcctcaatgaatactgttttcaaggctgaaatagttcattatgttaataaccttctttatgttctcagggaaatgcttaggtggtgtcacaaaatgtgccttttcttttctttttttttttttttttttgaggcagagtctcgctctgttgcccaggctggagtgcagtggtgcgatcttggctcactgcaagctccgcctcccgggttcacgccattctcctgcctcagcctcccaaggagctgggactacaggctcccgccaccacgcctggctaatttttttgtatttttagtaaagacgggtttcatcgtgttagccaggatggtctcgatctcctgacctcatgatccgcccgcctctgcctcccaaagtgctgggattacaggcctgagccactgtgcccagccaaaatgtgcctttgcaaagtttgcgaaatcagattttgtatcccaatagaaccaaaatatttatgaggatgctagcattttccaagcatagtaattagttcacaactgagaaatattatgtctgtagtagataaatattagttgtgcattttaatttaattctcctttttccattttgtctcatgaagtaccttattgcaaaaatcccactgagtaatagctcataaattataatctttcaaatagccatgctaccagcgtacaacagtgatacatgtaaccccaaatgtgatgtgagaggacgattactttgtaaataaaacttgttattgacattttaa

SEQ ID NO: 94 - DNA, 100546 bp, Homo sapiens
accttgggcgaggagttcggagcggccccatcgcagagcccacggccagccgagcgcgcgcgacgcaggtgcccgagccccggcgccgccgccatctctgccttcggtcgagttggacccccggatcaaggtgggacctgcttccctctccgacaccccctattgccacctcttcccgctctgggtaactcgagaatggggctttgggacgcgcgtggcagacgcggagccccgcgggccgcttagggactgggagtccggggcagcttagcgggaccaccagaggggccagcgcccggcgggcggcgggggtggggtgggtgcgacgccgggcgactctcggctcccgtggggcgaggaagatctggacacacggctgacagcagccggcagcgcctggagcgaacctgctcgggaccaccgagagagcatgccacccggccaacttcttttccaggcttcgtgcctactttggaaactgaagggactgccacctaaaacagtaaaccctggggtcctgaagagaatttgctggttcgaatgacaagagaaaaaataattgttctgtagggatggtttagacctcagcttttgtttcccacctccccccttccctgcaagcaaattaaacaacaacagtagcagcatcagcagcaaaaccccaaacccaatcctaaccaaaccacttactgaaagagatttgtagtggtgagaaaaagagacccaactgaggaatcatttgggaaccgcaggtatggtgccatttaaaaactggttctttctggtgttatttctagaacttgtgtttgcaaacagattagaattctgggctcttgtcagcctaatggagttctttatactgaagggtggcctggggtgtcctctgttaacatttatttctgtaagtattaaagtatattgaaacaaataccctttcacggctctggaattggaatcagaaaatctgagttttggtgtgatttccattttattacctatgacactgtggttcgtttaacctcagtgggcctcagtttcctcattttttcaagttggagggttggattaagataatttctgagggccttttgagaatatctaaggtatgccccagaataaaaaagtataattccttaactctctttaacttgttacaaacattgctagtttcataatttcatgaaataaaaacaatctgtattaatcttggcactagtttatatgcatttatgacttaggcttttaggattttcccaccaaaaggtatagagaaaaacatgtataaagagctcagaaacatatagatttatatgaatatttacacctctcatactaccttaaataatctttaagccagtatttgcaacactgcaacaaaaatacatggctttagcatagcacgtattctctttaagtattgtacatctggaggaaataaaaatgtgtttgaaggaaaacaaacattgcacctttcctatcaattattgttcttgaacagtgctggctactttttagcataaagttgtgggcagaatgttaaaaaattggtttcaggtcacttctgagccgctgtgaaattaagcacaatagcagagatgccaattttagtaatgcagttagttgccttggaatgaatcccagaaaatagcagagattaactaaacagataaaccagaaattaggaatggacacacgcacacacaaaagtgtctacagtgagtatgtactgtgaagggttagtgtacttcatactttctttttgattagaagaaaatgtcgggttgttttagcagacagagaatgttacagtagcttttgttgctacttctaatgttttatcagtagcattttcaagattatttgaaacttagttatcactagtaaggacaggtttaagaatatttctgcctcttttcggtggcttggattcaaaataataaaacaatcttttctcacccacatgtactttgtatgcagtttgggagagtgaaatggatttgaagtactcttttatgagtacattttaacttattttcagtgactttttgcctttgggctggaaatgtcgtaagttactcaggcatttatcttccctcatattctctggtgaagtagagatagtcatctccgttgaaacagatgctcagagatgtaagtaaattgcttgttgagtgaacagggaatcgtagaactcaaatataccctggttgctaagtcatttggaaaacaactgaaactggatggatccaacagctcacggtccacagccaactcattcatggcttgggagtgtcatcatgggtggcagaggctctgttcctcctttgtaatgtggggacttactctctcagcaatttactgagaaaaaagtaatctcttcacacttagatcactattataggaacaaatggtgtgtatttgtgaagtgcaatatttctgggaggtcttggaaataaatactaaaagtatccagaaaaaaaaaaaaaagaactctcttggcagatattgtactgcatttttcatactgagagccaaacacacccacttaaagagtatgtcctgtggagttaaaaatgaagaaaaaggcttatagtctgctctaattcttaagactttatgtgatttacaaattccagttttaattaaattagaaagttgcaaatgttcacctactggccacactcagtatgtacaaccttttggagttgctcttcaaatacgatctgcttatagtttggaatattccttctcaaacatgttttttggagtcttgctatgttgcccaggctgatttaatactttttgtgacttaatagtgatattacctgttatcatcacacataatcttattaatatttaaaatattttaaaactacaaatcttatataaatataaataaaatctttaaaacatttgaactgtaatgaatatagagagaagcatataaaacaaatttaatggttgacagataatatgataaatcattataataattgtaaggcaaatttctcattattcaccacccccaaaaaaagaacattgcaaatatcccaaaacttcttgtttgttccttcttcatcacaaatctaatttacctttttttaaaaaaagaaagttatttacttatttattttgagacggtgtcttgctctgtcgcccaggttggagtgcaatggctcgatcccagctcactgcaacctccgcctcccaggttcaagcgattctcctgcctcagcctcccaagtatctgggattacaggcgtgtgcctccacacctggctattttttttttttttttgtatttttagtagagatggggtttcaccgtgttagccaggatggtctcaatctcctgacctcatgatctgcccacttcggcctcccaaagtgctgggattacaggtgtgagccatcatgcctggcccaaaaaaagttttatatgattatggtaggcattaaatcatagattattttgcttaacattatgtttatgagattaagggatttcttctctctcctttaaaacaatattttttgaaagagttatctcggctgggcatggtgcctcacgcctgtaatcctagcattttcggaggctgagacgggtggatcacaaggtcaggagttcaagaccagcttggccaagatggtgaaatcccatctctactaaaaatataaaaaaatttatccagacctggtggcaggcgcctgtaatcccagctactccggaggctgaggcagagaattgcttgaacctgggagacggaggttgcagtgagccaagatcgcaccactgcactccagcctgggagacgagtgagactctgtctcaaaaagaaaaagaaaggaaggaagggaggaagggagggagggagggagggagggaggattgtctctattccctgtctccaattattctcttcacactgttaaaaaaaactcattcctattaatcttgttttcaatattctgctaaaactacgtcaaggtctactactgtcaagttcaccaatgatactacctttgctcatccagtagtcagttgtcagtgttcattttacttcactactggtagcattgtcacggttattactctgctccttgaaacagtcccttactgacttccaggacaccatgcattcttgattttcctccttcttcactggctgctcctttctgtctcctgtgctagcctctcctcttttcttagaggttttaaccttggaataccttaaggtttagctcttttttctccatgctttttgatgatttcatgcaatctctctatgtgtgtgtgttgatgattccgaaagtgatagctcaagccttgactgctccctctggacttcagatctttatattccagctgtctactgagcatttccatttggatgtctagtaggcatctccagttcaaattctccacatggaatcttcatctttcccaaacctgcactatctgcagtcttcctcatctccatctttcaagttagttaggccccaaaccttggagtcatcttcgattcctcctattctctcatacctcgtttgtaatgtgttggggaattctctgtgctctatcttcaaaacaaatccagaatataatgacttctcattacttccatggctctgttacaggaaaggggtcccaatccagaccccaagagagggttcttggatctcatgcaagaaagaattcagggcaattaggtagagtaaagtgaaaacaagtttatttggaaagtgaaggaataaaagaatggctactccatagagcagccccaaggtctgctggttgcccatttttatggctatttcttgatgatatgctgaacacggggtggattattcatgcctcccctttttagaccatattgggtaacttcctgacattgccatggcatttgtaaactttcatggcgctggtgggagtgtagtagtggggacaaccagacgtcactctcgtcatcatcttgattttggtgggttttggccatcttttttactgcaacctgttttatcagcaagatctttatgacctgtatcttgtcctgacctcctatctcatcctgtgacttagaatgtcttaactgtttgggaatgcagcccagtaggtctcagcctcattttacccagcccctactcaagatggagttgctctggttcagacgcctctgacagctcccaccctagtacaaggtgccatcaactctcacgtgagttattgcaaggacctccaaactggtctccctgcttttattttttgccctcttcaatacattctcaaaatagcaatcagagcactccttttataatgcatgtcggatcatgtcacttttctcctccaaactctccatggatttctggttcacacagagtaaaaaccaaagtccttaggataacctccaaggccctacctgatcattctgcttgccactttacctgtctggtctcatttcctactgttcttcctttcactttactcagttccagccacactgggctccttgctatttcttgactatattagaaaccatcttttcattttagcttttcctgccttgaatgcttgtcctccagatttccacatggttcgctttgttactgtcacttcttttaagtcttcgttcaaatgtctccttttcaatgaggcctactctgattacagtatttaaaattccatatcttcttaccttgtaatatattctttttcctttcctttcctttcctttcctcctttcctttcctttcctctcttctcctctcctctcctttgtgtctccctatagcattattttaccttataaaatactgtgtgactttctaattatcttttttttttctgtcccatttccactagaatgtgaactccacaagggcagaattttgtcctgttttgctcactgttgtgtccctagtgtgtgaaatagggcctaacatgtaagaggtgctcaatgctttttttggtgattgaatgctattgtttgttcatttttattcctggatatattcaattctataaatataacacgttaatttaaaacatgaattctgattatgcacatttagtttccttcctttcttcttccctcacccatcacttcttccttcctgccttcctcccttccttcttttttgccactataaataaagcagctatgatccatctacaagtgtgctagtatacgaagtttctttagagcgtaaaaccaatagacaaattacgggctagcaggacttgcagacttcaactttattagataatgaatgccacacatttttagtgtggattcaccaatttgcattcctgtttttattgctctacaccagatggacaaacttcgtattgccagaacatttaatttttcgccatctgatgggtattatctcattaatagttactactttaattactggtgagattaagcctggtgtctgtgaggataggttaggttatgctgcagtaacagataatcttcaaatctcatgggcttaatgcagttcttcactgatgcaaagtctcctatggactaagacaactctctggggcaacttctccatgtaataacttggaggtctaagttcagggaaactccatcattctgtaactgtaacaatctggaacatggaactttcccatttggtgtggtaggggaaaagacagcagggatggatactcgtgagccatcttcaaatgcttccatctgaaagtgacatgaattattttcaaatgctaaacgtaagtgtttaagatagtcatatggtaatatgacccagtaattctattcctaggcatatacctaagatggatgaaaatatacatccacacaaaaagttgtacagaagtgtcagtggcaacattcttcataataaccaaaaaacagaaactgcccaaatgtccatacactgatgaatggataaacaaactgaggtatatccatacaatggaatattattaggcaataaaagggaatgaagtgctgataaatgcttcaacacgatgatccttgaaaacatgatgctaacagaaggaagccagttactaaagaccccaggattttatttatatgaactgtccagaataggcaagtccataaacacagaaagcagatcagtggttgccggggatggaggaagctggtgaaaggggagcgactgctaatgaggaagaggtgcattgtggggtgatgataatattttgaaattagacagtggtgatgattgctctgttagatacattcactcaatgtactaaacctagtgaattgtatgctataaaagagtgaactttatgatatatgaataatagaccaataaaactgatattttaaaaaatactttaaaaataaagtatatttctatatgccatcaagaaacagaaaatgaaatattttagaaatgcatcatttaaaatgattccaaaaacatgaagttcctgtgaaaaacatctaacaagatgttcagggacttttatggaaaaaattagatgagatttacatctcatattagggaagaactcagtatatggagacagatagtcatacattttaggactgaatgattaaaggatatcaatttccttttcattgttatagactcaaaacagtctcaataggatctctattaaattcctaacaatttttttagaacttgacaagctgattctaagatgtatatggaaagtcaaaacccaaagaatgctaaagcactcttgaaaaagatgcaaaatgggagaatttgtgctatcggatagcaagactcgttttaaatctgtagtaatcaagacaatgtttctttattatttctttttcccttctactttctttgattttttctgttctaactgcttaagtgaatgttcgattaaatgttttattctaacagattataaaggaatgatagcacattaattttcagcctttcttctttttgaaaagtattatttatggctttgagctgccttctacatacttctttatctgtgtgaaataaattttgagatactgttttcactaagatcagtttaaaataggttctgattttcatatttctttttgcccagttattaacttaaaagtatttttctggttaattgaaactttagtcaatttggagtaagcttcttgatttctaatgtttctttttgcattaaagcctattttgtatgatattgatataactccaccagctttcttttgttccgtatgtgcatgttaaatcttttttccatcctttgctttcagatttctacatacttattttaaatgtgtctctgtatcctatatcatttttctgtcattctgcattcaacctttctatattcttatgttttagatgtgtctgtagtaaacagcatttatttcttaaggtattttaaattcaatgtctttccactggagaattttgtcagtttacatttaatacaattactgatatattgaggcttgtatttactttctgctttctttatttgcccataattctggttattttcttttttattgccacattttaggttgattatttttatcacttcaaattttctttcattactttaagagttatacactctatttctattgttcagtaactactgtggaagttaccatatgaatccttaagttatcgaagttgaaaatgaatacactttgagcactaatgagtacaggaaaatacagaggccttagcttactttaacttcatttaatactctcttgccatatattgtgagcatcttgaattccatttatttattcaaatatttattgagagcttactcggggctaagcattattctagatactgaacaaaatagatgagcatccctgtgcttgtaagacataacagagtgcaaacaataaacttaatagagtaaattataccatatactagaaggtagtaagtatatggaaaaaaaactagagcaaggcgaaagagattaggagtgccgagagagggagaaagagaatgaatgagagtgagtgcacataagtacaagtgaaagtgagtgagtgtgccctagctttggaccaatactgtctataaagtttgtggggacatataaatgttttatctattttcactagataacagctgaaaggtttgagccaaatagagagtctcaggtgcttctataatggtattataataggctttaaaaacgtgaaaaactcatgtttaagaacagctgttaccaactatctgttttgtgagggtggaggacaacttagtttttctcagaattaattatactttcttattgtaactttagccgctgttatttgggtctctaaacctatacaaattaagaagctatgaacatgagagaatcaaacaattagatttctgtgcacaccaacagaatttctgaaccaaagtggtttgtgtttaggagatgaaagagatgataaatcatacacacacacatagataaacacacatattatatgcatgtgtgtgcatgtgtgtgtgtgtataaacacagagagaaaacatactggcatacacataagcacctgttaattgtagttgctgttatagtagtaagatgttatctcttagaattatggtatacttatcatattagacctatccaggaggtagctgggtatctagtgtggtgatactatctagtgtggtgtcttgcaacaacactgctagtcataggtctgatttgggggagaaaatatttttttaagacagtgtctcgctctatcacccaggctgaagtgcagtggcatgatcatagctcattgcagcctcagtctctgggttcaagctaccctcctgcctcagtgtccccactgcatgctaccacacctggctaattttttcaaatttttagtagggacgaagtcttgctatgttacacagggtggtctcaaactcctgaactcaagtgatcctcccgctttggcctcccaaagcgcagggattacaggtgtggaccatcgtgccaggctgggagaaaagttttgttgacacaacaaacaggatgcaaagaaacaatctataaaaacagtaatttaggtaagtggcttcttggtcttttgattaataggattctaaacttgcaaatcaattcttatgcaggagttcttattggcatttaccgatgctctttggctgatgtttgtttttactgaccagaggttctgtgggaatctcatttattaatacttacaatgtgcttcatattcctctgcatctttgagggacaattaaatgtccactctatggaatcttttataatttcccaatcataagtaattactctgatttctcctaattacccttttttctaggtagttgtgattctttaagtctaagacagcatggatttttaagctacaccactgatatagtttggataatagtcccctccaaatctcatgttgaaacttgattcccagtgttagaggtgagtcctgaagtgggaggtgtttaggtcatggagcagatccccaaagagtggcttggtgacatcatcacagtaatgagcatgttcttactctattagttcctgtgagcactgatttttaaaaagagcttggcttgtccctcctctctcttgcttccatgctgtcactatgtgatctctgcatgctggcttcctttcccctctcctttgcctgcactatgagtggaagcaactcgaggccctcaccagatgcagtacaggtgccggtgccatgcttcttgtatcgcctgtggaaccatgagccaagaaaccttttttcttcataaattacccagtctcaggttttcctttgttacaacatgaatgaattaagataaccatcatttttgtatcagtaaaaagaaaaagctctgcgtatttaactattatacagtattttttatcatttaaaaatttatacttattcagatagctcactaagaattatatatataaacatttttatttaaatcatgccattctcataaggaaagtataaatcaaagatttcggttaagggattcttattcatattcaaagtctgtttttttcaagttgcttttcatctcagaactgttgatgtaaatattttcccaaacagtatcatactctgggctatcaagaatatttgtgatacagcaattcaaaaaagaatgcctcactattgtttctgggattttcttccaagctggttcattttgctaattttgatgcggcttttaactgatcttgtaagatgtcaatatcgggttttttggagttcatattctttcctcaaatggtctttaaatagtttgttgaccaaaatattgataggttaaaattgtccagttggtcattaagaaagtgtccagttttgatgtatgcaatcaataacaaccagatcacagctgctaccaggccatcgggaattgtaagatgctataaatttaaacaatgatgctgatgccagaggtgttaaaatgttgtgaatcttaaaacagaagacatacaatactactctcttcctttgtatttcctgtagttcaactaaaaatctcacctttcgttggcccctaggactttgtgagtagctattttctctgaaatcccatagtactttatttaatgaaaggaactaagtaataatttggggtgaaaataatccatgtacatggttaaaaaaaacttacttatgtataaaccagtagccctctgctctactacctacactaaagggtataacctgaccctaggaacaactagtttgaaccatttctggttttagtccttcttcctctagggctaaattgtatgtttatactgtctgcttttctttttttttcatttatcatttaagcagataccatagtagaagataatttagcctactcatttcacctccttttcttttttgctcctccacatatattaattttatgagctcctttattggttacatttgtcatttccaccacgatatttgttccattaactacagacagtttctcttgaacccctgcttcatgagtttgggatatttcaccctttctcctctcaccatctctccttgtatattataacacctaaatctgacaactgtgtggtgagagtattgataatattttaggtttagtatttgttattaaattttgtatttttgtctattggttgaccctaaaagttgaaaaattaataaatagcattaaagttattatgaccctgtaaatgttgtttactgcagaatcaagaagtattctacagttacatttcattcagtatggctcctgagccacccaaagaatgttcctagaatcaaagttaaggagattctttctttcaaatggattatttaattctagcatttgctaaaaatttgccatattttcttttcattcatatttacattgtgaatttctgtgacgctttttcaaattacctttattttttcttattgggaaagcatatgtgggccttcctggtttcatccttaataattttcagctttttactttctttatttttttgaatgcattttcttccttttttttttgaagtccactgactcatattctagtggcttcaattttgaattatgacttcctttttccctggtgtttattctgtttttattttattttcaagtttttttctggcttcaggattatattatgtgtcaggttgccttccatctccaccttcctccttgccatctccttttgggggccatctatactacagctgctatctggactagtcatttgaaagtttgcagagccagcaaacttgtttgtaaccacgatttcctgaatgtgtatgtttttgtcgtttttggttttctcctcattttgctggaatactttataaaattacttctggcaaataaatttatactatataaattttgtaagccattacattactaaaagtatatttgtttctctcggatacttctttgactggatgtaaaattctaaactgaaaagaattttctataagtcagttgctggattattttctagtattcggtgttttgggatgaaacatttgttttccattctctttcttactcctttagtgatttttttcttctctggaatcttttcttatattctttttttctttgttgtttggtaatttcttaattatatgtttaggaatgaatctgtttccattcttctttcttggagcctggtagccatatttttcactttgaacacttgtgccttttatctctgggaaatgtgccttttatctcttgtgccttttatctctggaaacacttgtgccttttatcgctgggaaattttcttgtattttttttgtgtgattattttctcctttctattctttttttctggaagtactgttggttggatttgggtctcttggatttatttttaagtgacttctttttcttaaacatttatttcctggttttttttttttgcctttggggggaaatgttaattatgcattttttttaaaaccattgaaattttttttttgtactatgcatgtaattttcaaaagctctttcttgctctcattattcctttgttattttatggatccaaaactttctgaaatgtctctgccaatactcattaaagatttgttaaagcttttttttttttctttaatttatccctgtgtccctggtggttagtttcctttttactttctttttataaaagaaaaatttaacacaatgctaaagactttcttcatgtctttgtgtctccattcagcatggctgttaaatgaagaaacaggaagaatgtgacttctgtgcatatgggcagtgttttatcaactgataggcttcatgttaggcactcaatcaaagagctgccatttatgctaaaggcctgttgcctaaatgtcagggctttaccataccggtgccaagtttacatgaaaagctcaagttctcaaacaacttgtactttttcctcctttaacacataggagtgtatactataatttttaaattgtctttggccatttgacacctttgaatactttgctcgtgtttgaggaatttccacttaataagcccctgttttcccaagcttcctggcagtctgcctgtagagtgtgaagtaggctccatcagttagaggcatttgtgccagattttagatcagaagtgtgggacatgaaagggcagatgagctccccggagctcagaggtagtaggcattgaggtttcagtcataacatgcagtatcctggtatggtgcagggctgtcttctctagagcaattctgcatgggattttgggtgtggtcttggctgtgtgcttttctagcttggttctctggcactcactgaggttcggagagctacccagtaaactttaataaatttctttcctgcttagactagtcaaagttcatttcagttgtttgttagtcactctcctgacagttacatggagctagtttagctgctgtgcaatgtttgtgaggaggtgaattacatacgcagatattacatgtgcagaccaaaatggcctctccttttagccccacctcaccctcctgcccttatcatttagaacatctgcaggtttgttttctcattgttgacagcctattctccaaatatcctatgtagttactacctttgttatacctcattagtctttgctaattgatatggtttggatatttgtcccctccaaatctcacgttgaaatgtaatctccagtgttggtggtggggcctggtgggagatatttgggtcatggggtgggtccctcacgaatggcttggtgccctccctgtggtaatgagtgagttcttgctctgagttcatgcaagatctggttgttaaaggagcctggcatcttcttccaccctctcttgctcccccttgccatgtgatgcacctgctccccattcactttccaccatgactgtaagcttcttgaggccctcaccagaagcagatgctggcctcatgcttcctttatagtctacaggaccatgaaccaaaataaaacacttttctttataaattacccagtctcagatattcctttttaacaatgcaagaatggactaacacactaatgttttagaaatttgtttttctcttttgctgctgatcgctctctcattcactcttgtagtgggttgatattatttactttactataattttcaaggtatctcaggagggaaagatcagtttgttcagtttaccatttttttttgagacagcatctcactctgtcacccaggctagagtacaatggtgcaattttggctcactgtaatctctgcctttcaggctcaagcgattctcatgcctcagcctcttgagtagctgggattacaggcatacgccaccatgcatggctaatttttatatttttagtagagatggggtttttccaggctggtctcgaactcctggcctcaagtgatccgcctgccttggggttccagagtgctgggattacaagcatgagccaccgtgcctagtcccagtttaccatcttgaacctgaagtcccactggtattatcgtgctttgacatgtaaaaaaattaataaaatgttatttcttaaagtaaataaattttaattattttctacatttctagcatcacatgtggtagcttgcattttattgaatatctggttaatatttaaatgagtcaatttatgtagagcttttagattacaccgtaggtaagatgcctactctgactcaactttgttgactttatggtacccacatctgtgaatcatagcttatccttatgcattttttaggaattaatatgtgacaagttcacacagagtaatatcaggaattaaagtacttgaaattatgttttccaagtgacaaatatttatgccaggatgttggaaggttttttttttaattaaaaaataatttaagtctttaacagctacttgatgggaataacatgaccaatttatattccaagtgaataaataaaagttaacatacttaaaatgacaaggctactggaaatagatcaggctatatttattttgttaaatttttgatacttgaagaaatagtgtttttcagttgcatttaaattaaatgtttaaatgcttatttaagtgagagatagacagatgcttctctaacaaaaagtaaaagcaaaaattagtggcatttggagctcattgagttaactcatcaaagcaacattattgtcagaattgcttttcttactcataaactttcctacacactcagagattttttgagatcaatggagcaagttgtaaataattttatttctgctcaaacactgattgagactgttctgttttatatttaagtagaatttgataggtaaaaataacacaaataatcctttacaatagaaattaaacagtctgatcttcctttgaaagcccaaattatgcttattcagtagaatatagatttggattttttcttcatagtaataactgaagagtaagcatgattaatatgcttactgtgctgggcatattatgcaaattaaattactgcttgcatacccatacatcatggatgtatcatttagatcagactgtggatttgtctttgtatactttatacagatttcttcaaatatttgtatatttcaacataggcttttttttcttttcatttctttctaaattcctaagggctgtttttctttttaaacgtgagaataaatatctacattaattatttattatatactttaattgattcaacaactatttatgagtacttacgatgttccagagaatatattaaaatacttgtttttcagaagtctaatatggatgagaaacattgtgcctattctttttttttttttaaattgtactttaagttctgtgatacatgtgcagaatgtgcaggtttgttacataggtatacacatgccacggtggtttgctgcacccatcaacccgtcacctacattagatatttctcctggtgctatccctcccctagccagccaccccccgacaggccctggtgtgtgatgtttctctccctgtgtccatgtgttctcattgttcaactcccacttgtgagtgagaacatgcagtgtttggttttctgttcctgtgttagtttgctgagaatgatggtttccagcttcattcatgtccctgcaaaggatatgaactcatccttttttatggctgcatagtattccatggtgtatatgtgccacattttctttatccagtctatcattgatggccatttgggttggttccaagtctttgctgttgtgaatagtgctgcaataaacatgtgtgcatgtgtctttatagtagaatgatttataatcctttgggtatatacccagtaatgggattgctgggtcaaatggtatttctggttctagatccctgaagaattgtcatactgtcttccacaatggttgaactaatttacactcccaccaacagtgtaaaagcgttcctatttctccgcatcctctccagcatcttttgtttcctgaatttttaatgatcgccattctaactgacatcagatggtatctcattgttgttttgatttgcatttctcaaatgaccagtgatgatgagcttttttttcatatgtttgttggacacataaatgtcttcttctgagtagtgtctgttcatatcctttgcccaccttttgatggggttgtttgtttttttcttataaatttgtttaagttctttgtagattctggatattagccctttgtcagatggttagattgcaaaaattttctcctattccgtaggttgcctgttcactgtgatgatagtttcttttgctgtgcagaagctgagctgtttagtttaattatatcccatttgtcaattttggcttttgttgccattgcttttgatgttttagtcatgaagactttgctcatgcctatgccctgaatggtgttgcctaggttttcttctagggcttttatgggtttaggtcttacatttaagtctttaatccatcttgagttaatttttgtataagttgtaaagaaggggtccagtctcagttttctgcatatggctagccagctttcccaacaccatttattaaatagggaatcctttccccattgcttgtttttgtcaggattgtcaaagatcagatggttgtagatgtgtggcattatttctgaggcctcttttggttccattggcctatatatctgttttggtacagtaccatgctgtcttggttactgtagccttgtagtatagtttgaagtcagttagtgtgatgcctccagttttgttctttttgcttaggattgtcttggctgtgcaggctctcttttggttccatatgaaatttaaagtagtttttaaaattctttaaagaaagtcaatggtggcttgatggggatagcactgaatctataaattactttgggcagtatagctgttttcacaatattgattcttcctatccatgtgcatggaatgtttttccatttgtttgtgtcctctcttatttccttgagaagtggtttgtagttttccttgaagaggtcattaggtattttattctctttgtagcaattgtgaatgggagttcactcatgatttggtgctctgtttgcctattattggtgtataggaatgcttgtgattttcacacattgattttgtatcctgagactttgctgaagttgcttatcagcttaaggagattttgggctgagacgatggggttttctaaatacacaatcatgtcctctgcaaacagagacaatttgatttcctctcttcctatttgaatacccttaatttctttctcttgcctgatttccctggctagaacttccaatactatgttgaacaggagtggtgagagagggcattcttgtcttgtgccagttttcaaagggaatgcttccagcttttgcccattcagtatgatattggctatgggtcataaatagctcttattatttttagatatgttccatcaatacctagtttattgagcgtttttagcatgaagcagtgttgaatattatcgaaggccttttctgcatctattgagacaatcatgcggtttttttttgcatataaatataatagaatattattcagccttaaaacggggtgaaattttgatacgtggtacaacattgataaactttattttattttattttatttattattattattatactttaagttttagggtacatgtgcacaatgtgcaggttagttacatatgtatacatgtgccatgctggtgtgctgcacccattaactcgtcatttagcattaggtatatctcctaatgctatccctccccactccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatacacccagtaatgggatggcggggtcaaatggtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctacataaatgtcttcttttgagaagtgtctgttcatatcctttgcccactttttgatggggttgtctgtcttcttcttgtaaattagtttgagttcattgtagattctggatattagccctttgtcagatgagtagtttgtgaaaattttctcccattttgtaggttgcctgttcactctgatggtagtttctttggctgtgcagaagctctttagtttaatgagatctcatttgtcaattttggcttttgttgccattgcttttggtgttttagacatgaagtccttgcccatgcctatgtcctgagtggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcagtgttatttctgagggctctgttctattccattgatctatatctctgttttggtaccagtaccgtgctgttttggttactgtagccttgtagtatagtttgaagtcaggtagagtgatgcctccagctttgttcttttggcttaggattgacttggcgatgcgggctcttttttggttccatgtgaactttaaagtagttttttccaattctgtgaagaaagtcattggcagcttgatgcggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagctggattcctaagtattttattctctttgaagcaattttgaatgggagttcactcatgatttggctctctgtttgtctgttattggtgtataagaatgcttgcgatttttgtacattgattttgtatcctgagactttgccgaagttgcttatcagcttaaggagattttgggctgagacaatggggttttctagatatacaatcatgtcatctgcaaacagggacaatttgacttcctgttttcctagttgaataccctttatttccttctcctgcctaattgtcctggccagaacttccaacactatgttgaataggagtggtgagagagggcatccctgtcttgtgccagttttcaaagggaatgcttccagtttttgcccattcagtatgatattggctgtggatttgtcatagatagctcattattttgagatatgtcccatgaatacctaatttattgagagtttttagcatgaagggttgttgaattttgtcaaaggccttttctgcatctattgagataatcatgtggtttttgtctttggttctgtttatatgctggattacatttattgatttgtgtatattgaaccagccttgcatcccagggatgaagcccacttgatcatggcggataagctttttgatgtgctgctggattcggtttgccagtattttattgaggatttttgcagcaatgttcttcaaggatattggtctaaaattctcttttttggttgtgtctctgcctggctttggtatcaggatgatgctggcctcataaaatgagttagggaggattccctctttttctattgattggagttgtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctgatttagtcttgggagagtgtatgtgtcgaggaatttatccatttcttctagattttctagtttatttgcatagaggtgtttgtagtattctctgatggtagtttgtatttctgtgagatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttacatatttcttgccttctgctggcttttgaatgtgtttgctcttgcttttctagttcttttaattgtgatgttagggtgtcaattttggatctttcctgctttctcctgtgggcatttagtgctataaatttctctctacacactgctttgaatgtgtcccagagattctggtatgttgtgtctttgttctcgttggtttcaaagaacatctttatttctgccttcatttcgttatgtacccagtagtcattcaggagcaggttgttcagttaccatgtagttgagtgtctttgagagagtttctgaatcctcagttctagtttgactgcactgtggtctgagagacagtttgttataatttctgttcttttacatttgctgaggagagctttacttccaaccatgtggtcaattttggaataggtgtggtgtggtgctgaaaaaaatgtatattctgttgatttggggtggagagttctgtagatgtctattaggtctgcttggtgcagaggtgagttcaattcctgggtatccttgttaactttctctgtcgttgatctgtctaatgttgacagtggggtgttaaagtctcccattattattgtgtgggagtctaagtctctttgtaggtcactcaggacttgctttatgaatctgggtgctcctgtattgggtgcatatatatttaagatagttagctcttcttgttgaattgatccctttaccattatgtaatggccttctttgtctcttttgatctttgttggtttaaagtctgttttatcagagactaggattgcaaccccggtctttttttgttttccatttgcttggtagatcctcctccgtccttttattttgagcctatgtgtgtctctgcatgtgagatgggtttcctgaatacagcacactgatgggtcttgactctttatccaattttccagtctgtgtcttttaattggagcatttagtccatttacatttaaagttaatatcgttatgtgtgaatttggtcctgtcattatgatgttagctggttattttgttcattagttgatgcagtttcttcctagcctcgaaggtctttacaatttggcatgattttgcagtggctggtaccagttgttcctttccatgtttagtgcttccttcaggagctctttcagggcaggcctggtggtgacaaaatctctcagcatttgcttgtctgtaaagtattttatttctccttcacttatgaagcttagtttggctggatatgaaattctgggttgaaaattcttttctttaagaatgttgaatattggtccccactctcttctggcttgtagagtttctgccgtgagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccaagttggtcactttcaggtacaccaatcagacgcagatttggtcttttcacatagtcccatatttcttggaggctttgttcgtttctttttattcttttttctctaaacttcccttctcgcttcatttcattcatttcatcttccatcactgataccctttcttccagttgatcgcattggctcctgaggcttctgcattcttcacgtagttctcgagccttggctttcagctctatcagctcctttaagcacttctctgtattggttattctagttatacatttgtctaaatttttttcaaagttttcaacttctttgcctttggtttgaatttcctcctgtagctcggagtagtttgatcgtctgaagctttcttctctcacctcgtcaaagtcattctccatccagctttgttctgttgctggtgaggaactgcgttcctttggaggaggagaggcgctctgctttttagagtttccagtttttctgctctgttttttccccatctttgtggttttatctacttttggtctttgctgatggtgatgtacagattggtttttggtgtggatgtcctttctgtttgttagttttccttttaacagacaggaccctcagctgcaggtctgttggagtttgctagaggtccactccagaccctgtttgcctgggtatcagcagcagtgtctgcagaaccgcggattttcgtgaaccgcgaatgctgctgtctgatccttcctctggaagttttgtctcagaggagtacccggccgtgggaggtgtcggtctgcccctactggggggtgcctcccagttaggctgctcgggggtcaggggtcagggacccacttgaggaggcagtctgcccgttctcaggtctccagctgcgtgctgggagaaccactgctctcttcaacgctgtcagacaggaacatttaagtctgcagaggttactgctgtctttttgtttgtctgtgccctgcccccagaggtggagcctacagaggcaggcaggcctccttgagctgtggtgggctccacccagttcgagcttcctggctgttttgtttacctaagggagcctgggccatggcgggtgcccctgccccagcctcgctgccgccttgaagtttgatctcagactgctgtgctagcaatcagcgagactccgtgggcgtaggaccctccgaaccaagtgcgggctataattctcctggtgcgccctttcctaagcctgtcggaaaagctcagtattcaggtgggagtgacccgattttccaggtgccgtctgtcacctctttccttgaccgggaaagggaactccctgaccccttgcgcttcctgagtgaggcaatgccttgccctgctttggctcgcgcacagcgcgctgcacccactgtcctgcacccactgtctggcactccctagtgagatgaacccggtacctcagatggaaatgcagaaatcacccgtcttctgcgtggctcacactgggagctgtagaccagagctgttcctattcggccaccttggctcctccccccatcatgtggtttttgtcattggttctgtttatgtgatagattatgtttattgatttgtgtatgttgaagcagccttgcatcctagagatgaagccgacttcatcgtggtggatgagctttttgatgtgctgctggattctttttgccagtattttattgaggatctttgcaccaatgttcatcagggatattggcctgaaattttctttttttgttttgtctatgccaggttttagtatcaggatgatgcgggcctcataaacgagttatggaggaatccctcttttcctgttgtttagaataatttcagaaggaatggtaccagctcctctttgtacctctggtagaattcggctgtgaatctgtctggtcctgggccttttttggttggtaggctattaattactggctcaatttcagaccctgtttttggtctattcagggatttgacttcttcctagtcttgggaggtgtatgggtctaggaatttatccatttcttctagattttctagtttatttgcatagaggtgtttatagtattttctggtggtagtttgtatttctgtgggatcagtggtgatataccctttatcattttttattgtgtctatttgattcttctctcttttcttctttattagtctggctagtggtctattttgttgatcttttcaaaaatccagctcctggattcactgagtttttgaagggtttttcgtgtctctatctccttcagttctgccctgatcttagttatttcttgtcttctgctagcttttgaatttgtctgctcttgcttctctagttcttttaattgtgatgatagggtgtcaattttagatctttcctgctttctcttgtgggcatttagtgctataaatttccctctaaacaccgctttatatatgtcccagagattctggtacgttgtgtctttgttctcactggtttcaaagaacatctttatttctgcattaatttcattatttacccagtagtcattcaggagcaggttgttcagtttccatgcagttgtgcagttctgagtgagtttcttaatcctcagttataatttgattacactgtggtctgagagacagtttgttatgatttctgttcttttgcatttgctgaggagtgttttacttccaattatgtggtcaattttagaataagcgcgatgtggtgctgagaagaatgtatattctgttgatttggggtggagagttctgtagatgcctattaggtcttcttggtccagagctgagttcaagtcctgaatatgcttgttaattttctttcttgttgatctgtctaacattgacagtggggtgctaaagtttcccactattatcatgtggcagtttaagtctctttgtaggtcattaagaacttgctttatgagtctgggtgctcctgtattgggtgcatatatttaggatagttagctcttcttgttgcattgatccctttaccattatgtcatgctcttttttgtcttttttggtctttgttggtttaaagtctgttttatcggagactaggattgcaacccctgctttttcttttttgctttccatttgcttgataaatattcctccatccctttattttgagcctatgtgtctcacatgcaaaggcatgtgagactggtctcctgaatacagcacactgatgggtcgtgactgtttttccaatttggcagtctgtgtcttttaattggggcatttagcccatttacatttaaagttaatattgttatgtgtgaatttgatcctgtcattatgatgctagctggttgttttgcccattagttgatgcagtttcttcatagtgttgatggtctttactatttggtatgtttttacagtggctggtactggtttttcctttccatgtttagtgcttccttcaggagctcttttaaggcaggcctggtggtgacagaatctctcagcatttgcttgtctgtaaaggattttatttctccttcacttatgaagcttaatttggctggatatgaaatcctgggttgaaagttcttttctttaagaatgttgaatattggcccccactctcttctggcttgtagagtttctgcagacatatccactgttagtctgatgggcttccctttgtgggtaacttgacctttctctctggctgcccttgacgttttttccttcatttcaaccttggtgaatttgacgattatatgtcttcaggttgctcttctcgaggagtatctttgtggtgttctcgtatttcttgaatttgaatgttggcctgtcttactaggttggggaagttctcctggataatatcctgcagagtgttttccaacttggttctgttctccccatcactttcaggtacaccaatcaaacataggtttggtcttttcacatagtcccatatttcttggaggcttagttcatttctttgcattctttttttttaatcttgtcttcatgctttatttcattaagttgatcttcaatctctgacatcctttcttccgcttgttcaatttggctattgatacctgtgtatgctttacaaagttctcatgctgtgtttttcagctccatcaggtcatttatgttcttctatatactggtttttctagttcgcaattcctctaaccttttttcaacattcttagcttccttgcattgggttagaacatgcttctttagctcaaaggagtttgttattacccaccttctgaagcctacttctgtcaattcatcaaactcattctgttcccttcctggtgaggagttgtgatcctttaaatgagaagcggcattctggtttttggaattttaagcctctttgtgctcgtttttcctcatcttcatggatttatctaactttggtctttgatgttggtgacctttgaatggcgtttttctgtggaatcctttttgctgatgttgatgctattcctttctgtgtgttagttttccttctaccagtcaggcccttctgctgcaggtctgatggagtttgcttgaggttcactccagaccctgtttgcctgggtatcaccagcggaggctgcagaccagcaaagattcctgcctgttcctttctctggcagcttcgtcccagaggggtacccaccagatgccagctggagctctcctgtatgaggtgtctgttgacccctgctgggaggtgtctctcagtcaagaggcagggtggttaggaacccatttgaggaggcagcctgtcctttagtaaagctgaagcgctgtgctgggggatccactgctctcttcagagccatcaggcaggaatgtttaagtctgctgaagctgtgtccacagccacattcttcccccagggagaatgctgtgtcccagggagatgggagttttatctataagcccctgactggggctgctgcctttctttcagagatgccctgcccagagaggaggaatctagagaggcagtctggctacagaggctttgtgtgcagcagtgggctccacccagttcaaacttcccagagaccttgtttacactgtgaggggaaaactgcctattcaagcctcagtaatgacggacattccttcccccaccaagcttgagtgtcccaggtcgatttctgctgtgctggcagggagaatttcaagccagtggatcttagcttgctgggctccatgggggtggtatccgctgagctagaccatttgactccctggcttcagcctttccggggaagtgaacggttctgtctgtcttgctggcattccaggcactgctggggtatgaaaaaaaaaactcctgcaactagtttggtgtctgcccaaatggctgaccacttttgtgcttgaaacccagggccctggtggtgtaggcacccgagggaatctcctggtctgtgggttgggaaggccatgggaaaagcataatatctgggccagagtgcactgtccctcacggcacagtccttcatggcttcccttggctaggggagggagtttcttgatcccttgcacttcctggatgagccaacgccccatcctgcttcagctcaccctccgtgggcggcacccactgtctaaccagtaggaatgagatgagccgggtacctcagttggaaatgcagaaatcacctgcctcctgcgttgatctccctgggagctacagaccagagctgttcctattcagccatcttgccagccacccccgcctgttctttttttgtgttcttcttgctaaatttatttagcatgagaacagcaatagcatgttctcacataagaagctgactaacagaatgcacagcatataaaaaatgtgctatttgtatagaaataatttgtcaacttcagcaatcagtttgagacccacatatcacctggatgaatggttctcctgcagaatctgattcagaggaaagagtcatgtggtgcggtgacttgaaagagctgtggtgaataattgaattctaagaatggccacagtagactccctgttaatatttctgaaaagtagggttatggagcacatattattaaactgttatttttaatagacatcttatacttgtatctggtctgtaagaccagtcatattagtgtacatttttcaattagtttactttggaagtgggcacaggggtctacactgctcaaatctgtaattataattaccttatgataatttattatggcaataatgggaatttgcttatttttctttgaaaaatgttttcaagctatacttgtttctgccatgatagagaacttttgcaacattcatttttgttgtgagagtagagccacaatgattttctaatgagaattgattaagccctttccttaccctagcccagttctaagtattgtcagtggtgattgggatagagggtagtctgtttggcatgtttccatgtcatgtgaggatgtcaaccctccgtctttttgaatgactgctaaggcacattactccttttaactgtcaacagagaatgactactactgtggtctgaatgtttgtgccaccacagaattcatatgttgaaacctaattaccaatgcaatagcattaagaggtggggcctttaggaggttattaggtcatgagggtggagccctcatgaatgggattagtgcccttataaaagaggctgcagcggagcttgttcaccccttctgccatgtgaagacatggcaagaaggcaccatctatgagaagtagtccttcaccagagattgaatctgctggcatgttgatcttggactttccagcctccagaattgtgagcaatacatttcctttctttataagccactgagttcgtggtattttgttatagcagcccaaatgaatgaagaaaactgcattccaggggaatgttaggcagtattatctcacctcttcatagtgtgatgtctgtgactggctcagttcatgcagctctacttgtggaatgtgcattacatttatttatctatatcaggaattcttaatcctggagaaatttcaagggattgttaaccccttgaaattatagccctaattttagttgtatgtgcttcctcatggcgttgatacacttctttcaccaaattctcagtcaggtccatgttccaaaaaatggttaagaatcaccattttgaaatccttcttgctattatgccagattctcaaacagctgtatctggatgataggagaatgcctctttgaaggttgcttttgtgcatgttggcatgggggaggtgctaaaatttcagatgggatggccagggcaggctcctttagaaggtgagttgagtggtggggagagcagtggatgacgagtgggatctgggaccttgtagtcctgttcaggacttggacttttactacaagtgacaggagagggctgtagtgctttgagaaagagagacatgatctggtcaatgtgttaataagatcactgtgactactgtgttagagagacatgatctgatctgtgttaagaagatcactttaactgctatgttgataactgactgaactggggagcaaggacagaagtagagagcctcttctgatagttccgggaagaaataattgtggcatagaacagggtattggtagtggagagggtgacaaattattaaattttgaaattgctttgaaactctggtattattaggatgttcatgaggatgttagctgttattttataaaattaatcaataattttcttagtgttaggattatttgtactcttctcctaaactgttcatttcattttaactactcagaatttataattgaacaatacaaccataagaaaagttagaacaaattaatggttcatccttaggaagtgtcttcatattaatggtgtttggtgtattaggcttattttggtcatcctatctttaattttccctttgcttcattcttttttcaccaatttaaaaaatttctgtcactttttctgtcttttatttagacagagtctcactttgtcatccaggctggagtgcagtggtgtgatctcagctcactgcaaccttcacctcccgggttcaagtgattctcttgcttcagcctcccaagtagctgggattacaggaacacgccaccacacccagctactttttgtatttttagtagagacagtgtttcactatgttggccaggctggtcttgaactcccgacctcaagtgatccacccgccttggcctcccaaagtgctgggattgcaggtttgagccactgcacccagcctctttttctgtattatttgtgttttaaaaaacttctttatattcctttttgtacagtttagggtgcatgtttctctcattgaatctatgtcagataccacctttcactgtctcttcaaggttgtgtctatgtcctttttacacttgtgattgtttctctgttatttaagaatgaaacctgattccacgaatccaaaccatcagaatagtttgtgttttgcatggaacattaaataaagaagtggttgttttatgtaaggaaaactgctgatctatttgatcacttaactgaggagaccaggtgagttaaaaacaagccaaatcatttgttgaactgaattactatagtcactagtaagtttcatcaaagcaatccagtgatatgttgtatctgtgacacatcttgactataaaacttgcccttgagtttattttatgagaacatcttatatcaagaacaggtagcataaaaagcagggaggaatttgtactcatttaatataattaaatcatgagggttccaaacagtgtactgatttctagaaatcctaaagaaccattgtgatatcagtgtataaagaacaaaaattctgatgacaaacttgtagtgtgaaaaacaaatttactggactacccactgtttatactcatttattttcttcctgatagtaagttgtaaaataaacaaacacttttttccatttacttatcatgtggtgccaattctcacttatcatatggtgccaattctcagatatgagtcatgagacatgtttcttaatgtttttttttttttttgaatcagaagtttttttttttgttttttttttgtttttttttttttttatactttaagttttagggtacatgtgcacattgtgcaggttagttacatatgtatacatgtgccatgctggtgcgctgcacccactaacttgtcatctagcattaggtatatctcccaatgctatccctcccccctccccccaccccacaacagtccccagagtgtgatattccccttcctgtgtccatgtgatctcattgttcagttcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattatggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtgtaaggtgtaaggaagggatccagtttcagcttcctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtaccagtaccatgctgttttggttactgtagccttgtagtacagtttgaagtcaggtagtgtaatgcctccagctttgttcttttggcttaggattgacttggtgatgcgggctcttttttggttccatatgaacttgaaagtagttttttccaattctgtgaagaaagtcattggtagcttgatggggatggcattgaatctgtaaatgaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatagaatcatgtcatctgcaaacagggacaatttgacttcctcttttcctaattggataccctttatttccttctcttgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagggttgttgaattttgtcaaaggctttttctgcatctattgagataatcatgtggtttttgtctttggctctgtttatatgctggattacatttattgatttgtgtatattgaaccagccttgcatcacagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcctccttgtacctctggtagaattcagctgtgaatccatctggtcctggactctttttggttggtaaactatcgattattgccacaatttcagctcctgttactggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcctttcaaaaaaccagctcctggattcattgattttttgaagggttttttgtgtctctatttccttcagttctgctctgattttacatatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttgggttggagagttctgtagatgtctattaggtccgcttggtgcagagctgagttcaattcctgggtatccttgttgactttctatctcgttgatctgtctaatgttgacagtggggtgttaaagtctcccattattaatgcgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttcattggagcatttagtccatttacatttaaagttaatattgttatgtgtgcatttgatcctgtcattatgatgttagctggtgattttgctcgttagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctgtaaaggattttatttctccttcacctatgaagcttagtttggctggatatgaaattctgggttgaaaattcttttctttaagaatgttgaatattggcccccactctcttctggcttgtagggtttctgatgagagatccgctgttagtctgatgggcttccctttgagggtaacccgacctttctctctggctgcctttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagttttttccaacttggttccattctccccatcactttcaggtacaccaatcagacgtagatttggtcttttcacatagtcccatatttcttggaggctttgctcatttctttttattcgtttttctctaaacttcccttctcgcttcatttcattcatttcatcttccatcgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagagacgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccgtgtgaggtgtcagggtgctcctgctggggggtgcctcccagttaggctgctcgggggtcaggggtcaggaacccacttgaggaggcagtctgccggttctcagatctccagctgcgtgctgggagagccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttggagcttcccgctgctttgtttacctgatcaagcctgggcaatggtgggcgcccctcccccagcctcgctgccgccttgcagtttgatctcagactgctgtgctagcaatcagcgagattccgtgggcgtaggaccctccgagccaggtgtgggatataatctcgtggtgcgccgttttttaagtcagtcagaaaagcgcagtattcgggtgggagtgacccgattttccaggtgcgtccgtcacccctttctttgactcggaaagggaactccctgaccccttgcgcttcccaggtgaggcaatgcctcgccctgcttcggctcgcacacggtgcgtgcacccactggcctgcgcccactgtctggcactccctagtgagatgaacccggtacctcagatggaaatgcagaaatcacccgtcttctgcgttgctcatgctgggagctgtagaccggagctgttcctattcggccatcttggctcctccgtgaatccgtttcttaatgttttacactattctttgtggtaaagtgtggtttccattttaaattacatctctcagaataataggcagctctgaaaggggttgtagagaccatctaacagtctgatttgtagatgaggaacctgaggtctagagtgttgaaaacccaagtcccacagctgattaccggaagagcttagcctggcacccaacactcctgatgcctaattcaggtaggttttcatccaaagtccaagccacatatattaaaattatactactatttggatttatgacatagtagtacaaataatcatatttgtgatactccaacttgagtagaactcataggaaatcttgtctctgaagtcggacttcatgtgggtatattaagccaccagacttttaattattctaactctccaatattacctcatctgcaaataaacaataggtttccaaaggtctactggtaaaatttctcctctttattggaaataaataggcagttgttacctatgcaataattatttggccttacaatatcatagtaaagataaagactttagaaaacagggaaattttaagacctgagcatgaaagaaattgaagacggtgatattaatgatgttaaattagctgttacatattttatcaacattgtgagcacttgcatttagttaaaatttcagtcttatcccgtgatacctgtcctggtttgttatggcataaaggaacattcagtttaaattttttcgacttgtatttttaatgatgtaagataggatgcgtacaggaataaatctgtagcctaattttacgtgagatatttctcagatattgatctagagtatcacatgtaaatttagagacttatctataatccctttccttttatgttttccacagacaacttatatatatgtgtttttgtttttgtgtgtgttctgattttagatttaccttttccaggtgtacttctctgaagtaagatgatttgtcaaaaattctgtgtggttttgttacattggggtaagttatttgctcatttgctgttttaatgcccttaaacatggtagagattttgcctttagagatgctgttttatttattagctaacagaatttcctatttctagttaggaattctcatacatgcttatgattaaaaatgcaaaccatagtataggtgtatcagtgtgaaaacgaaaacccttcccaacctcctaaagacaacctgatggtgtatccttccagaatcctctctctctctcacacacacacacacacagactcacacacacagactcacacacacacatacacagacacactcatatctatagctgcaaaaatagcactggtctgtacatgttgttctggatgtttatttttccatttaacaggtttccaatttatcatgatggctttttacctttatcagtatttaccgggatacttattagtttaatggttgcatgacaatgcactgtatgaatatatataaaattattagtctatttgaccaattcctgattgatagacatttctttttctgtaacaaataatactgcattgaaacttcatgtgtctttgtatatttggaaaaatatttctgtagattaattcttttttttttttttttttttgagacgcagtcttgctctgccgccagactggagtgcagtggcatgatctcagcccactgcaacctctgcctcctggattcaagcaattctcctgcctcagcctctcgagtagctgggactacaggcacgcgccaccatgcccagataatttttgtatttttagtagagacggggtttcactgcgttggccagatggtctcaatctcttgacctcgtgatctgcccgcctcggcctcccaaagtgctgggattacaggcgtgagccaccgtgcccagccgatacattgccaataacttttgagcatactgttctcacgtgtttcttaccacattctggtgacattctgatttccttaaaccaaatcatctaagttagattgtgttccaagtttttgaaattaaagttagagtatctttaacaaaacttatgtgatttggcaattgtttatctagctttctttaacaaaacttatgttgtggcaactttatctggcagctgttacctgtgtgtcaactgattctgagcatctccttggctaccccaatctaaaggggctcttctaagcttccctataggtcttccttgtggtacatacttctctttcattgcagccatctgtatatttccagaaaataacctagatagctccaccattacagatttccaaaaaattatgccacaagggactatcaaagagaaataactcattctctttttatattctctaattttattagatatatttaagggaactgttcattctcttttataattctctattaattttcgttagactctagtgttttacattgactttctggaaggtttctggtttgatcaagtttttgaatcaaaagaattcctgggatattgttacctgataagatatgccttcagatgaaaattctagaccatctttagagtttaggattcatttggagggaaagaaatatcatttgcaaagttgcatgtggataaaatagactcatcttttaatttaactgcatcaatagttgctatgtttttaaagttcatcattacattttacatttaaatacttctgtgaggattttaggctaattcatttcaagcaactgaatcctctatgtagacctagaatatataatgctgtaaattagtaatattacatattcttggttttgtaaacctcctccctcaaaaaactattctgttttctttgaggtgttctgattttagaaacatgttagaaggagtgaagtccaaaggaacataattgtaatatggatttacttttggtaatgttgtgatacctaattgttatcagtatggccatagtcacatttgtcacattaatcactttggcctcaatttttgcatctatacctatttatattaatttatatctatagaaatctttagaaaccaaactattaacagtcattacctatgtattgtttgaatattttcactgataattgcttttgtaatgaaaaaatacatttgtgaattgattaaaaattttattttcttacatttttaaaaagcctttattttttagagcagttttaggttcacagcaaaattgagaggaaggtacagagattttccgtagactccctgccccacacatttataaccccccattatcaactatcccccctcagagtggtacatttgtcacaattgatgaacccatactgacatatcattgtcactcaaagtccatagtttacattatggttcactcttggtgttgtatattgtatgaatgttgactgatgtatgtatagtgacctttatctgcagctttagaaacatacagaagaatttcactgccctacccatcctttgtggccttcctattcctccctccttcttacctaactcctgggaactgccgatctttttactgtttccatagttgtgcgttttatagaatgtcataatgtcatatagttggaataacatagtatatagtcttttcatactggtttctttcccttagtaatatgcatttatgtttcctccatgtcttttttttcctctttaaatttttatttttttagattcagaggttacaagtatggttttgttacatggatatgttgcgtagtatgtacatcacctgaatagtgaactttgtgtacaatactacttataagtgagaacatgtggtattggattttctgtttctgagttatttcacttagaataatggcctttagctccatccacgttgttgcaaagtacatgcttttattcttttttatggctgcatagtattccatggtgtgtgagtgtgtgtgtgtgtgtgtgtgtgtgcatgtgcatgtgtgtgaatatgccactttttttaatgcagtcattcattgagggacacttaggttgattccatgactttgctattgtgaatagtgctgtgacaaacatatgaccgcaggtgtctttttgttacaatgatttcttttcctttgagtagatacttagtagtgggattgctggattgaatgatagttctacttttagttctttgagaaatctacacattgttttccatagaggttgtacaaatttacattgccaccaacagtgaataagcatttccttttctctgcatcctcaccaacatctattattttttgactttttaataatggccattcttactggtataagatggtatctcattgtagttttaatttgcatttttctaatgattagtgatattgggcatttttttcatgttcattggctgcttgtatgtcttcttttgagaaatgtcttcatttcttttgccttctttttaatgggattatttgtttttttcttgttgagttgtttgagttccttctaaattctggatattagtcctttgttggatgcatagttctggaagagtgctggaacctctgtatcttttcgtgacttgatgtctcatttctttttagccctgaataatatttaattgtctggatgtaccacaatttacccattcacctactgatgaacatcatgtttacttctatttccttacattattacatttgccaaactcttcaaaattctcatttcatacaaatccatacaagattctcagaattcgtattctgcattagtgtctatataagccaacacaattgttgcatcatttgggtaacttactgaaaaaacaattatggagaattattttattttcaaacaaatatttaaaaataagtttggctgggtgcagtggctcatgcctgtaatcccagcactttgggagaccaaggtgggcggatcacctgaggtcaggagttcgagaccagcctggccaacatggcaaaaccccgtctctactaaaagtacaaaaattaaccgggtgtggtgggaggtgcctgtaatcccagctactcaggaggctgaggcaggagaattgcttgaacccgggaagcagaggttgcagtgagtcgagatcatgccactgcactccagcctgagcaacaagagcgaaattccatcttaaaaaaaaaaaaaaaaaaaaaaaaaaaagacaaggtttaacttttgcagatcttttggtacaggattatataattgttcttaatttttatatttaaacagtgataatttaatcagcagtgggcatttcccataagaagtctattcttttgcatcattttttgtgtaatgtgctaagggcatgtcttatatgatgatgttttgtatttggaggatcatgggaaaattcaggagatcatcaagccatcatcatgttgaagacaaattctttctaaaagtgctcagcgaaagcagtgttaatattttggtgttactctcttaaatacatattaaaatagcactttaatgtttgtttatataattgcacatccagatatttatttatcatttatactggatattatatttatcatttataatggaagctagaataatatgctttagaaaggaaaaataaaatattcagtgtttgtttccttttattaaaacataaatataaaatgtcagcttaaagagaaaacatgaagtgtgagtcttcaaaaagaaaagagatgtcagaaagtggagtaatttctacaaatgaatgcatcctcttgaatgtaacacattgtacaatggaagcacaaagttattcattagacactcactgaggacttagaaagttaaataattattgagcactacatggtttaatctcagatactttctattcatgtcttagtcaaaatgattacttttttctatgtgtctttttaatatcctaacagaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaataggtaagcattagctatgttttaaatgtattgaacaatgttttttaattctttgatacctgtatgaaatagatgtcttatggctatgattttaacatacataatcatttttatatggataataaaattaggattcattatgtgaacaaactaataaataatttccaaattatcttgtatcccataaaaatataatgagggaattattttacttttaagtacattccttgtagtcttctaaatttgctttgaaatagaaaaacacaccttatttttgttaaatgtataaaatatcaaatgactgataatattgttgaattggttaaattttaaaatattcatgaataataataattcttcaggcaaggaatatctctgaaagaatatacgttttaaagatgggtttttcagaaagaatagctaatggatgctgggcttaacacctaggtgatgtgatgatctgtgtaacaaactgctatggtacatgtttacctatttaactaacctgcacatcctgcacatgtacccctgaactaaaaataaaagttggaaaaacaaaaaaagaaaagaaaaaaattctttttttttgtttaagtataatgcatactgattgtagctagtgtagttaaaaattctgcatctggaaatataaacaacaaaattatcccaagtcttttggaaaagctaggaagagtggagtcaattgactcatccatgtagagagacctccagtatgaaaatacaggcatatcttttcctcccttaaaagcgtgatgattgggttttcacatgtatgagtgagatgtgcctccctcagaccttgttatgatgttggcacattacctgtctaatgttaaaaaaaaaaaaaaaaggctgggcacagtggcttaactgcctgcaatcctagcatttaggaggcctaggcgggcggatcacttgagctcaggagttagagaccagcctgggcaacataatgaaaccccatctctaccaaaaaaaaaaaaaaaaaaaaaaaaaaaaattaactgggcatggtggtgcatgcctctagtcccatctacttaggagactgaggtgggaagattgcttgagagatggaggctgcagtgagccatgatcacatgatcatgccactgcactccagcctgggtgacagagtgacaccccatctcaaaaaaaaaaaaaaaaaaggaaagaaaaagaaaagtgagaactgagctaggtgagttttgagctcttttgtcctatttaagtggtttgaaattaaagaaaatttgagaagcaataattgaatttaattctattactttagaaaaaaggaaactgagggccagagggactaagtgatgggcaaacgcatgccactagttaaagcttgttctttttctctcagaataggcaatggaagttgtatcagaacactggtaaatttgatttagctcttctctttcactgagttgttcagatggtttttgagatttcatgtagttgtttttttttttttttttttttttttttaaattcagatgcaaactggaacatacagtgctggctaaaaggagacttaaaattattcatctgttatgtggagtcattatttaagaatctattcaggaattataactataaggtccatcttttatatgttctgtaagtaccaaataattaatttggcatttctaatacacagtttttttaaaagagctttcatatacggaagtagattataaacctcttgcatccctacatttcctattatatgttttattttttaatatagcattctgctctgttaggtttcctcttttctcctcctgctaattgaggtagcaagacagtcaggtttagggtcacgattgtcaggtccatgagtataccaaatgttcagttcaagttcaggttctagctcacactgaggtccgaagggagtgggtggatgggcaatagctgaacgaacactctgggggccttaaacaggtgaaacgtagttttattcagcagctctctatcagcagcttactcaaactaggtctctcattagcagctctcttagcagcagctttctctcactgtctgctctgttttgactgcttgggccagctgctcctatgcacagctgcacggctggctctctcttgccttcagggtcagcagcttaactctttctctctctgggcatgaacatgaaccatgctgtgccatgttgtgccatgctgagccatgccctggctcccctcgtcagagcaagactgacagctctggtactctctctctgggtacaagagcgcctgtacaagaacatctgtagagtgtcagcagggcaattataccttttacagacaacagtggcatatggccaagggatggccttcccatgttatggctacatggctgtgataacagatggagttatatgcctgcgcactactcgctgagtcatgcaggcctggacatctgccttggcctgattcttgaccgaagcacatccatgtaccttacaaagatattgcaggtataggtgggcatgtagtctgaaagaagagtgaactcagttcaggagtgctagatatttgagtggaaaaggaaaaaaggtgcgttttatatttctttttcagatgatttttcgtattcgatctctttataaacttaaaaatatgggtggctaatatttgtgctagaaagagaacaaagatattgttttcaaatagccatatacttataactcaaacagcgaatatgtcattaagttttctaattactctagtgatgatatacaccatttttatgtcaattttaactctttaaaattctttctcattaattcttctatttgatgcttaaagtctcgcttccttcagttctgcagttattgagataataccgttgaggagcaatgtgctagaaactgtccctatacaaatgaatagagacagaaagtaaagcggggctgagaggagggggaattggggagttactgtttaatggatataaagtttcaatttgggaaaatgaaaaatgttctggagttggggagtggtgatggttgcataataacgtgaatgtatttcatgtcattgcactgtacacttaaaatggttgaaatgttaaattttatatacattttattacagtaaaaatttaaaaagaaacttaaagacatgtaaaaaaggatgaatggttacgatcactgtcctttaggtgctcaaaggctagcagttgggacctgtatgtacagagtttcagtttaagtggttaccgatatgtatttggtaggtacataatgtcatgggagcccatcattgttgtgagatcttagatgggggttatctagttaagctggtgagagaagagaggaggaaaggtttcctaaggaagtagatagctgagttgagtcattagagataaataagagctaatgagaaaatatgtgggcagtatagtgttgggaagagatcagtatcacctggaaccttgttagaaatttaaatttgcatgctaaatgacgagttaatggttgcagcacaccaacatggcacatgtatacatatgtaacaaacctgcacgttgtgcacatgtaccctaaaacttaaagtataataataataaaaaaaatttaaatttgctagctcacccctgtgaataaaaaattagggggggtggagctcattaatatatgttttgccaagtcctttgggtgattctgatggaactcaagtttgaaaattcctgctgtagaggttaatatgacagattttagagtcagactacctggctgtaccacttactaaatgcactcacaaagcacttgctatgtttaacagttgttctacctctagaaattaacacaatggaaatatttacacaatgtttaaaaattatttgttgaatgaatacatattgccaaaatgctttctaaaatattttccaatttaccctccagaaatgtcttaatgagccaaaaagttaataaaaaaataatattgtctgaaggtgtgagtagtgagtagtcaacggtcagatatagcaggaagatataataaggtctgaatgatatgtacggatttggcagtgtgaaagtaatgggtctttaggcagagctcattcgggggagcggaaggagaggttgccagaacaaagggaaacttgaagaaaggacccggaagagctgatctttatgctagttcctcattcagttgatggggggacactgcagagctggaattcatatatccaaggcatactatggctggtgctgagaatatgaaaaaaacctggttactgggaccaactgctgctgcccaggtgaggaacctttggctggagtgatatttcaagaatggtaggcaaaacaggaaggatcaactcccttgtcactccattattctagtctctttctagctcccccacaggtagaatttaacaagaatttaggtagcagaggagaactatggtttgcagagttccagccccagcatggtgaaacagagcatagggtgcatttgaagatggcagtcaatagcttaaccaccagcaaaattcacttcattggctcattggctacttagaacattcacacacacctttctacgcatacctacctttccctacaacttccttataacttcatgctttcacttaattaagtgcaactatactttaaaaaaaaaatcaaaaagatcctttatttcatgtgtatgtagtatcataattcatcaaaataatttataatagttaactgcccctcaaatattgttttataaatgatgccttctgaagttaaacataatgtagattcattttttaaaaattgtctgtttagaacatactaaacaaatgataagttaaaaaaaaatataattctctcctgtgaagtcttctaagaaaatcatggcaagttcctgataagataaaaaccattccatcattaaaggggattaaaaagaggcataaataaatttgaataggaacatctgtttgctgagttttgtcattgtgtacaaatgaaactctagagttaaaattatattctgatttccttctataagcaagaaattccttaatagaagctcagaaatgacctcagtgccttggtgaaacatacttcttcatctgcggacactcagtgctcccatctctatcagatctgctgtgttacctctgttaacattcccaggcatctccaggaagacgggagatgtcatcctctccaagatggctctaccaaaccaaggctttcctggcaccaacaacgttctttctaaagccctacacttcacagaggaggcaaagcccgacgaagcaccatttctgccacggtgtccaccttaagcttccaactgccactgttgtgaggaggagccatcacagattgccatagccacagagtcttcctgaccctgtggagccactgctctcaggcactgtccagctgacgtctggtgtagccaattattttccccaaaggtccatgtctgcctgacccatggcactccacgagttgtggtgggtctgatgagctagtttctgtcatacctagacaaagaagatggtttaaaaccaattcatgctcttcattataaatccagatctgatttgggtccccatgctcacaagtcttaagcactagtaggcctcctttccaacttgggcagccctgagccaccagacatttgttggtctggaggtgatagagccttccaagttgaaggactttggggcattttggccctctactgataaaagtgggttgctgggatttgtcatgggtcccagatatctgcatctttgggtaaatattacccaaataccattcaaatgatttgcatcctaacttctttctcaattcaacatgctcactgatggttccaaagcttttcctctccagattaagtcttaaggaaaaatactgcgcctttattcatccagccagacatgtgccagctgcaaaaagttgtgttcatggcatcccggccttcaggagatccatatggtcccctttttttggaaaatgtgtcctactgtagagcaaggcatgatgaagaacttacctccacacacccagatctgaaatgttatttccaagttttctcctctccagatatccatgccagtatcatactgtccaagttcctggaaatactgtctgttcctggcaaacaatcctccagccattatcggtgactttgttggtgctgtggctttttctgctcatcctagctcagaaaggggaacaagctcctatttgaagtgcagccctcagttgaatcctccacggacaacagaggatgagctgtaggctagcgtgttggcactaatgatatcaatcactgagaacatcatggtctgctagtccacacagatgacagccagcaagggctgctgccacatcacattcacttcaattggctgtctaggaacacaaggacttctgttgtgtggactgctacactcattcttccttgaatcaatccctcacactttatgtttcttataccttaatttttccaaggaggtatttttggacatattcatctcgtcctcctttcaagtcatcaaggtcgctaacaacatccataaagatgatttcatgaagcaggtttgctggcatgcaatttgtgacaatgtgcagcatctggagacagggcagaaaaagcttcattgtggaaacagataacaattatgtaagcaactggcaggtcaggaggtaggactttacatgctgtattctttgtccctggcacatctctgtggtagcctgcagttactgataagcatattaaaagcacatttctgatagcccgtctctcaactcctgagcacgttaattaaaaatcatgcctagttcagaagacaatttcaagtggcctttttctggatcttcaatatgaccatcacatcatcaattttgtttgcttcgaactgtggctctagtaatagacttggaccttgagtgaatcaggaatagaattgttttggaaatggtccatggggtccaggccccttgagcacattctttttttttttaatatagtttaagttctgggatacacgtgcagaaagtgcaggtttgttacataggtatgcgtgtgccatggtggtttgctgcacccatcaacccgtcatctacattaggtatttctcctaatgctatccctcctctagcctcccacccccctacaggccccagtgtgtgatgttcccctccctgtgtccatgtgttctcattgttcaactcccacttatgagtgagaacgtagtgtttgtttttcggttcctgtgttagtctgctgagaatgatggttttcagctttatccatgtccttgcaaaggacatgaacttatccttttttatggctgcatagtattccatgatgtgtatgtgccacattttccttatccagtccatcactgaggggtatgtgggttggttccaagtctttgctattatgaatagtggatgagcacattcttaagtggctgagtcacttcaccgaagttgaaatgaacaaaaaccaaaactgcacaggtcacagatgtaaaaatgtacccataacagaaatattgaactgtgacacttcccataatagacttagcataactaatgggccattttcaatttctgcagcactggcagtggccttccaggactcaggctgtggcatctttcctcctgccacagcccctgtctgagccacaggagctgcccagggggtgaggagtggtgggctacactttgaacaaaaggagacagtcttattctctctcccaaatgggatgatgctatgtcacagttgtcattatgttttctgtgcaacatgtacagtattgctctctgggcagtattaattgctcctcacattcaatcactgtttcacctgaatgaatattgtggaagctaaatataaaattgtaaatttaataattccaggaatccttatataaaataatagggggaaggaaaagattgagaagaaattagttaatatatagaaacacacacacacacaagcatactgtaagggaggaaatatgcacagctgccactgctcttctttctgtattgattaccaggctgtagttaatatttattactagtgttagaccactggactaattctttaagtcacccagaggaggaacccagatatagtgccactgccatcatatctggacattgaatgtccctgtggtcatcatttccacatggaggtcacctgatgccacgactgatgaacctacaagcccctgcatctttgtgcaatcgtcatgagggctagtgtctcagatgtagttatctagttggtgagaaggtgctctagctgccagtgtttcagccttgtatgatggtagattcttcagtcagatattgggcaaccagcaagtagacaaatgtccttaacaaaagtgactgagttataaatctctagaggcctgagaagcctggctggggttggaaagtggaggtggaagactaatggataatgaatgtcccagggtggataattaaaggatgaaatcatgagtttgtttctagtctatagaaagtgacccagcagggagagaaaagttgataatcgaaggggagccattgaagatattttattgagagtgaataatggaataggccaattccatgaaaagagcacagggttggtcttaaagaaggtttacctcaacttctgagtattgagagaagaaaggaagccctatggtggatgaagatatatttgaagctcagggcagtttcctgctttattgagcaaaataggctttagctcagagaaaagtattcctttgcatagtagtaccttcttgcaatgacctaaatgctttggatgtgattaaaaattctcacttgggtgcctactctagacaatttctgatcttatcagcaggttaaggcaaaatgctcagttttaaagccccgtgaatatgtgtaaggtcttaaattctattatgtatatattataattatgatgaggtatttttctgaaaaagataagtatatgtgtaatatatagatatatataatttcagagcattataaatttgaatagttacttagttatagctgagaattttagcttcagtttagtcagccaaacagtcattggtctattcttctaaacaataggacccagaagaatgagaaaattaggtaaattaggtagattttcaaactttcttacaagatgatttttaatttggtcttcttttacttggaacctaggtttctaaaaatattagcacagtaaaacctgtcataatttcaaggaatttgagaaacagtctcccatttttttcctgccacattatatacctctatgatttggttaatatgttcattgcaccaactatcacatgctgtttctgcctttaattgtatttttgtttggctcttaaggcaatgtatctccaaacaattaaataggactctaattcaatgggtagagctggtcaatataggaagagctggtcaatataaccaatgagaactccatggaagagaaaatccataatggtgattactatagaaaagctttgaatcagactcacctattttggacatcagagaattcacaagagaaattttcaaatgcttccatgtgtaaaaaagtatattttaaaagggataaaatctaatgtttgtaagggatttaaaaccatataaatatgtcccttaagggaaagctttgtttgggctcagatattaatgtttgtcagagagtctgaaggacagatactctagaaatgtaatattttgaaactgctctgagattttctcttagatctaggaaggaaattctctttctttattaggtgcctactgtgtgttccaggcacggagctgagcatggggaacaaggttctacaacacagactcagcccttgccctcctggagctaacattctgtggtaaaaacagaagacataacagcaaagtttggaaaggctgtgctgtaataaatacagtgccttgtggaaacaagtactagggatatccagcccaggtgaagagggggcagaggagaatgagccagagagtgaagaacatttgcaaaggcccagaggcacagataccacatggcaggacttgaaaagttgagtgtggtgggactgggaagctggggaatgaagagaaatcaggatggagggatacacaagggtcagattatgaagggccctccaggtcatgcttggagtttgggcttctataactactaacacctactttactttgttttcacaattactcctgccagcattcttgatgatttcagcatccatgtgattaatcttcagtttcttgaatgcttattttcaatattcttgtattttcacaccactttgttcaccccttgtcatggacatgctcgagactttgtcatcaccaataagcatgctttttctataatctccatgtcaagaatcctgctctttgaccatctccccttgcacccttcatgttagtttattccctctactactcaacttcaggaataattctccatggttcttggctcccccttctgggtgccaggttctggcctgagtaaccctctcttcttcatgaaaagcagcccatatgcgcatctaagttgttttcacagcctgctttcctaccagcacaatttttaatggttgaaaggctttttttttttttccattttgttctgtctctgtctctttctgtctctatattagcactatttctgctaatacacttctctcacaaaactacctggacctccagtggatctctctggtgttcactccattagatatgataaaagcctgcaaatctcctagagatcttttctctgtcttctctttgatctttgctcagaaggcatttcttaattttaacagtgtttgctatctggagaggctagacacttcaagactatgaagtcctctttccttttgtttaagggccctttcttcaatgtatatctctcctcttacagcaagaagaaaccaagagacatccgcaacacttgctggaaatctccttaaatatatcattcagttcaataggcacattctatactttccacataactacagatggtaatgttaatgagctctctgctactacacaagaaggaccactgttctccagtttccaataaattatctctcacttccttttgtgccctcactggcagagtctttgaagtccgccagatttctactaacagcctgttcgaggcaatttaggttttcttcaccatgcttctccaaatccttctagcctctgtctgtccgctggttccaaagccactcacacattttcaggttttcattatggcagcaccccactttcaagttccagtatctgcattagtgatctaatgtcatataataaattaacccaaaacttagtggcttaaaacagtaatcatttattatctcacaatttctgtttttaaggaattcagctgcagcttagtgtggggtggaatgggaaaggagtatctgcttcagggtctcttacaaatactgcactgaaggtgtcagccaccaggactgcagtcatttcaaggttcaacttcaggaggagctagttttgagataaattcttggggttccaagttcttcatgggatgttggactgagggcctcagttcctccctggctatcggctggagacctccttcagttccttgttatgtggatctccccataggacagcctgcaccattgcagctggctttcctgagagtgagccagagagactcactgatgatcttgctttttattttcactgagacaacagaagcaggtggagtttctctaatgattgcttttctcacccaaatctaccaggctgcctgtatcagtgcccatgcacttttcctctcttcttttattgtgaataaattctttgagttctgatctaaggcaaaccctttgttacgtgttctgagtcccatctcttattgtcaactcaaggactttcttgccattatcctctattttctgcaccatcatgtttctctctcagctaatagacacgatataataactcccatttaaaaaaataaattttctctgttacacatttctgtcaagtaaccaccccatttcactacttcttttaaagaaaacaaagttttgaattgtatgaatacattatatcttcaaaagttaataaaaaagtcaacaagtgactctggccacgagggaataagagggtctggattactctcctgtgataaacaactagaaaactggaaaaaatgtaggaaataattattttcagacattggacaaagacagacagaactgtgattcctaagagaaggaaacaaaatgagtactcctagtacttaggctttctgaactgtagaaaattcccagaacatggcacagagctgaggaactcaagctgagcccaacaatcttgcagagataagagttcagagagggtaaggggctcaagttcatggggcagagtactttgaaagcaggagcatacagaaaaacttacagtggggccactttaactctttggctgaatatcaatctggccacaatgttgggtaagaaaaacttctagtaagagaacagttatcagggagctataagctaaacaattcacagaattcatagaggtctgggaatcgttcaagttcccacaaacgagattggagagaccttaatgggtatcagtgacatttcataggaactccagaagagctatactttaaaggtggggccaaattagccttagagtcaaggctacactatactattccccaaaatgcttaaaggatgccctaaaagattcaaattagtgctcaagtaacttaactgactttcagaacaaaatccaacactcttcaaggcaaaataaaacaatgtaatattcaaaaatgaaataatcacagtgtctggcagccagtaaacacatgctagatatatgaaaagataggaaaatgtgacccataaccaagagaaaaagaaaaaatagtcaatagaaacagacccggaaatgacagagatgatagaattggtagacaaagacagctatcattaatatgctctacatgttcaagaatgtaaaggaaaatatgaatataatgagacaggaaattgaagatgtaaaaaagaacccagtgacatttttaaagatgcaaaatgcattttttgtaaacaaaaatgctaaatattaatttgggcatttagaataatgttattcaataaaatagtatttatggtgtgcagcccatagtgctaggctctgtaaggggtgcacttttcattctccttcccttctttcctttctatcaggatggactcatggattcttattttagtttgtgggctacaaaagttacatcatttattttattactgaaatcgtctttctttctagcagtataagatgtaccaggttgatcttatacttttcctgatataacactggaattagccatttctccaaggagccatcgttccttttgttgaagaatggtatttacaaaccagtgtctggaggatagttgttcgttgttattgtttctagccctctctgtgtgcagagctagttagtgcacacaatatatacacaatgtgtgtacataatatacacaaatctatatatctatatatctctgtatgtacatgtattaaagggtgtgtgttcatactaatatgtcccattctaggccaaaactgcacagtccgttctaaacttcttttctttctgttttgtaactttcttctccagcagtgagaaagaaacctggcttccctttcccacagtgtgttacttatttgctcagtgctagaatacacacaaagcagttttagcattgctatcccatactgctgtgaaaaatgaaaacaagcgtactaactgaagtgcaatattgtttacactcattttgcctttactaaggctaatgggtacatggtcaaatattatgttccaaagttaaataggataggtcttccctctcccttcaggtggttatattattaacttggtagacattaagttctgtttgtttcagtttgcattcttctttttttcccactttctcttctctttgttgattttccatttatttggtgatatcttacatctgaagagtactttgcattttacaaaatgcttcttaaactttcctccttgataagatttatctaggtcagcactacttacttggcattcaataggtctgggtggaactagattgcttgcatttattcagaacatagattgcttagctctggaccttctgaattcctcatggggtctaggaatctattttttcacaagttctccaggtgatttttatgatgagtctagtctgggacaataactcagtctcaaattattttggattggcaagagaaaattttgaggtaatgtttttatagattaccaatctgaaatttaaaataagtgacttgattaaatgatttacaaaactaatactaaattttctaattccacttcattggtttgttcactattttgctgtcagtttacattacaatcagaaaattaggtggcaccaatttggtgttattcctgtaataatttagcatagaatttgcttggagaagctttaatatattcacattttctgggaagaaaaattggaccaaaagtcagaggacagaatgtgctttctttctaaaccatgtatggctaccaaaaatgaaattccaatactaaagaattatatctctaccttttgtgtaaaaatattaccaaaaaggcaaaaatggtaaagagacaaaattttaagttcatttgacaactgttttcatactattttcactttcaagtaaagtttatttacatgtagaggtattaaataaatagtggcactgagtttgtatatgtgtatgtatactggtaaggcataaaatattttgttgcatataaaattttcaagaattccagaaattcttaatgtttgcttgttttaagccaagtatatctcctgttacttttaaaatttgatgatccttttattctcatactttaaaattatcaaatttgttagagtatgttttgatattagtaaaaacagagttcttaacttcttatactgactttggcatgtaacaaggttggtggattccaggtttcacacaaacttgggaaactcctctcacaaatacaggaaatagctaatgtttttccttaaagaaaagaatcatttgaagtaattatataattctctaattttccatttataaaaatattgacatgattcaggttataattattttttagtcatggttactatggtctttattgatctctaaataaaatggtgatgataacagtgaaatttatcttgtgacaataaggcacgttgggtgtaatgaaatgaatattgaacatgatgcacaagacttcagttgagttccaggtctaccttctctccaaatctcagttttcttacctgtaaagtagatgatgttagttccctcaaagggtgctttgaaaaactggattagataatattactaaaggtgtttcatgtaaattgtaataatgaaatttgatgatatatttaatgtgctttctctatttttgtgtcctttgcccatcaaatacccaccagtagggagtacaaaatacttttggcttatacctggggagggagaattttcttttttcttaaagggccaaatagtaaacattttggggtttgtggaccatcctgtcttggtcacagctattcaactctgtgcttgcagaaaaacaattatagttagtatgtaaattgaattaatgttactacatttatgggcactgaaatttgaatttcatgtatcatgaaacagtcttttttttttttaattgaaaatgtaagtaaccattcttagctcacaggctgtacaaaaacaggcagatggctggatttggcctgtgggccagagtttgctgatcccaagcttagaacattttgaaattagttttagattgatgctgatagtgtcatgatggggttagctgttggcatggttacagaaagcttttttaaaaaccaacaaacaatgaattactataatgcatattttataatgtagatactatatagtcattattaaggatatatactctatatgatgttttgcatgtgtattacaattattaacaaaatgaaaaagagattgaataaatagaaaatacatcagtgaagggatgaggaaaccatagagttaatctgattttaaattcgcccttttttacaaatattcagtgtatttagaaaaggatggctttggcaagaccatctaaagtaagatgatgtgattctaacttttctttttgtcttaaaatatgactaaaattttctatcatttaaaatgttagcagagaatatatttgttgttttgtgctcaacttaggcaaatattcttgctttaaaattctgaagtttttcagccaaagcataataccttgcaagaatgtttccgacataaaacaccacaatttattcaatttgttcacagactttttgtaaaagcttttattttaatatttgaaaaacacctaaaaggtctggcttgatatttttaaaaattacattttgtttgctttgcttaaagatttagataaaatcgaaagtgctaaatcaggctacctctaattcaaaacaatattttatgggtggatagcattttacagttctcaaaaatacttttatgtgattattgtctttgatattcacacccttgtaaacatagatggttcggggattgtcttggttttattgattcaggaacctgaggctcacaaatataaacttacttgtccatgatcctatggctaataagcaaacagaagtacttgattttagatctcaatgttaatttagtgtgcttttgacactaatatcccctatacagttcccagtagattccttggcacattaaagccatgcaaatgttgtttcagggttgattttttttagtagtaaagtaataataaattctattacttgaaaatatatcataattcaaaacatttcatattagtggggtatgcagagaaagactagggtctatttttcatgttttttatatctggatgctcatatatatgctagtttattatagcttctaaagcaacacttttccatactgatttttaaattattacatttgttaattacagtgttttccctctacaaggactgcaagatttctgaaggcagtgatcatgcactatctccctatccccaggttctttgaaaaacagtgtggtttcgatatgaggtagcagatattaatggatagaatggggcagcacaggtgagatgggtagacagagacactgttactccacactcttctccccactgctcttattctatagtcacttcatttacaccaagacttagactccctaaaggatgaggcagatttataaaaaatctagtaagtaagaaataacaactgtctgttcttggttgcatgctattattttttatgccctgtatttggtaaccctacccagctaattataattttttttttaagattgacctacttatttgaaggtttaaaatgataggcaaggtattgcttacaaaaatttcctggattttctttctttttgtaaatagttttattgaggtatagttgatatataataagctgtacatatttaaattataaatttgacaaatattgatctgagaaatcactcataaaaccatcagtataataaagaaagtgaatatatcatcaattagaaaatttcttcctgctcctttgtaatcccaccctcatgctcctaccattggtacttcctcctcccaccccacctctgtccccagggaatggctgatctgatttctagcacatagcctactattactctagcattttttagaactttatataaatgcaatcatacagtactttgttgtgctttcatatacatgattatcttgagattcattaatgttgtttatatcagtatttcattcgttttgattgctgaatagcattccactaaatggttatattgcaatttgttcatccattcacctgttgataggcatttaaattgtttatagtttttgactgttacaaatgaagttgtcacaagtgttagaattgaaatatgttttcatgtctcttggataaatgcctgggcatggaatgggtacatcatgtggtaggtgtgtgtttaacaacttaagaaagtgccaaactgttttccaaaattgtatcattttacattcccatcagcagtgtaagagttccagttcctccacatcttcaccaatacttggtgtagtcagtctttttttaaaattttaaccattctagtatgtggatagtgatatctcattgtgattttagtttgtgtttcttgagtgactaatgatgttgagcatcctttcatatgcttatttgccataactatgatttatatggtgaagtgactgtgtaacattttgcctatctttttaactgggttgtttgtattattattatttagttttgagtattgtagataccttatgtatacaaatcttttatcagatagataattggcaaatatgttctctgtgtatggtttgtctttttgttatctttcatagtgcttctcagaaaacaacttttcaattttgataaagtctaatttatcagtttgttcttttatggatcatgctttttgtgtcatatataagaaatttttaattaacacaaggtcacaaaattttttacttatgttttcttctagaagtttcatagctttaggttttacatttagatttatgattcatttggaattaatttttgtatctgatgtgaggtatggattaaagttcttttcttttattgcatatagatattccattgttccagcacaatttatcagaaagattatcatttttccacagaatttcttttgtgcctttgtagaaaatcagttgtccatgtaagtgttagtctattctagactctattctggtccattcatttacttttttttgtttttacatgaatacttcattggcctgattattgcagctttataatacattttgaagttaggtattgttattcttcaaaatatgttcttcagtttcaaagttgttttggctattctagattctttgcatttccatatgaatttttagattcatcttgtcaatttgtgtaaaatagcctgttgagattgtgagtagcattgcattaaatctgtagataaatttgaggagagctggcatattaaccatattgagtcttctgacccataagcacagtacatctctcattttagttaggtcttaataatttccgtcaacagcatttcatagttttcaatgtgcagatcctaaacatcttttgtcaaatacattacaaagtatttctatttttgatgttattgtaaatgatattttaaaataatttctgtttcatcagttatccaatataaattcagtatcataaaattattcatatttccttattatccttttaatatctgtagactgtgtagcaatatcgtgctttcagtttttatattcttaatttgtgacttctgtggtttttcctggtcagtctgtgatatggtttggccatgttcccacctaaatctcatcttgtagttcccataatccccaagtgtcatgggaggaacccagtgggaggtaatcatgggggtggttacctccatgctgttcttcactattatggcggttacctccatgataatgagtgagttctcatgagagctgatggttttataaggggcttttccccacattcactctgtacttcttgctgccaccatgtttgcatgtccttccaccatgattctaagtttcctgaggcctcctcagccctgaggaactgtgaatcaattaaacctcttccctttataaattacccagtcttgggtatttcttcctagcagcataagaatggactaatacagtctggttaaagcttctttcatgttttaaaatcttttaaccagcttttggctttcttgatctttgtgtattatttttctgtattctatttcattatattctgatttgatatttatgatttctcatctgttttaaagtttggttgaatttgctcttttttttttttcctagtttgttaagacggaagctgaggtcattgatctgagacttttctttttttctcatataggcagttagtgcctatatttagtgttaaacacatttccctggaattattgctgtaagcaatatcctaccttaaagaatatgttgtattttaattttcatgtacttaaaaaatccttctaattttttttgatatgttttttgacccaggaattatttagttgtgttcagtttccaactatttagggcctttccaaatatctttctgttattgatttctgttattaatcctatttttgtgtgactggaatcctttaaaatttattgagacttgttttatggaccagaatatggtcttccttggtaaatgcttttgcaaagaatgtgcattctgctattgttgcatggagtgttcttgaaatgtctattaggtcaagtcagttgatgcgttgttcacgtttttatccttactaatttctgtctatttgttatatcaatggagaagaatgttacatcaatgatgaaatgaaattaatcaataattgtggattagtctatttctccttaaggttctctcaatcttttgcttcatgtattttgaaactctgttattgggttcataaatgttttggattgttatgttctcttggtaaattgatccctttttcattatgaaatgatcatctttatcccatggaatattcactgctttgaaatctactttctctgatgttaatataaccattacaactttcttttgactaatcttataatggtatatcttttcccgttcatttccttttatttgtgtttatagttaaaattgatttcttgtaggttgtttataattgggtctttttaatccagcatgataatctttgccttctaaatgggatgttaaggctgtttgcatttagtgtgaaaattgatatgtttaggtttaaatctttttatttcttttcttatcctattttattatttgtttccctttcctctttttatgccttctttttgattttttaaatgattctacttaatatcctttgttgcttattaattatattttcttgttttattattttagtggttgctttagcatttataatatttgtcttcaatttattatagtccaagagatagtatacctctaagtgatatcataccacttcgtgtaagaacattacaaatttctcccctcccaagcttggtactaatgccatacattttacttttacctacgttgtaaactccacaccacggatctattatttttgctttaaacaatcaataaatatttatcattttagttaaatttaatttctttgtgtgaaaccacatttctatctgctgtcatttttttttttttttttttgcctgatggattgcctttagcattttttatagtgcaagtctgatggtgacgaattatttttgctttggtatgtctgaaaaaaaaagcctttatttcatcattattttgaaagctgttttcgctgggtataggattttagaattgcagtttttcttttattttagtacttcacttttacgtcattatctttttgcttatgttattcctgatgattaacctgctgtaatctttatctttgtttttctaatgtagggtttttttttttcagataccctttaagctgggtgtcccaaatagtttacttcaattagtatttagtatcctgctttaaaagcctatccagtattttcatatctgttttaatatttagctcttatttttcaatataggcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccagtcacctctaatgtcagttcagcccataaatatgggtaagttatgcactaaaatgatgataataggtctaaacatcagtcatatataaaggttaaaaattgcttacaaaaatatttgctagcttatctcactttgcttaacactgtaatgatggtagatgtagtactgggggtattaagagtggcttctagaatgatttaacaatggtatgtatatctctgccattgtcacttaaattctgttttgaaaactgttttctttcaatcctggatctatgtaatggatgtatattgattggatatcactttttcacatctcagataactatttttgaaaatagtagcatgtttcttgcctgaatttattccttcaataaatatttcttagaggctcatgtttgtcagagactgctccaggagctggaaaaagagtgggacattagacatagttcccacctcagagagcagggacaaacaatagtaggcagagacaatgataaaagagtaaatgagtaatttactgtacaaacatgattacaaaaaacttcaaataatagacaacactctgttttctttgtgcaaagatcccccaaatctctttttatcaatttaaatatacaattacaaatgtgaataatacaggaaaatgttagcgctatgtatttaatttattaatttcatttaattatgtataatttagcagtttttctccacttatatttcctgaaacaattatatgcaaactctttatgtctgattttgcatcattggttttgacatcactagagctgcttttccaagtatctgatacaattttccatacaactcaagctttacttctttctaagttactcgagatatagcactttttgaaactgtgtatgacatcatattttaacatgaagactttcaaataatttgtcctgtagggatatagttgtgatctccacaacataattacaatggcatacaagcaattcaatcgtgaagttataccatagagaaaaaagttacaaaatctttattcaatatcattttcttttctttgaaaactaattctacctgatgattttttagtagcatttagagtcaacattgagtgcattgtttttcaaaatgaagtaggtaagggaaagtgctgtggaattttaaagaacttgaaagctttcttaattttgtctttatgcagagataattttggggaaaagtatttccttctatttgaatatatattataatatccccaaattatatgttccatgaaaaaaataaaactggtgtgatggagtgtcagggactattatttctactatgtagatcaaagaagatctcctttaggacatagcatttgagctgaatgaagaagagatatccatgcaaaaatccagagcaaaaggtgctccaagcaggaagaacaatattcacaaaatccctaagatacaatgaacttggtaatttgaggaacaaaacagaagacctttgtgctaggagtgaaagagatatgagagtattaagggatgaggtcagagttacctggtccagagcatattgtaggccagggtggagaagtaaagaactgttttggtttggatctgtttgtgagatggtgctgactggactgtctagtggatggagttgtagagtgtgaaggacagaggggtatcaaggataacctttaaatttagacctgagcatctaggtgaacagagacaccagatactgagatacggaaactcagggaagattaggtgtgtgtacagaaatcaagagctctattttggacacattgtatttgagatgtctattggaaacctaagagacgttgaataagaggttggacatatgagtctaaagtttaggggagatatatatatttgggagttgttagcgtatcaaggtttatagtattgtatgagatcacctatttagagttcaggaagagaaagactgaggggttatcagtaagaatgaaggagtaaaagagtatgttgttgtagaagccaagtgaaaaaaatatttcaagaaggagggaataagcatctatggagtgctgctgaaaggccgagtaaggtgaacaggaaattgacattgggtttatttttgtatttctaatattaatgcatattaatattgtcaacctaaaatgtatgacagataccaactctataaagcaaaaagttgatttgggagtagtaggggattgcagttctagacatgcatgctatggaatgactatgacacatccacaggggattggagtaaaggggaagcttgaaaagacatataggagacctccatgtaagctgttttgaacaaagattattggttacaagagcttgctgcaggggtggcattagctcattggtggagacagccgtagttaggcaagtgtctctgtgcaagcggcttttatggaatactgtggttttgaggaattctttacgttgttccaatgtaggcatacatatacataaggggactccttcatggcctcccaactccattgtgttagggtttcacactagtaactccagtttgatactgataacttttacagtatgcagataggaaatgtacaatagcttgtaatattgtaattttacttttctttggtatatattgttttctctttggtcatggaaacacagtaaatttcacctgctgtttccagacttttgtgtttagctgtctctgctttaaagtaactgaaatttataatacgtctcataaagtaaaacctcattgattttgactaaaagaggaaaattgtgaccaaattcttgaaaatatagaatgtgaaaattatcttatgctctttatttattgaaaataaaattcaaatcagtgtttcaatttaatgataatttctatatatatgaataattcctgttaattgtaaaaaccttgctaatatagagatgaacaaacaagaaaatgcatcgattttctatcactttggcgatctttatattttaactatatcaggaatccaagtataaatgtgtgttaaactttcaaaatttaaacattaaacatttttaatattctgagaaacttcatccctacttctgatgacaagccagggactgctgatgctgcatttattgcatgggaatatttatgctgtcagttatttgagtaggtttgtctagattatagtgatctaaaattaatagacaagctgaattttgggtagttttgtgtatttccaaatagtgttctgcaaaatgcttttttcctttttaaccactaaaataattgaagtgggtgaggttcaggggagacttcagataagttttaggatgctgggtttaataaagttaagtgggattcttacaaggggaaatcacatttagcaaaataatctcatttactgattcatagtctttaccacttaaggggagggtaatgaatatacatggattgctatgataaggtacaaggacgagacccagtattcaagcttgtttcggttctataattagtccttggataaagtcaccttttaagtacttgaaaggcaagatatgatgaaaatttatcttgactttattttattcagctataattgtcatgaaaattacttgacttaaaagtattctcttttttttccttaagtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagtaagtatattttagtaagtaaaaggaaaagttgagaagtaaataaagaccctcttaagtcccatagcaattaccctctgcatactaaatatatacatttcttctaaagcagaatgaattataattcaacatttcatattatatatcatatatagatagatatacgtatgtatatatatggctataggaaatctagttacagaaacttgaattcataattacaattattttccaccaacagaccactgatttcatcttttttttaattgctcaatctatttgaatgtttttctgaatgtggcaacagaaagatttttgcttggctaatcattagtcgagcttctgaatcttctgctagcccgatctgtgcacattcctgtaaaatccagttttagcaaagaactctgctaggtcattttagcaggaacacccccaccctggatatctgatgaatatttgatcagatttctcatcctccaccattccccaaatgatgtttgatcaccatggcctgtcttcagcaagaattctgttaggtcagtttagccagaatccctcttaccatgatgtttttgcttagtaattttctatctactccctccttcttggctataaattccctgttgtccatgctgtgtttggacttagcccacataccccgacccaccacaagaccccattgcagtgctccatatacctattgtgatgattccaaataaagtcttccttacttcctttctctttttctttaacagttcgttccgtaagtatttattgaacacctgctacatgcctggaactgttctgcttgcatcaggatacactgagatagcaggacaggataagaggaatctgggggtgctggtagggaatggaaggttgcaataataaatggaggttggggagggtgacatttgagcaaggatgtgaaggagatggtaatgtagatatctgggtagttgggttctaaacagggagaacagcagtgcaaaggatggtgtggctgagggcagtgaaggtgacagcagtagtggttgaattcagaggccagcaggggaagagaatgtggagctcaatgaaaggcctcttgggccatgtgaatactttggcactttactttgtgaaactaagtttcatataatttagaagtaaaaatcagtctttttagaactggcaaaaaaatttaaaacattttattttcacaaagagaatgatgggaatcctcagtgtcacatatggagaaaacagagttaaggcttctgtgggtttcagctttcttatctgtaaactggagataatttgtgaacttgaggattttaaataggagttattaatatctgatgttgttttatgcattcctgatgcttttcataatttttagtctgtgacatgctccccttaccccaagagcagtcattagagccagagaatttattaactttggagtacatttttgggaagctgaattttgatctcctaggctcaagtgatcctcctgcctcttttttttttttttttttttaagagatgaggtatcactatgttgctcaggctggtcttgaactcctgggctcaagtggtctacccacttcggtctcccaaagtgttgggattacaggcatgagccaccatgcctgaccaggctcaggttcttaagacttttcatgctcttctgtacagggacacttgtagttctttgtctacccctgcacagcattttctaccaggtgtgtgttataggtgtcagtagtggcttaaagcttcccacagattttagctgcatttcttaaaattctaaaggtcatatattcatcatgattcaattaacagtatttgttaattatcattatgattttttcttggacccatgggctatttaaaattttattgactaatgtgcaaactttttttttggttattgatgtttgttttaattccgctgtggccagataactactgtgtaagatattaattctttgaaatttgatgagattagcttatcctcacttttagtaaaggttccacatcaacttgatgttctgatgttttaatataatatttaacaggctgacaagattgtctcagctacatccctgctagtagacagtatacttcctgggtcttcgtatgaggttcaggtgaggggcaagagactggatggcccaggaatctggagtgactggagtactcctcgtgtctttaccacacaaggtaggttatgtaatagccacttctactgggagggaaatatatttcctgaacttgcctttgtatagtataagcatcttacattttgaggccttaaaatgaaaggaggaacacagtatcaacttccttgtttaaactttgaacaggccaatttgtgaattaaaattctgtcagagcctctaggcttgtgtgtttctattgcagtatattgtaggatcacttttcctattaaaaagaaaaaattaatataacagctccaaattaacaaactcagaaagccatttgtattgataattccttaatttacattttaaaaccaagcatatttatttgacataaaattcaaatattaacattttactttatattatataataaatgaattatttttactccagatgcttgcttttgagagttttcagtgccaatgttcatattttaaaggttatttttagcatcggaacatctacagttcattcacagcttcttcatgcagctgatgcgcaaagttttgcatagaggctccagaggcttggaatggtcctagacctgttgcatgcaaagttgggactatagaaagacaatagtcctttggctggttgtccgatctgtcaaaagggcaaaatttttcttgttcagacttactgagattgattatggcctgtacagagataacaggtaccatgcaaatatcaatccatttaacaagtttacttgttgattgcttactattttaaaagcattgattcgtcaaaaggcaagtagcaatagtagtttaagacattgacttcggagtccaacagaagtttataggagttctggctccaccacttatttggaaagtttcttaacctttctatgccttaatttccttatctgtaaaatagggatgttttacatggatatgaaatatccatataaaattaaataatgaaatgaaataattaacattggtcatgtgaagaaaaccattattgttttcttattctgcaaattaaaaattgcatagtatgtcatatgcagataaaatgtgtatctatattattaaaattttgcaaattaaatattcaatatctcatatcaatttcaataaatttatccagtgtaaatttcacaaattgtcaggtttttattaacttagttttcttattttaagctaatattttagcatctaatcatgtaaaaatactatgactttaatcttatttctcagttaagccttactatatgtatttgatttcaaagtgaaatgctttgaattttcttgtcatctttaaaatgaaaaacttcagcttaatccatgaaaactcaattatattttttatttttaaataagaattattctgagacttttgaggcagttgagtaaggaggttgtggcgcatactgaaggtaggttaagataggttaatgtactaggtacttgtccacagtaagtaatgtacaagtgaagcttgagtgccacctcggctaggattatactcagtcacgctcataaatctaatggtctggctcctgtgcagtaattttatgctactaagttttttcctgtttctatttgattatggacatacaaaacacaaatgttttgtatgaattgtaaatatatagacattgacgtttaccatgctattacagaataaagaaaacttaataaaaaccaattaaagtatttttgtttctgtttttaagggtaatcccaagatatgtgtgaaaacaaattttcatagtctatcaacagaaaatggtttaccttaactttacaactgaaatgtactgacgtttttgcagtgcactgtggtggaaataatttcttcctatgtaaaccatcatttacttgtatctcgcatgtctttgaaaatgataggcaaatgaaatttacaacaacagaggactttaaaaatagtatagaatcatgtgtaggcattaaaaaaatcatgttttaggaaaatatcgcttccctttaccctcatccataggatattggcattaaataactcaaaatgatagtacaaaccagtatttcccattttctctgctttgtatattgctgcattatcattcatacgacattcctattttttaatttatatctcgtatctttacctacttacttgaaatttttatgtatccaaacaagacaatagcggcaatcatttttacttcaggatttggcttcatagtgatttgctttaagaacttgtcctagtttcactgattcccaaagcagggtctgttggaaaatatgtcattgttgaattaagctatattttgttttagtcactttcctgcctatcagttagcaagtgacaattactggctaaaacatattttatgatgaataagcctctgtgtttagaagatagtaaagacattcatggaagctcaactcactttagaatgagagcactcgggacactagataactgtacacaaacaggtaatttcagcattatccagtttttaaattacactcattttatttttggcagtgtaactctggaatgtgttgtgaatatttttcgatgtggtacaaattacttacagaatgttttgtcttcatctgatatcctttcttccctcattacagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattggtaagaaaacagaggttttgttcattttgttccacaacttgaattttcattatggaccctccttatattagagtcctgttaaagatgtaagaaaaaatttttttcattgaattttttggagtttttgctttatattaatattttaatatgtttcaaatagatgtcaatatcaatatctcatgtgaaactgatgggtacttaactaaaatgacttgcagatggtcaaccagtacaatccagtcacttgcggaaagcactttgcaattgaggtatcataggtacgtattatttttgctgttttgtttttctgtgggcacagtgagataaaaattttctttagaaatattacaacagtagtcttacagattatttgcttcctgaaagaggaaagtataatataatgaatcaggaaatttttgagggattatataaattggtgattcttgaaaaatattcacacctgagattaaaaaattgtaatttgtttttacttcaaattatcttttctgaaaatcaatcaattctgaaaaatttgtattttaactcttgaatgaaatgcaagaaaatgtagtttatatatattttaatttgacttagttgactagaggagaatgtgaaagattataaaagtttcgtatcatttggctaaagattaatgttttggaaaaaagaggtaaaaacagattataagagataatatgaatggtttttagaactgagtgagattacttaggaaataaatacttatggttaataaagggtaatgtgttctaatgagaagtaatttgtgcttgtttatttttactcttctatgttttaaaaagaattcaaggcatcgtcttatagtggtccctttctttctaaaatcattttatctaaaatgatacaacccttgattatataatagatttttatttttaaaaatatcccatagtagtagtcaagtaaatatatactgctgttaaacactgtgtcccaatttatatttttatttgtagtggagactttcaatttgtataacatgctcatttattcttaaaatataaattttcaactagaaaaataaatcccttctctcaaatactgtgatctgaagtctattcctaatgctgccagtctcttcttatgtagcgttaggaaaaaaatgtggcaattcgtacatttctcaaatagctgccttcatcctacctaatatgagtattttaaaatcagtagaattgttcatgatatgaaattttacttttataatctgtctttacattcttttcatggcattttcacattagaaaaggtgtttatggaaaactattatgttaagccccatgccttgtttctcttattaacatttacagaataactatgaaactacatttacttgggtgagtttcttaacttccctaagcctcaatttccttgtctgtaaaacagagagaataataggacttacagtgtttctgcgagagttaatgacatatttcatctaattataatcacatggtataatttctccttgtaaatattcaatatatggtttttgctgtcatgataatgatgccaacttttcgatttcaagtgtactagtactgtgcttctactttgttcttattttctacccccagatgacccctcactcctcattttcatttttgcccacgcaccaccatttattcacacacacacacacacacacattcatgattgtaattttgagaagacaagaaaaagaagtggtatagaaaatagaaaatgacagaagaatatagattttttagcttcttctaacttcctcactcccatctctttggaaagagtaattgctacttcagctatttaaatatagtattcagagcaaacattggcccaagaggttatttcaaagaagaggaaaaagactttatgtcaagtttgtccaacccatggcctggggcccccatgtggactaggatagctttgaatgcagcccaacacaaatttataaactgtctgaaaacattaggagattttttttgcaactggtttttttttttttttttgattcatcagctatcgttagtatattttatgtgtggcccaagacagttcttcttccagtgtggcctagggaagccaaaagattggacacccctgctttatgggttctgaggtggagtgttggctaggactcacttataaaattttttttaaattttcttttctgagaaaatgaggaatatacatggttatataattcacatacatatctgaaattggtattatattaacttatattaatttgaactagaaaattatattcaccactcatttgtggtgaaatttaattctttcttcaaagtgtgaggaatttgccttccttgccatctcaggaatgctccatgactactttcatctatattttaaatattctatcactaatacataatgtttgtttaattttcaaattattgtaggttctgtctctaactggatcattttcttctttttagagtatttatttcatttgcatccctgcttagtgtctaatgaaatatttaataagagttactgtcagtttctgtggaaagatatagaattgggaaaaattaaaaaatgcctttctaataagaatgtctttttttagatggagtgaaattgtctgtattttatttattttaatttaatttaatttaattttattttgtttttgagacagtctccctctgtcgcccaggctgcagtgcagtggtaccatctccgttcactgcaacctccgcctccccagttcaagcgattctcctgcctcagcctccctagtagccaggactacagatgtgcatttgtagagacagggtttccccatgttgcccaggctggtctggaactcctgggctcaagtgatcagcccgcctcagcctcccaaagtgctgggattacaggcatgagccaccgcaccgggccttctgcctgtcttttaaacttggggtccccagtccctgggccacggaccggtacctgtctgtggcctcttaggaacccggccacaaagcgggaggtgagagagcagcattaccacctgcgctccacctcctgtcagatcagcgcagcattagattcttagaggagcagaaccctattgtgaactgggcatgcgctcctcatgagaatctaatgcctggtgatctgaagtggaacagtttcatcccgaaatcctgaaccatctcccatcccccattagtggaaaaattgtcttccatgaaaccggtccctggtgccaaaaaggttggggactgctgttttaaacaacaaatcagaattctcagatatcttcttgttgcttttattaatgtatactaattgactatttttgtatcttttaaaggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtgggtatgtcaagctgcgttgtgtcttcatttgtgttagcagatttgtatgcagattgatgcagatttaatgttatattttgccattttctgatcacattagattttgaaaaaaaaattgttcctgtttacagtggtattgagaaaatcagccttaggaagttttacagttttgaattcatttcaaattatttatagcagactttttttagcaataggaatattttctgcacactattagatgaaatacatgggtcattatgaatgaattttagtagtgtttttctaaataaggcattattttatgtttttgttccaatgtagttatgaaaacatgtaatatttgtaatccaaacgtttaatttgaatattctgaggttctcaataatctgagtactcataactcaagcctttaatttgtgaggctatgtagggcacagaagcatttaaaatagctaaattgaagtggaggaaatagacaacaatgacatacattatattttaaacattcttttcaaaaaacttttgatttcaaagatattaagagagcccttggaaaatgtgatatattctttccggttcattgtgaaatctctgagaaatgattgtgcaacaggaatgcaaaaatatcttttggtgctgttacatatgtataactaaggaagcttttgtagatcttttctaaatgtttgttttcaagataagatgtctaaaaacaaaacaaaaatgggattttcagtgaattttcccctcaaataaaatattcctcagtaggaaacatgttagaataatgttccataaaaatattaatatatactattttgttgggggattatgtcaaaaatcaatatttgagtcattatttttcaattaattaatacacatttgaattaaaacctataaccaaaaaatacacgataagattgtcttaattataagatttctttttcaatgtaaagtcccaatgaattctctccccactgtttaattccattttaagtgatttttactgcagtgatacttaatatcccaggatagcaaggaaccctcctacactcccccaaacatgcacagataataacacactcacttataagatatgacaaatgaagcctggattcagtaacatatgttacttgaataacctatggtgttatccttttcaaaactaaaataacgagtttaggttgggcttatattgcctacttagtactagaaagtaactcaacgttgggatccaaataccatctccacttattactagcctttaaatccggactagccacacaggcactatgtgtctgttttgtcatccataaaatgtagacagctcctcataccttcccagcatgggtattgagggaatcacgtaaactattgaacttcaagcatatcctttctgcagactggatattcactgccagtctgcagaaaggatatgattcatatgattcagttaattgcaaacacagatttaacctcttacagtctcttgaatattgatacttcctttcctgacaagaaattatcaagaggtgaaatacagtatatatcatcttcctgggttggtggagaatgtctttttgttctatgaagaattgaataatcatgataaactttacatgacggaaaaagtttaggtatttttgttatcaacagtcaaaagtattattgttgattgcttaaaaatgattttaaaataccatatgaaagggagactatacctttacacagtgttggtttttggcaagtgagacttggagcaagagaataataaacacccatattgtgccaatccaggtattaagttttccctgtgaatcataacagtagcatgatttataagacatggggaaataaatcaagaaggtaaaccctggaactctatcgtcagttctctcttaatttttcttacacagagtgtctacatttggccttagttatggtttgggttatttaggtttctttttgttggtggtggtttgttggttggatggtttcatacattagcccttcagcttccctttttgctactgcagttgtttcctgcatattccagccaagggccatctctcactttagattgtccactggcaggggtgactgtcaaaataatgaccaagaggagggccattccagctgcaatcccagaggcctctgctgtaccaggcattgaccttttaggttctgagccgtgggcaggtgtggagggcatccaacctgagcagttctggaggagatattcctcaggagagcacctctttaccagttggtatggatgtacttaatatttttaacaactgttttgacataccaactgaatatatgtcctctaaatggaatcttctagtcttagtgcagataatcaagacatgactatgtaaatgtagtgtgtatcataaagttgatgcttggagtcataacagagttagggcttcagagacgcactgttatgcttgggctttcaggcttttagtttaaaatatgccacatttccatattgcctgttattgtcaggaagattggccctcaaagttaaaaattaagaacttgggggaaaacttatgtagtgaatctaagcctaaggtagtttttactttagctctgaaagcagcatcataaaaaggtgataggaaaacagggaagataacctttttctttgcatttctatgatttttacattacacctttaaacatgtcttgttatgtacatatacgtatctattttaaaaatcacttgctattcagaccatctttgcctctattactgcccattaaaagcctgttttcctcagattatagaaaaccaaggctttgctctgagagactatctctgaccttgacctagaaatatttaatgatacacagcagcataagagtttcacactcacacatatggaaattgatgcagtccatgggttttttttttttttgcctttaattaaagttcaatggagaacagtttgttattgatatttagcatgtgttcagcatggtatctttttttttttttttgagacggagtctggctctgtcgcccaggctggagtgcagtggcgcaatctcggctcactgcaagcttcacctcccgggttcatgccattctcctgcctcagcctcctgagtagctgggactacaggcgcccgccaccacgcgtggctaattttttgtattttttagtagagacggggtttcaccgtgttagccaggatcggcatgttatcttttgcttgcagagccaatggttcaatttctaatcaggtactactactagctttcagagtaacatgaataatgtattgacttttttcagtcaagtctatatttgcgaaaaagagataaatccctcttttaatatatcacataaagtaatagggaaacaaatgagataatgagtgagaaagttatgaagaagatattgcttgatgaatacagatgtatgaaaatataacacaatgtttttaggcattattactatttaaattaccatcacttaatactattgtaaaaatttctagtgaagccactgcctccatccagtgtgaaagcagaaattactataaacattggattattgaaaatatcttgggaaaagccagtctttccagagaataaccttcaattccagattcgctatggtttaagtggaaaagaagtacaatggaaggtaccttttacttagaacttcagctttcctcattaaatgctatttttataatatgtaagagtttaattgcattagattaattttattggcataaaagtacattctcctgtattgtgtagctattttcattaaatagatttatctaagtctaacttttttaaagaacaaagtttcctgaaatccatcattccctgaagtgtgttttatagaacgttggttgcatattatgttccttggaaaaagattaaatggctaaatcagtttaggaaaccctgtatcactgtatcttccttgtgtagtcacggtatacatattacatattcaaggtttggagaggtccttcattaaagaaaaatttgtgaccttatttcatctcatgttccccaaactaatttttccaaggaactgttgtttctctaacatctgttgatatcttttagtacatacatgtttagtggaatgcattttggaagaagctgcttttcaaacaaacagagtcattcccgtagtggcaagtgtgcctatcatggcattccacatcagctttgtgacggcagcctgcaaagacctagaaatatcagaaacccttattgtatcattagatcacaatgatatcaactaaaacaaatgtgacagtttagctgctattgaagaatactgaatatcagcgatttgctacagtaggtcctatctaaccaatacgtttaaattctttttaaattcttaaaacatctttgtgggtagaggattagtggacagggattagtaggagggtaagagagtgtttgggaaacaaggttgcaagtaaaccagttcaaaatcttgtcatcatcagcaagggagtgacaagataaataagaaaatccttgacttgaaggagtttacaatccaagcctaattgtgactatttctgaaggcagagaacacagaatcagttctcttaattttggaatagtgttaaggtttaaaataaaatgtacttcagggccctttagatacatatgtgttggtaatgatcaatctaatgctttgacttattttacagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaaggtctgcagagattttgtaaatgtgttttgaaagtgcataagtgtgtgcttcaaatatggctgaaaagtatttcttcaaaaacatatacacaacttgtcattttgcagttcctatgagaggacctgaattttggagaataattaatggagatactatgaaaaaggagaaaaatgtcactttactttggaaggtattcccaattttaatattaatcttaaattgtatttttatactcttaaaaatttacttcatggtccataatcctgttattaatcttcggaaagctcaacaatcctgtattttcattgcatttatgagatgtatttaaagagagctaagatgtacagtggctgaagcactggcatagtgttaggagactttcattctcttcttagcttcacatattatagttacgtcagtactatttgggcaaagttacttagactctttgggcctcagttttctcatctgtgtaaatgtaatattgaactagatgataggcagtgtttcttggagtctaaaaattgtattcatatttaatcctgaacaatgtaaatgtcaccttccccgcacaccccaagggcatctaacacatgacagagtattccatttatgtgatggcataaaaacagtggatagtcccatatatgatggctgtttagcctagtaattttcaaagcatcctctcccaaatgaactgatttctatttcaagtgaatagtttatttggtcagtaaatgccaaatttaagattgacttgggaatacaacacatgaagtcaaagagtatttctgtcactccaaatgtgaattgtaagtttaatacccaaggttgaatgagcacatgtttgaaaatggtttcctgatgtaagaccaaagcctctgtaaaagttgtggtatataagaatttatgttcatttggtttctaaatccagttactctataatttcatttggtgaataatcaatgcaatttctaaagtcttccatttcaatatttcttaaaataattttttattcttttatttcatttcttttatcattgctctccttaaaaaatttagtttcttttgttattgctctcttttctttttctagcaaaccattccttcaacacattttaatatttccaacttaaagttagcattagaactgacagacatttatgagccatttattgtattctgaacacttcatacagatctccacctcccggggaattcaggacctgtattctgagagattgagtgggcggttgaacccaccgcggaagggggcactgctgaataagaaacaagagtcttgcccgacagattatttttctcatatttttggttttatctccatgggcactgttccagatacctgcaaacttctacagtgaaggacaggcagtgatgttcccatgtttgtggtagggccagctatgagcagaatttaagtagcttttctttttctttgatttgtcctctcagagctgtagtcaacagccctttggcctaggctacagctaccctctcccattgcaatatactctagaacaaaacagttgtctttctccagacagttcttatgttttcctcatatcatggattccacatttcctcagcaatgctgccaatagaagtttctgtaatgatgaaaatggtttatatctgcattgtccaatatggtagcaaccagccacatgtggttattaagcacttgaaatgtgcctagtgtgactcagcaactgaattttaaattgtatttaattttgattaatttaaatttaaatggctgcaagtggccagtggctatctttttggacaacaaagctctatgggttctttaggggtgatttgtgggagggagacaggacccttgctaatctaccatctttgcagaaccttgaatgccttttattagtcaatttgcctttcattaattttgttttgtgctgttttgttgtgttttcctaaactgagataatagttcaatgattacggttctccaagcctatgcctcttaaaccgggataagatttgcttaaggagtaagccacaaggccacaggataagtatggcactttttaaaaaatatcatttctctggcatttttaaaataataaactttacgttaaggcagttttagagttacaaaaagacggcaaagatagtacagagaattcctatgtattcccacaccaagttttctctagtattaacatcttaggctagtatgatacatttgttacaatgaattaaacaatattgatatgtcatcattaactcatctgtaatttatttcaaatccaaatttccttagcttttacccaatgttctttttctggttcaggattccatccaggatagcagatttcatttagtagtcatacctccttatgcttctcttggttgcaaaagtttcttagatcttctttgtttttatgaacttgacacaattgagaagtactggtcgggtattttgtagaatctccatcaaatgggttttgtctaatgttttctcatgattaatttagggttatgtgtcatacctccttatgcttctcttggttgcaaaagtttcttagatcttctttgtttttatgaacttgacacaattgagaagtactggttgggtattttgtagaatctccatcaaatgggttttgtctaatgttttctcatgattaatttagggttatgggtttgggggaggaagatcacagatgtaaaatgccattccatcacatcatattaaggatacattctaccaatgtgacttaccatagttgatgttaaccttgctcgtctggctgaggtagtgttgtctggctgaggtagtgttgtctggcttcccactggaaagttactcttttttctcctttctccattttagttttaaaaatgaagtccccatgcttaaggagtaggagtcatgttccacctacttgaaggtagaggacctacatatattatttagtgttcttctgcatgggagatttgtctgttctcccacattaactattttatttattcaatcatttatttatattagtatggacaatgaacatttattttagacttggtttgtaatccaatactactttattttgttgctgaaaatattcctgcttcagtcattgggagctcttttaattgactcatgttcctttgacatgcccccgtcattgtggggttttttattttaatttttgagtactggtaagttcgactttattaaaattaaaaacttctgatctgggaaagactgtcaagaggatgaaaagttaaggcacagactgggtgaaaatatttgcaaaaacacacatctgataaaggacttataaccaaattacacaaagaaatctttaagattcaacaggggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaaaaaaaaccaagtatctgaacaaaaacctagccaaagtagatatacagatgacaaatatgaatattaaaagatgttcaacatcattcatcactaaagagttgcaaattaaaacaagataccactccacatctattagaatggctaaaatccaaaaaaaaaacctgacaatacaaattgctggtgaggatgcagggcagcaagaacttttattcattgctgtggaaatgcaaaatggtacagccactttggaagccagtttggtaatttcttacaaatttaaacatagccttaccaaccacatgatgcaacattgcatcctaggtatttactcagctgatttgaaaacttaagtctacatagaaacttgcacatgaatgtttaagcagctttagttatattcaccccaaactagaggcaactaagatatccttcaaaaatgaaacgattctgtatacttctgaaatggtgggtatatagcactatgcatttgccaaaactcctcgaacttcatagcacaaagagtgaatcttaatgcatgtagattaaaaagaaaatcatttaggaggttgaaggatcccaggattgactgtaaactgtgacaaaggaatctacctgtattacaagtgtatgaagcaacttcactgaaggtggtgggagaaaaggccactttggaacttgagtggagttgttggaaatgtgtggaatcttaagactaaaggcaaaagaaactgtacataagcactgtactctagttgatacagttctcacagggctatgggctaacaattatggtactgctctacatgtactctggaaggggacaagcaagtaaatggatggtggatggtgggacccagatttctcactgttggattgggaggttacacacaagcacaggatgatccatgtggcaatgaattagagttggggatataggtatgaacttatatctagcttaatatagatatagctagattctggtttaggatacatgtacattttcttgatttgtaaggtaagagggcctaaaagtaatgacatccagtagtaagacatgtgcccagacttgtttctaattaccatcgttcaataatagaaacaagggctattggaagaaatggctaattttagggttggggcagaaaatatacgagattagcctggaggatcttgtagtaccagaaagtaaggaagcttaacattctcttacttgatggttaccaaaaaagtattcattaaaactgacatgtttttttttcaaataaaatgcaacatttgcatgactttgaaacatttctttcttgcggtggctgctaaaatcttactttcaacctatccagatgattccaagttttgcagggatacatgtatatgtgtttatttttctctgccatttctaacttagaggcatctcaccggcaagaaattgagatgtactgttctagtctatgatatacagtccagccttctctgtctttataagggattgccagcatttaatcttacctgccataggtgaagttgattggggaaatggggtacactgttaacctctgtggaatataagaatagaattgaactagacacttattttacattcggatctttaatgacctgatattattatttttaattatatgacagaaattctggggtgccatagacactgttttgatggcctctgttactcattaacctttgcagacattcttacattctagataatcttccaagagtatcagaggaaaggaaaatgaatgacaaatcttactatgatcaatatatgatgattaacaccttcacagctcttgttgttgcttttcattttctgagggttattccttgtttgctttttagatgaggaaactctctactccttatgtctttcatttctctaaaattagagtgaaacttcttggtagaaaagtgtcttgatcatatccctactttattatcttcaagtgatttattctctgggccttaagaaaaaaacctcaaaaaggggaaaataagtttgctatgctccataacgatccagacaccttcatggagactgtggcagaggcaaactctatcccacccatctccccagcctctcagccttgtaatagtacctgccctgatctggcccctgcctcctaataagaaatgtagaatgagagttatgtgagctcagttagtataaaaagcactgcagcccttaaactaatcaatttctatatttactacagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaaggtaagaagaggtacagagtggtaatccattgcctcttttaatatttaacttttgcaaactctcctattttaaattatctttcaagcagcctgcaattctctgcatctgaaagtctctctttcacctttcatttcctttgtctggaaaaataacaaagtacattgtacaatgatcacataatacagtccttgagctttcatttgggagaacattgttgtaatggtgttataatatatgagaatgttttagtgaatctaatacttaaatcttttggaccaatggagatctttaggtcaataattctctctccctatgtacatatacatgtatatatttatattcatacatacacacatataaatatgtaaaaataagtatatatcatattaaatatatatttaacactatgtaaaatagtaatagcatgacatgttatatggatgcaggttaattgctgagacttaaaattactatggacttcattgaatgtgagtagcaaaccttcttgcattaattttgatatatctgattaatcggagaattgagacccactttcaataggaatttctagtctagattacatattcaaagtgtaaatttttaatggaaaatacaaattttctgtgtctctaccaatctataaaggcctttccaactgttacctcctttatgaaatctttgcttattgctttaattgaatatgccctatctcttctttaaatctcagagtgcttcctgtctttcttattttatgtcctgtttacattatgattacctttgtatttatagtgttaagcatcgagttccatagcacccagctcagtgttttatgcttaacatttcctaagtatatatattctagaaatatctgtagaatgcgtcagtggggtaggtagtgggaattgtaatgtgagaaaaactataatggttggagtgtccagagcctaataggtaagacaggtattaatgaaataatcatacaagtgaatgtctatttgcaaactgagagataagggcctgcaggaaaggaatataattttatgaaaggaatgaaaaaaaggaacctgacctggcattgagattcagagaagccaccttgaggaagtggtactgaactgaaatctgaaatgtgagtaggaattaaacttccccaaaagatgtaggggagggcaggaaaagcattggctcctaacaagagcagccagatcaaaagtctatggcacaggatagaaaatgaagaaagaccagggtggctttggtgtgggaaatcatggaaggcagagaggtgcgttgagacttggccctcagggccttgcaggcatgataggaattttaccctcaaatgtagaaatccgctggaggcttttaagtgggatgctgtgcagatggtgttaaaatgaacagatttgtgctttgagagtatcactccatcagtgggagaggatggttaataggcttgtgcagtattccatatgagaatgcctttttgaatatatcaaaaaattgctttttaaggttttagggagtatcatgtttctcttcaatgtcatctattcccatatctctctgtttaaatgactctcatgatgcaaaagtaattgtcatgtatcatatttatttgtgtaaattgtctgtcttctcttccttattccctttagtaggttataagttcctcaagagtattagtagatttttattaatttttaatttaaaaattaatttccttcttttcccctcagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatggtaagtttactatactttagtaagttgctctcatggattaatatgacactacagattattaattctattaatatagccagttaatgaaaacttcaaaaatatagaggatactaccatcctaatacatataatcctataacctttatcaaaacatttaattctcttcctcttctcttctcttctcttttcttttcttttcggcagggtctctctgtgttgcccaggctaaagtgcagtggaacaaacatggctcactgcagcctcaaccttctgggctcaagctatctttccacctcagcttcctgagtagctgagactatagacacacaccatcacacccagctaattaaaattttttttttttggtagagacaaggtctcactatgttgctcaggctggtcttgaactcctaagctcaagtgatcctcctgccttggcctcccaaagtgttgggattacaggcatgggccaccacacccagcctaattctgtttcctttgacattttctcattttaacattttatacaggggttatcatatcatatcatatcatatatcctatcctatcatatcatatcaattttctcctcatttctttctaccattatttttaatgatatagcattttattccaaagtccacttaaactgtttgagattctttatgttgcttccagctttatcttttcttaaatcattttttaacagcttctgatatcttctgccaaattgtttcctcaaactgtgtaccaacttataatgccactaacaatgagtgggaatgctagcctgaaggtctgaggagctaggactgggtgacctagaccagggtattctcccaaagttagaccagttattccaggaggtgagtcaagcacaaagtataagtgcacaagacagcatttctaagtctgagtaaggattgaggaaagttaactagggaagctaaggattgctatgatcttattatacaatatcattctaaggactcataccattattttattccagggacctagaatttagcatcagggtaaatttatttacaaattgttgaactgaatttagttcatcaccactgatgcgcaggtagtttctctctgtgcttttctttaaaccatgaggatataaaatttaggcttcacagagatctctcttcttctggatatattcttctagaagaatattcatatattattagcatttgtgaaaatcatgatggatccatctggagctttgctatagggttggtcattttccatggatcaaaatcccagatcttgcaaggggtctcgtggtctccaccaccattttgtttgcataggatttcacaagactttagtctcccagctaccttgaatggaatggggaaactaagtaagctgaattcctattaaaaaaaggagtattgcccactttgggggtaagggagaggtagtagaacatattgctctggaaaaggaaatgaaggaaagaaaaagctcatacaccctgcacttgaacaaattggctatcactggaacatgcctttgaaaaattgcaatcttctgtctctggctaagatttttagaaaaatatttggaaaactattgtcatgactagataattagaagtgcttaagtttgttttgaaactcccttgataatttaatccacaaataataagtaatttctatgtttggaaatatatgatagtcactttaattcttttttaaaatgtatgttccactcattactattaattttgtataaatgagccttttacgtatttttctcctcagatcattttatccccattgagaagtaccagttcagtctttacccaatatttatggaaggagtgggaaaaccaaagataattaatagtttcactcaaggtaaaaattataattttagtttccttttacaccaatgtgtgtgcctaatttgtttgcagtaatattgccatctgattattctttttctgatagaatcatggaagagtccaaagtcttctgtagatttttcatggtgaggttccaaaggaaatatttttttcctctaaaaataaaactggagctatagaaatagagtcactgggcctcttatatttctgattcatcttactgtacttggaataccaacattttgattttgttattactttttaaattgtcttcaaatctaagcaacctagcaatgatatttcaagagataaacatttcatttgttgttagaataaaaatcattaaaaaaattcatacatgtattatccaacagatattaattgagcattgttctaagcactgtggattgaatagtgaacataagtttctgcccttatggatcttaaataccagtgctctaattgagagtgatgggcaaaaaataattatataatgtcagatagaaataagtgccatgaaggaaaacaaaagcaagataaagggatggcattaaatgtggcactttagttgatagccagaaatggtctttctatggaggtggatgatattcgagtaaaaccttgcaagtacagtaagaccctacttgatatagtcaatagattcttggaaactgcaactttatgcaacatgaactacaggaggtccttgaataacatcattttgttcaaggtagtttcattataatgttgatgagaaaaaaaaggttttgttatacattgccatttcacttaacattgcagtttccaagagcctatcaatgatgttcagtgaagacataactgtacaaatagcaaaagcattccaggcaaagggacagtgtgtgaagagcccctaaagagtggggatgcttggtggttcaagaaacagcaaggaaatcagtgtgtgtggagtgaacaagatagagattggcaggtgtggaaggttgggtcctccaggagtagatactgagacagtcatcataacaagtttgacactttggcccattataatgtaaaaatgatcaggtagagaggaatggcaaataaataaatttgaaaaaatattttgctaatttacagtagatatgatgctgaacaaaataataagtattttattaatgtgatcacaacatatttttatcttcattttttatttttatatttttgaaggtaataagagatttgtgatgaattcagaaaatgtctactataatttttgatacagaaagaaattaatatttcctcaagtttctgagttgtgtaaattgtatttctttttcagatgatattgaaaaacaccagagtgatgcaggtttatatgtaattgtgccagtaattatttcctcttccatcttattgcttggaacattattaatatcacaccaaaggtattgtacttgaggttaagaatctttacggcaaaagtccttacgcgtattcaaaccctgatttaaaaccttctaaattaggaatattaaagtcttctaagtgcttttatatgtagtctgtatacaattaagatagcataaaaaggaaaggcctgttgtgaggaaatggcattccattttgctaggactgtaagagttaaagaatgaggaaagaaacacgaaacacagcttaacagttaaagacaggttttctttagataaaacctgaggggcttctggccaattttgttcaggagcccctttctcttacagactaagagtatgtattggttttagggtgagggggcttatcacaagcttggaatgtttatgtgtgagggagaagtttatggcggggttggaatgtctctgggaggaggggaggttatcttggggctgacatctttccagctggatggggagggttatcttggggctggcatgtgcctggtcagggaggatggaatgtttctggttggagatgttatttgtggtttatggtaatgctgaccttagccattaggctgatgccctttggatttaggtggtttttgattaaggggaattttaatatgaggtgcttgtccatgatggtgatgctcctgctctgtcaaggacaacataacttcaaggaagaatttagttttttaaaaaaaatgtacatacattcaggaaacaacaagcttataacaggaaatcctaagcagtatgttcttggaggtggcaaaaatggctttcagagttctgcagtttgggttaaggacgttttgtggtgaagtgggtggtaaaagtagccttttagtggtgacctggagcagtcagttcatttatgatcagcaggcactctgctttttagagatcagcactgtgtggctccagtctgcttggcttgtcaggcaaatgcctgagttccgtggatggtggcatgggtgccatgatactctctgtgctgagaagtccagtgtggttattttacacatgccaaatctctgtagaaaccatcgtcttcaggcaaaaaagagagagaggagattttagaatctgaatttatcttgtagttaagtgagttgatggggccacatcaaatggaattttttctggtacccactttgtgaccatttttaatatttcaatttctttgagagaaatctatccagtgtttagcatggtgcttggcacacagctttcaataagtattggctatttctattattacagtgattttcagcttgggtctagataaaagtttggtagaaatcttcatgggctagcatgtgaaaatgcatctgaccctacggaggcatagttgatctggtggactaatttctagcttgtctgttcactaactgttcacattttcaatatggatgtttttctctaattttgatgccctgtttatcctttgtagaatgaaaaagctattttgggaagatgttccgaaccccaagaattgttcctgggcacaaggacttaattttcagaaggttgctttttcaattttttttaacccagaatatatacgattgcaatctagacgccatatgacttatagagcattaagcatttttaagatttaaaaggtcatattttattcaattcatcttaatatatctgttattatatactttcaagaatagcaggatgcagggatttgaaatcaggaagaaacaaatttcagcgcatagtttatcgtatgagagttcacaatatacatatgttgcttctgtgtcacagtacataataaaataaatattagaaagttaagggtcaatctgatggagaacagatatttggatacactttttttggtataaactgtatttaggcaaaaggctggaatcaatatttttaatgtctataattatctccataattatttaaataaattagaaaattatataatcctcaaacattacaatctgaaaaatgcagtgatcataataaaacttatatttatgcagaagttccattcaagtacaagtactttatgagagttagtcaactataataaaataatttgtatttacttctatagtaggatttttcagaaagctctaaatttagtgactgttttattaattctcataatgtcccttgaagcaaagctagctttccactcataaaactggaaaaatagaattcagtcaagtcaaaatatacagatttttaaacaatacttatttggaggttattatccaggtttggtgattgcatctttatcattagtcacttgttaaaagttttcaatggtttccttttgaatacaagatataaactaaagccccctgaagctattaatagtactcaaggacctctttctacaatctgttatcaacctacctatacgactttttctatccctgggccttgatgatacctttactgttcccatccaccttcacagagccttccttgtacatgaagatcttgctctaggcccttctttcctcaagccttcctttaaccagtgtaattcaaaagaatttctaccccctttaagttcctagatcattgtactgtttttttaattgtggatagtgctctgaattcaaagactgtattttatccatcacaaatatttgtagtactcctcctgctgttctttatgtgcaaagcactgagatacatattcttacatttattaagatttttacttacattctcaatgtttcagtttcctcttctgtgaaataggctgcttaccttattaggttgtttgcgggactaaagaagatggtacttgtgacatagtaaggtctcaacaaatattaattattattgtacatatttatgtattttatattactattattattctttcagttaccctatgggacaagtgttattctctctattttgcaaaagagaaagctgaagctcatagtggttcggtaacttgttttagaggcaagattagcttaccagtttgtctggctttggagcctgttctaatagcagctgttctctatagcagtggcttctttttctttctttcttcttcgccatgacccacagtgaaaaaaacttaggttggtgcaaaagtaattgcagttttggcatttttaatgtataaatacgttttaccttccaacctagtacaccatagatacagatatgcaagaccgaaatgaaagatacgcaaagcagctttacttcttgcttgaaatagaatgttttaaaattctattttatttgttaaaaatgctggttgcaagacactaaattgatttcacaacattcgaatggcctatgatttgcagttagaaaaacactgttctacagcttatcaatgaataagtaaacaactaatattgtagacataatgaacaaagaaaaagattgaattgtaatttttcagcaggagaaagaatgccctgtcttcagaagcagcagtagtgttgttttatatacgaacaattctttttatagaaacttcgctttgcctgagtctaatcagccacactcctatatactcctcacctgtgctgttgctcactaagccagagtcttctttcattaaaacagtgttgccgagtttttcaagtaaatattttttctctcatttatcttttactaagaatttatacagtgacattttgtgtagttgtgatgatatttcagagagagatatatatatgtcgttcattcatttgttcaacaagcacatggtgagtatttatatgtaaggcttggctgttgctagggtctgggagaacagatttttcttaccatatgagaaataagacagtgaggtcagagaagagtggctgggttgaaagtagaataggaagagcttgtctccttttgcctctctaaaatagttcttttctattcatttcatccatatattcaatatgattgaatacttaccctataccagtcactatagtatgccctggcattataaggataagaaaaacactatgtgctcctgagtatacagtttaatggggatgataatcattaatacatttatcatggaaatagcattactttttttttgtacaaatttatggggcacatgagaaattttgttacatgtatataacatataatgatccaatcacaaccttatagttgtaaactacatgttgtgaaagaaggggttccattgtgctgagcgcttataatgtgggaacctggcttagtgtatccgtgggggtgagtggataaagttaagcaaattacatttgggccaagatctggtagatgaacaatcattaactaggttttgaggcagagatgtggtgtccagctaagtacctgcaaacactaagtcatgtggaaggcagtacctagcatattcacaaactggaaataggaagactataagactttttcttaaatatgagggttttatgtcaaaaaacctatatacttatctaagtaaaattgccaaattttcagtatataggtatatattaattcagggaatgatcatcttactttttaatgtcacttaaaaagaggctgaaacactctctcttcagcatttaagctctgaaatcttacctatggaccaccatgaagtggtttctcagtgttcaggagggccatgaaatgatcaggcccacatcagcaaaatgcagtttaaacctgcagcaaattatttttcccttttccagaaaatgcctggcacaaaggaactactgggtggaggttggttgacttaggaaatgcttgtagactacgtcctacctcgctgccgcacctgctctccctgaggtgtgcacaatg

SEQ ID NO: 95 - DNA, 104724 bp, Homo sapiens
accttgggcgaggagttcggagcggccccatcgcagagcccacggccagccgagcgcgcgcgacgcaggtgcccgagccccggcgccgccgccatctctgccttcggtcgagttggacccccggatcaaggtgggacctgcttccctctccgacaccccctattgccacctcttcccgctctgggtaactcgagaatggggctttgggacgcgcgtggcagacgcggagccccgcgggccgcttagggactgggagtccggggcagcttagcgggaccaccagaggggccagcgcccggcgggcggcgggggtggggtgggtgcgacgccgggcgactctcggctcccgtggggcgaggaagatctggacacacggctgacagcagccggcagcgcctggagcgaacctgctcgggaccaccgagagagcatgccacccggccaacttcttttccaggcttcgtgcctactttggaaactgaagggactgccacctaaaacagtaaaccctggggtcctgaagagaatttgctggttcgaatgacaagagaaaaaataattgttctgtagggatggtttagacctcagcttttgtttcccacctccccccttccctgcaagcaaattaaacaacaacagtagcagcatcagcagcaaaaccccaaacccaatcctaaccaaaccacttactgaaagagatttgtagtggtgagaaaaagagacccaactgaggaatcatttgggaaccgcaggtatggtgccatttaaaaactggttctttctggtgttatttctagaacttgtgtttgcaaacagattagaattctgggctcttgtcagcctaatggagttctttatactgaagggtggcctggggtgtcctctgttaacatttatttctgtaagtattaaagtatattgaaacaaataccctttcacggctctggaattggaatcagaaaatctgagttttggtgtgatttccattttattacctatgacactgtggttcgtttaacctcagtgggcctcagtttcctcattttttcaagttggagggttggattaagataatttctgagggccttttgagaatatctaaggtatgccccagaataaaaaagtataattccttaactctctttaacttgttacaaacattgctagtttcataatttcatgaaataaaaacaatctgtattaatcttggcactagtttatatgcatttatgacttaggcttttaggattttcccaccaaaaggtatagagaaaaacatgtataaagagctcagaaacatatagatttatatgaatatttacacctctcatactaccttaaataatctttaagccagtatttgcaacactgcaacaaaaatacatggctttagcatagcacgtattctctttaagtattgtacatctggaggaaataaaaatgtgtttgaaggaaaacaaacattgcacctttcctatcaattattgttcttgaacagtgctggctactttttagcataaagttgtgggcagaatgttaaaaaattggtttcaggtcacttctgagccgctgtgaaattaagcacaatagcagagatgccaattttagtaatgcagttagttgccttggaatgaatcccagaaaatagcagagattaactaaacagataaaccagaaattaggaatggacacacgcacacacaaaagtgtctacagtgagtatgtactgtgaagggttagtgtacttcatactttctttttgattagaagaaaatgtcgggttgttttagcagacagagaatgttacagtagcttttgttgctacttctaatgttttatcagtagcattttcaagattatttgaaacttagttatcactagtaaggacaggtttaagaatatttctgcctcttttcggtggcttggattcaaaataataaaacaatcttttctcacccacatgtactttgtatgcagtttgggagagtgaaatggatttgaagtactcttttatgagtacattttaacttattttcagtgactttttgcctttgggctggaaatgtcgtaagttactcaggcatttatcttccctcatattctctggtgaagtagagatagtcatctccgttgaaacagatgctcagagatgtaagtaaattgcttgttgagtgaacagggaatcgtagaactcaaatataccctggttgctaagtcatttggaaaacaactgaaactggatggatccaacagctcacggtccacagccaactcattcatggcttgggagtgtcatcatgggtggcagaggctctgttcctcctttgtaatgtggggacttactctctcagcaatttactgagaaaaaagtaatctcttcacacttagatcactattataggaacaaatggtgtgtatttgtgaagtgcaatatttctgggaggtcttggaaataaatactaaaagtatccagaaaaaaaaaaaaaagaactctcttggcagatattgtactgcatttttcatactgagagccaaacacacccacttaaagagtatgtcctgtggagttaaaaatgaagaaaaaggcttatagtctgctctaattcttaagactttatgtgatttacaaattccagttttaattaaattagaaagttgcaaatgttcacctactggccacactcagtatgtacaaccttttggagttgctcttcaaatacgatctgcttatagtttggaatattccttctcaaacatgttttttggagtcttgctatgttgcccaggctgatttaatactttttgtgacttaatagtgatattacctgttatcatcacacataatcttattaatatttaaaatattttaaaactacaaatcttatataaatataaataaaatctttaaaacatttgaactgtaatgaatatagagagaagcatataaaacaaatttaatggttgacagataatatgataaatcattataataattgtaaggcaaatttctcattattcaccacccccaaaaaaagaacattgcaaatatcccaaaacttcttgtttgttccttcttcatcacaaatctaatttacctttttttaaaaaaagaaagttatttacttatttattttgagacggtgtcttgctctgtcgcccaggttggagtgcaatggctcgatcccagctcactgcaacctccgcctcccaggttcaagcgattctcctgcctcagcctcccaagtatctgggattacaggcgtgtgcctccacacctggctattttttttttttttttgtatttttagtagagatggggtttcaccgtgttagccaggatggtctcaatctcctgacctcatgatctgcccacttcggcctcccaaagtgctgggattacaggtgtgagccatcatgcctggcccaaaaaaagttttatatgattatggtaggcattaaatcatagattattttgcttaacattatgtttatgagattaagggatttcttctctctcctttaaaacaatattttttgaaagagttatctcggctgggcatggtgcctcacgcctgtaatcctagcattttcggaggctgagacgggtggatcacaaggtcaggagttcaagaccagcttggccaagatggtgaaatcccatctctactaaaaatataaaaaaatttatccagacctggtggcaggcgcctgtaatcccagctactccggaggctgaggcagagaattgcttgaacctgggagacggaggttgcagtgagccaagatcgcaccactgcactccagcctgggagacgagtgagactctgtctcaaaaagaaaaagaaaggaaggaagggaggaagggagggagggagggagggagggaggattgtctctattccctgtctccaattattctcttcacactgttaaaaaaaactcattcctattaatcttgttttcaatattctgctaaaactacgtcaaggtctactactgtcaagttcaccaatgatactacctttgctcatccagtagtcagttgtcagtgttcattttacttcactactggtagcattgtcacggttattactctgctccttgaaacagtcccttactgacttccaggacaccatgcattcttgattttcctccttcttcactggctgctcctttctgtctcctgtgctagcctctcctcttttcttagaggttttaaccttggaataccttaaggtttagctcttttttctccatgctttttgatgatttcatgcaatctctctatgtgtgtgtgttgatgattccgaaagtgatagctcaagccttgactgctccctctggacttcagatctttatattccagctgtctactgagcatttccatttggatgtctagtaggcatctccagttcaaattctccacatggaatcttcatctttcccaaacctgcactatctgcagtcttcctcatctccatctttcaagttagttaggccccaaaccttggagtcatcttcgattcctcctattctctcatacctcgtttgtaatgtgttggggaattctctgtgctctatcttcaaaacaaatccagaatataatgacttctcattacttccatggctctgttacaggaaaggggtcccaatccagaccccaagagagggttcttggatctcatgcaagaaagaattcagggcaattaggtagagtaaagtgaaaacaagtttatttggaaagtgaaggaataaaagaatggctactccatagagcagccccaaggtctgctggttgcccatttttatggctatttcttgatgatatgctgaacacggggtggattattcatgcctcccctttttagaccatattgggtaacttcctgacattgccatggcatttgtaaactttcatggcgctggtgggagtgtagtagtggggacaaccagacgtcactctcgtcatcatcttgattttggtgggttttggccatcttttttactgcaacctgttttatcagcaagatctttatgacctgtatcttgtcctgacctcctatctcatcctgtgacttagaatgtcttaactgtttgggaatgcagcccagtaggtctcagcctcattttacccagcccctactcaagatggagttgctctggttcagacgcctctgacagctcccaccctagtacaaggtgccatcaactctcacgtgagttattgcaaggacctccaaactggtctccctgcttttattttttgccctcttcaatacattctcaaaatagcaatcagagcactccttttataatgcatgtcggatcatgtcacttttctcctccaaactctccatggatttctggttcacacagagtaaaaaccaaagtccttaggataacctccaaggccctacctgatcattctgcttgccactttacctgtctggtctcatttcctactgttcttcctttcactttactcagttccagccacactgggctccttgctatttcttgactatattagaaaccatcttttcattttagcttttcctgccttgaatgcttgtcctccagatttccacatggttcgctttgttactgtcacttcttttaagtcttcgttcaaatgtctccttttcaatgaggcctactctgattacagtatttaaaattccatatcttcttaccttgtaatatattctttttcctttcctttcctttcctttcctcctttcctttcctttcctctcttctcctctcctctcctttgtgtctccctatagcattattttaccttataaaatactgtgtgactttctaattatcttttttttttctgtcccatttccactagaatgtgaactccacaagggcagaattttgtcctgttttgctcactgttgtgtccctagtgtgtgaaatagggcctaacatgtaagaggtgctcaatgctttttttggtgattgaatgctattgtttgttcatttttattcctggatatattcaattctataaatataacacgttaatttaaaacatgaattctgattatgcacatttagtttccttcctttcttcttccctcacccatcacttcttccttcctgccttcctcccttccttcttttttgccactataaataaagcagctatgatccatctacaagtgtgctagtatacgaagtttctttagagcgtaaaaccaatagacaaattacgggctagcaggacttgcagacttcaactttattagataatgaatgccacacatttttagtgtggattcaccaatttgcattcctgtttttattgctctacaccagatggacaaacttcgtattgccagaacatttaatttttcgccatctgatgggtattatctcattaatagttactactttaattactggtgagattaagcctggtgtctgtgaggataggttaggttatgctgcagtaacagataatcttcaaatctcatgggcttaatgcagttcttcactgatgcaaagtctcctatggactaagacaactctctggggcaacttctccatgtaataacttggaggtctaagttcagggaaactccatcattctgtaactgtaacaatctggaacatggaactttcccatttggtgtggtaggggaaaagacagcagggatggatactcgtgagccatcttcaaatgcttccatctgaaagtgacatgaattattttcaaatgctaaacgtaagtgtttaagatagtcatatggtaatatgacccagtaattctattcctaggcatatacctaagatggatgaaaatatacatccacacaaaaagttgtacagaagtgtcagtggcaacattcttcataataaccaaaaaacagaaactgcccaaatgtccatacactgatgaatggataaacaaactgaggtatatccatacaatggaatattattaggcaataaaagggaatgaagtgctgataaatgcttcaacacgatgatccttgaaaacatgatgctaacagaaggaagccagttactaaagaccccaggattttatttatatgaactgtccagaataggcaagtccataaacacagaaagcagatcagtggttgccggggatggaggaagctggtgaaaggggagcgactgctaatgaggaagaggtgcattgtggggtgatgataatattttgaaattagacagtggtgatgattgctctgttagatacattcactcaatgtactaaacctagtgaattgtatgctataaaagagtgaactttatgatatatgaataatagaccaataaaactgatattttaaaaaatactttaaaaataaagtatatttctatatgccatcaagaaacagaaaatgaaatattttagaaatgcatcatttaaaatgattccaaaaacatgaagttcctgtgaaaaacatctaacaagatgttcagggacttttatggaaaaaattagatgagatttacatctcatattagggaagaactcagtatatggagacagatagtcatacattttaggactgaatgattaaaggatatcaatttccttttcattgttatagactcaaaacagtctcaataggatctctattaaattcctaacaatttttttagaacttgacaagctgattctaagatgtatatggaaagtcaaaacccaaagaatgctaaagcactcttgaaaaagatgcaaaatgggagaatttgtgctatcggatagcaagactcgttttaaatctgtagtaatcaagacaatgtttctttattatttctttttcccttctactttctttgattttttctgttctaactgcttaagtgaatgttcgattaaatgttttattctaacagattataaaggaatgatagcacattaattttcagcctttcttctttttgaaaagtattatttatggctttgagctgccttctacatacttctttatctgtgtgaaataaattttgagatactgttttcactaagatcagtttaaaataggttctgattttcatatttctttttgcccagttattaacttaaaagtatttttctggttaattgaaactttagtcaatttggagtaagcttcttgatttctaatgtttctttttgcattaaagcctattttgtatgatattgatataactccaccagctttcttttgttccgtatgtgcatgttaaatcttttttccatcctttgctttcagatttctacatacttattttaaatgtgtctctgtatcctatatcatttttctgtcattctgcattcaacctttctatattcttatgttttagatgtgtctgtagtaaacagcatttatttcttaaggtattttaaattcaatgtctttccactggagaattttgtcagtttacatttaatacaattactgatatattgaggcttgtatttactttctgctttctttatttgcccataattctggttattttcttttttattgccacattttaggttgattatttttatcacttcaaattttctttcattactttaagagttatacactctatttctattgttcagtaactactgtggaagttaccatatgaatccttaagttatcgaagttgaaaatgaatacactttgagcactaatgagtacaggaaaatacagaggccttagcttactttaacttcatttaatactctcttgccatatattgtgagcatcttgaattccatttatttattcaaatatttattgagagcttactcggggctaagcattattctagatactgaacaaaatagatgagcatccctgtgcttgtaagacataacagagtgcaaacaataaacttaatagagtaaattataccatatactagaaggtagtaagtatatggaaaaaaaactagagcaaggcgaaagagattaggagtgccgagagagggagaaagagaatgaatgagagtgagtgcacataagtacaagtgaaagtgagtgagtgtgccctagctttggaccaatactgtctataaagtttgtggggacatataaatgttttatctattttcactagataacagctgaaaggtttgagccaaatagagagtctcaggtgcttctataatggtattataataggctttaaaaacgtgaaaaactcatgtttaagaacagctgttaccaactatctgttttgtgagggtggaggacaacttagtttttctcagaattaattatactttcttattgtaactttagccgctgttatttgggtctctaaacctatacaaattaagaagctatgaacatgagagaatcaaacaattagatttctgtgcacaccaacagaatttctgaaccaaagtggtttgtgtttaggagatgaaagagatgataaatcatacacacacacatagataaacacacatattatatgcatgtgtgtgcatgtgtgtgtgtgtataaacacagagagaaaacatactggcatacacataagcacctgttaattgtagttgctgttatagtagtaagatgttatctcttagaattatggtatacttatcatattagacctatccaggaggtagctgggtatctagtgtggtgatactatctagtgtggtgtcttgcaacaacactgctagtcataggtctgatttgggggagaaaatatttttttaagacagtgtctcgctctatcacccaggctgaagtgcagtggcatgatcatagctcattgcagcctcagtctctgggttcaagctaccctcctgcctcagtgtccccactgcatgctaccacacctggctaattttttcaaatttttagtagggacgaagtcttgctatgttacacagggtggtctcaaactcctgaactcaagtgatcctcccgctttggcctcccaaagcgcagggattacaggtgtggaccatcgtgccaggctgggagaaaagttttgttgacacaacaaacaggatgcaaagaaacaatctataaaaacagtaatttaggtaagtggcttcttggtcttttgattaataggattctaaacttgcaaatcaattcttatgcaggagttcttattggcatttaccgatgctctttggctgatgtttgtttttactgaccagaggttctgtgggaatctcatttattaatacttacaatgtgcttcatattcctctgcatctttgagggacaattaaatgtccactctatggaatcttttataatttcccaatcataagtaattactctgatttctcctaattacccttttttctaggtagttgtgattctttaagtctaagacagcatggatttttaagctacaccactgatatagtttggataatagtcccctccaaatctcatgttgaaacttgattcccagtgttagaggtgagtcctgaagtgggaggtgtttaggtcatggagcagatccccaaagagtggcttggtgacatcatcacagtaatgagcatgttcttactctattagttcctgtgagcactgatttttaaaaagagcttggcttgtccctcctctctcttgcttccatgctgtcactatgtgatctctgcatgctggcttcctttcccctctcctttgcctgcactatgagtggaagcaactcgaggccctcaccagatgcagtacaggtgccggtgccatgcttcttgtatcgcctgtggaaccatgagccaagaaaccttttttcttcataaattacccagtctcaggttttcctttgttacaacatgaatgaattaagataaccatcatttttgtatcagtaaaaagaaaaagctctgcgtatttaactattatacagtattttttatcatttaaaaatttatacttattcagatagctcactaagaattatatatataaacatttttatttaaatcatgccattctcataaggaaagtataaatcaaagatttcggttaagggattcttattcatattcaaagtctgtttttttcaagttgcttttcatctcagaactgttgatgtaaatattttcccaaacagtatcatactctgggctatcaagaatatttgtgatacagcaattcaaaaaagaatgcctcactattgtttctgggattttcttccaagctggttcattttgctaattttgatgcggcttttaactgatcttgtaagatgtcaatatcgggttttttggagttcatattctttcctcaaatggtctttaaatagtttgttgaccaaaatattgataggttaaaattgtccagttggtcattaagaaagtgtccagttttgatgtatgcaatcaataacaaccagatcacagctgctaccaggccatcgggaattgtaagatgctataaatttaaacaatgatgctgatgccagaggtgttaaaatgttgtgaatcttaaaacagaagacatacaatactactctcttcctttgtatttcctgtagttcaactaaaaatctcacctttcgttggcccctaggactttgtgagtagctattttctctgaaatcccatagtactttatttaatgaaaggaactaagtaataatttggggtgaaaataatccatgtacatggttaaaaaaaacttacttatgtataaaccagtagccctctgctctactacctacactaaagggtataacctgaccctaggaacaactagtttgaaccatttctggttttagtccttcttcctctagggctaaattgtatgtttatactgtctgcttttctttttttttcatttatcatttaagcagataccatagtagaagataatttagcctactcatttcacctccttttcttttttgctcctccacatatattaattttatgagctcctttattggttacatttgtcatttccaccacgatatttgttccattaactacagacagtttctcttgaacccctgcttcatgagtttgggatatttcaccctttctcctctcaccatctctccttgtatattataacacctaaatctgacaactgtgtggtgagagtattgataatattttaggtttagtatttgttattaaattttgtatttttgtctattggttgaccctaaaagttgaaaaattaataaatagcattaaagttattatgaccctgtaaatgttgtttactgcagaatcaagaagtattctacagttacatttcattcagtatggctcctgagccacccaaagaatgttcctagaatcaaagttaaggagattctttctttcaaatggattatttaattctagcatttgctaaaaatttgccatattttcttttcattcatatttacattgtgaatttctgtgacgctttttcaaattacctttattttttcttattgggaaagcatatgtgggccttcctggtttcatccttaataattttcagctttttactttctttatttttttgaatgcattttcttccttttttttttgaagtccactgactcatattctagtggcttcaattttgaattatgacttcctttttccctggtgtttattctgtttttattttattttcaagtttttttctggcttcaggattatattatgtgtcaggttgccttccatctccaccttcctccttgccatctccttttgggggccatctatactacagctgctatctggactagtcatttgaaagtttgcagagccagcaaacttgtttgtaaccacgatttcctgaatgtgtatgtttttgtcgtttttggttttctcctcattttgctggaatactttataaaattacttctggcaaataaatttatactatataaattttgtaagccattacattactaaaagtatatttgtttctctcggatacttctttgactggatgtaaaattctaaactgaaaagaattttctataagtcagttgctggattattttctagtattcggtgttttgggatgaaacatttgttttccattctctttcttactcctttagtgatttttttcttctctggaatcttttcttatattctttttttctttgttgtttggtaatttcttaattatatgtttaggaatgaatctgtttccattcttctttcttggagcctggtagccatatttttcactttgaacacttgtgccttttatctctgggaaatgtgccttttatctcttgtgccttttatctctggaaacacttgtgccttttatcgctgggaaattttcttgtattttttttgtgtgattattttctcctttctattctttttttctggaagtactgttggttggatttgggtctcttggatttatttttaagtgacttctttttcttaaacatttatttcctggttttttttttttgcctttggggggaaatgttaattatgcattttttttaaaaccattgaaattttttttttgtactatgcatgtaattttcaaaagctctttcttgctctcattattcctttgttattttatggatccaaaactttctgaaatgtctctgccaatactcattaaagatttgttaaagcttttttttttttctttaatttatccctgtgtccctggtggttagtttcctttttactttctttttataaaagaaaaatttaacacaatgctaaagactttcttcatgtctttgtgtctccattcagcatggctgttaaatgaagaaacaggaagaatgtgacttctgtgcatatgggcagtgttttatcaactgataggcttcatgttaggcactcaatcaaagagctgccatttatgctaaaggcctgttgcctaaatgtcagggctttaccataccggtgccaagtttacatgaaaagctcaagttctcaaacaacttgtactttttcctcctttaacacataggagtgtatactataatttttaaattgtctttggccatttgacacctttgaatactttgctcgtgtttgaggaatttccacttaataagcccctgttttcccaagcttcctggcagtctgcctgtagagtgtgaagtaggctccatcagttagaggcatttgtgccagattttagatcagaagtgtgggacatgaaagggcagatgagctccccggagctcagaggtagtaggcattgaggtttcagtcataacatgcagtatcctggtatggtgcagggctgtcttctctagagcaattctgcatgggattttgggtgtggtcttggctgtgtgcttttctagcttggttctctggcactcactgaggttcggagagctacccagtaaactttaataaatttctttcctgcttagactagtcaaagttcatttcagttgtttgttagtcactctcctgacagttacatggagctagtttagctgctgtgcaatgtttgtgaggaggtgaattacatacgcagatattacatgtgcagaccaaaatggcctctccttttagccccacctcaccctcctgcccttatcatttagaacatctgcaggtttgttttctcattgttgacagcctattctccaaatatcctatgtagttactacctttgttatacctcattagtctttgctaattgatatggtttggatatttgtcccctccaaatctcacgttgaaatgtaatctccagtgttggtggtggggcctggtgggagatatttgggtcatggggtgggtccctcacgaatggcttggtgccctccctgtggtaatgagtgagttcttgctctgagttcatgcaagatctggttgttaaaggagcctggcatcttcttccaccctctcttgctcccccttgccatgtgatgcacctgctccccattcactttccaccatgactgtaagcttcttgaggccctcaccagaagcagatgctggcctcatgcttcctttatagtctacaggaccatgaaccaaaataaaacacttttctttataaattacccagtctcagatattcctttttaacaatgcaagaatggactaacacactaatgttttagaaatttgtttttctcttttgctgctgatcgctctctcattcactcttgtagtgggttgatattatttactttactataattttcaaggtatctcaggagggaaagatcagtttgttcagtttaccatttttttttgagacagcatctcactctgtcacccaggctagagtacaatggtgcaattttggctcactgtaatctctgcctttcaggctcaagcgattctcatgcctcagcctcttgagtagctgggattacaggcatacgccaccatgcatggctaatttttatatttttagtagagatggggtttttccaggctggtctcgaactcctggcctcaagtgatccgcctgccttggggttccagagtgctgggattacaagcatgagccaccgtgcctagtcccagtttaccatcttgaacctgaagtcccactggtattatcgtgctttgacatgtaaaaaaattaataaaatgttatttcttaaagtaaataaattttaattattttctacatttctagcatcacatgtggtagcttgcattttattgaatatctggttaatatttaaatgagtcaatttatgtagagcttttagattacaccgtaggtaagatgcctactctgactcaactttgttgactttatggtacccacatctgtgaatcatagcttatccttatgcattttttaggaattaatatgtgacaagttcacacagagtaatatcaggaattaaagtacttgaaattatgttttccaagtgacaaatatttatgccaggatgttggaaggttttttttttaattaaaaaataatttaagtctttaacagctacttgatgggaataacatgaccaatttatattccaagtgaataaataaaagttaacatacttaaaatgacaaggctactggaaatagatcaggctatatttattttgttaaatttttgatacttgaagaaatagtgtttttcagttgcatttaaattaaatgtttaaatgcttatttaagtgagagatagacagatgcttctctaacaaaaagtaaaagcaaaaattagtggcatttggagctcattgagttaactcatcaaagcaacattattgtcagaattgcttttcttactcataaactttcctacacactcagagattttttgagatcaatggagcaagttgtaaataattttatttctgctcaaacactgattgagactgttctgttttatatttaagtagaatttgataggtaaaaataacacaaataatcctttacaatagaaattaaacagtctgatcttcctttgaaagcccaaattatgcttattcagtagaatatagatttggattttttcttcatagtaataactgaagagtaagcatgattaatatgcttactgtgctgggcatattatgcaaattaaattactgcttgcatacccatacatcatggatgtatcatttagatcagactgtggatttgtctttgtatactttatacagatttcttcaaatatttgtatatttcaacataggcttttttttcttttcatttctttctaaattcctaagggctgtttttctttttaaacgtgagaataaatatctacattaattatttattatatactttaattgattcaacaactatttatgagtacttacgatgttccagagaatatattaaaatacttgtttttcagaagtctaatatggatgagaaacattgtgcctattctttttttttttttaaattgtactttaagttctgtgatacatgtgcagaatgtgcaggtttgttacataggtatacacatgccacggtggtttgctgcacccatcaacccgtcacctacattagatatttctcctggtgctatccctcccctagccagccaccccccgacaggccctggtgtgtgatgtttctctccctgtgtccatgtgttctcattgttcaactcccacttgtgagtgagaacatgcagtgtttggttttctgttcctgtgttagtttgctgagaatgatggtttccagcttcattcatgtccctgcaaaggatatgaactcatccttttttatggctgcatagtattccatggtgtatatgtgccacattttctttatccagtctatcattgatggccatttgggttggttccaagtctttgctgttgtgaatagtgctgcaataaacatgtgtgcatgtgtctttatagtagaatgatttataatcctttgggtatatacccagtaatgggattgctgggtcaaatggtatttctggttctagatccctgaagaattgtcatactgtcttccacaatggttgaactaatttacactcccaccaacagtgtaaaagcgttcctatttctccgcatcctctccagcatcttttgtttcctgaatttttaatgatcgccattctaactgacatcagatggtatctcattgttgttttgatttgcatttctcaaatgaccagtgatgatgagcttttttttcatatgtttgttggacacataaatgtcttcttctgagtagtgtctgttcatatcctttgcccaccttttgatggggttgtttgtttttttcttataaatttgtttaagttctttgtagattctggatattagccctttgtcagatggttagattgcaaaaattttctcctattccgtaggttgcctgttcactgtgatgatagtttcttttgctgtgcagaagctgagctgtttagtttaattatatcccatttgtcaattttggcttttgttgccattgcttttgatgttttagtcatgaagactttgctcatgcctatgccctgaatggtgttgcctaggttttcttctagggcttttatgggtttaggtcttacatttaagtctttaatccatcttgagttaatttttgtataagttgtaaagaaggggtccagtctcagttttctgcatatggctagccagctttcccaacaccatttattaaatagggaatcctttccccattgcttgtttttgtcaggattgtcaaagatcagatggttgtagatgtgtggcattatttctgaggcctcttttggttccattggcctatatatctgttttggtacagtaccatgctgtcttggttactgtagccttgtagtatagtttgaagtcagttagtgtgatgcctccagttttgttctttttgcttaggattgtcttggctgtgcaggctctcttttggttccatatgaaatttaaagtagtttttaaaattctttaaagaaagtcaatggtggcttgatggggatagcactgaatctataaattactttgggcagtatagctgttttcacaatattgattcttcctatccatgtgcatggaatgtttttccatttgtttgtgtcctctcttatttccttgagaagtggtttgtagttttccttgaagaggtcattaggtattttattctctttgtagcaattgtgaatgggagttcactcatgatttggtgctctgtttgcctattattggtgtataggaatgcttgtgattttcacacattgattttgtatcctgagactttgctgaagttgcttatcagcttaaggagattttgggctgagacgatggggttttctaaatacacaatcatgtcctctgcaaacagagacaatttgatttcctctcttcctatttgaatacccttaatttctttctcttgcctgatttccctggctagaacttccaatactatgttgaacaggagtggtgagagagggcattcttgtcttgtgccagttttcaaagggaatgcttccagcttttgcccattcagtatgatattggctatgggtcataaatagctcttattatttttagatatgttccatcaatacctagtttattgagcgtttttagcatgaagcagtgttgaatattatcgaaggccttttctgcatctattgagacaatcatgcggtttttttttgcatataaatataatagaatattattcagccttaaaacggggtgaaattttgatacgtggtacaacattgataaactttattttattttattttatttattattattattatactttaagttttagggtacatgtgcacaatgtgcaggttagttacatatgtatacatgtgccatgctggtgtgctgcacccattaactcgtcatttagcattaggtatatctcctaatgctatccctccccactccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatacacccagtaatgggatggcggggtcaaatggtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctacataaatgtcttcttttgagaagtgtctgttcatatcctttgcccactttttgatggggttgtctgtcttcttcttgtaaattagtttgagttcattgtagattctggatattagccctttgtcagatgagtagtttgtgaaaattttctcccattttgtaggttgcctgttcactctgatggtagtttctttggctgtgcagaagctctttagtttaatgagatctcatttgtcaattttggcttttgttgccattgcttttggtgttttagacatgaagtccttgcccatgcctatgtcctgagtggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcagtgttatttctgagggctctgttctattccattgatctatatctctgttttggtaccagtaccgtgctgttttggttactgtagccttgtagtatagtttgaagtcaggtagagtgatgcctccagctttgttcttttggcttaggattgacttggcgatgcgggctcttttttggttccatgtgaactttaaagtagttttttccaattctgtgaagaaagtcattggcagcttgatgcggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagctggattcctaagtattttattctctttgaagcaattttgaatgggagttcactcatgatttggctctctgtttgtctgttattggtgtataagaatgcttgcgatttttgtacattgattttgtatcctgagactttgccgaagttgcttatcagcttaaggagattttgggctgagacaatggggttttctagatatacaatcatgtcatctgcaaacagggacaatttgacttcctgttttcctagttgaataccctttatttccttctcctgcctaattgtcctggccagaacttccaacactatgttgaataggagtggtgagagagggcatccctgtcttgtgccagttttcaaagggaatgcttccagtttttgcccattcagtatgatattggctgtggatttgtcatagatagctcattattttgagatatgtcccatgaatacctaatttattgagagtttttagcatgaagggttgttgaattttgtcaaaggccttttctgcatctattgagataatcatgtggtttttgtctttggttctgtttatatgctggattacatttattgatttgtgtatattgaaccagccttgcatcccagggatgaagcccacttgatcatggcggataagctttttgatgtgctgctggattcggtttgccagtattttattgaggatttttgcagcaatgttcttcaaggatattggtctaaaattctcttttttggttgtgtctctgcctggctttggtatcaggatgatgctggcctcataaaatgagttagggaggattccctctttttctattgattggagttgtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctgatttagtcttgggagagtgtatgtgtcgaggaatttatccatttcttctagattttctagtttatttgcatagaggtgtttgtagtattctctgatggtagtttgtatttctgtgagatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttacatatttcttgccttctgctggcttttgaatgtgtttgctcttgcttttctagttcttttaattgtgatgttagggtgtcaattttggatctttcctgctttctcctgtgggcatttagtgctataaatttctctctacacactgctttgaatgtgtcccagagattctggtatgttgtgtctttgttctcgttggtttcaaagaacatctttatttctgccttcatttcgttatgtacccagtagtcattcaggagcaggttgttcagttaccatgtagttgagtgtctttgagagagtttctgaatcctcagttctagtttgactgcactgtggtctgagagacagtttgttataatttctgttcttttacatttgctgaggagagctttacttccaaccatgtggtcaattttggaataggtgtggtgtggtgctgaaaaaaatgtatattctgttgatttggggtggagagttctgtagatgtctattaggtctgcttggtgcagaggtgagttcaattcctgggtatccttgttaactttctctgtcgttgatctgtctaatgttgacagtggggtgttaaagtctcccattattattgtgtgggagtctaagtctctttgtaggtcactcaggacttgctttatgaatctgggtgctcctgtattgggtgcatatatatttaagatagttagctcttcttgttgaattgatccctttaccattatgtaatggccttctttgtctcttttgatctttgttggtttaaagtctgttttatcagagactaggattgcaaccccggtctttttttgttttccatttgcttggtagatcctcctccgtccttttattttgagcctatgtgtgtctctgcatgtgagatgggtttcctgaatacagcacactgatgggtcttgactctttatccaattttccagtctgtgtcttttaattggagcatttagtccatttacatttaaagttaatatcgttatgtgtgaatttggtcctgtcattatgatgttagctggttattttgttcattagttgatgcagtttcttcctagcctcgaaggtctttacaatttggcatgattttgcagtggctggtaccagttgttcctttccatgtttagtgcttccttcaggagctctttcagggcaggcctggtggtgacaaaatctctcagcatttgcttgtctgtaaagtattttatttctccttcacttatgaagcttagtttggctggatatgaaattctgggttgaaaattcttttctttaagaatgttgaatattggtccccactctcttctggcttgtagagtttctgccgtgagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccaagttggtcactttcaggtacaccaatcagacgcagatttggtcttttcacatagtcccatatttcttggaggctttgttcgtttctttttattcttttttctctaaacttcccttctcgcttcatttcattcatttcatcttccatcactgataccctttcttccagttgatcgcattggctcctgaggcttctgcattcttcacgtagttctcgagccttggctttcagctctatcagctcctttaagcacttctctgtattggttattctagttatacatttgtctaaatttttttcaaagttttcaacttctttgcctttggtttgaatttcctcctgtagctcggagtagtttgatcgtctgaagctttcttctctcacctcgtcaaagtcattctccatccagctttgttctgttgctggtgaggaactgcgttcctttggaggaggagaggcgctctgctttttagagtttccagtttttctgctctgttttttccccatctttgtggttttatctacttttggtctttgctgatggtgatgtacagattggtttttggtgtggatgtcctttctgtttgttagttttccttttaacagacaggaccctcagctgcaggtctgttggagtttgctagaggtccactccagaccctgtttgcctgggtatcagcagcagtgtctgcagaaccgcggattttcgtgaaccgcgaatgctgctgtctgatccttcctctggaagttttgtctcagaggagtacccggccgtgggaggtgtcggtctgcccctactggggggtgcctcccagttaggctgctcgggggtcaggggtcagggacccacttgaggaggcagtctgcccgttctcaggtctccagctgcgtgctgggagaaccactgctctcttcaacgctgtcagacaggaacatttaagtctgcagaggttactgctgtctttttgtttgtctgtgccctgcccccagaggtggagcctacagaggcaggcaggcctccttgagctgtggtgggctccacccagttcgagcttcctggctgttttgtttacctaagggagcctgggccatggcgggtgcccctgccccagcctcgctgccgccttgaagtttgatctcagactgctgtgctagcaatcagcgagactccgtgggcgtaggaccctccgaaccaagtgcgggctataattctcctggtgcgccctttcctaagcctgtcggaaaagctcagtattcaggtgggagtgacccgattttccaggtgccgtctgtcacctctttccttgaccgggaaagggaactccctgaccccttgcgcttcctgagtgaggcaatgccttgccctgctttggctcgcgcacagcgcgctgcacccactgtcctgcacccactgtctggcactccctagtgagatgaacccggtacctcagatggaaatgcagaaatcacccgtcttctgcgtggctcacactgggagctgtagaccagagctgttcctattcggccaccttggctcctccccccatcatgtggtttttgtcattggttctgtttatgtgatagattatgtttattgatttgtgtatgttgaagcagccttgcatcctagagatgaagccgacttcatcgtggtggatgagctttttgatgtgctgctggattctttttgccagtattttattgaggatctttgcaccaatgttcatcagggatattggcctgaaattttctttttttgttttgtctatgccaggttttagtatcaggatgatgcgggcctcataaacgagttatggaggaatccctcttttcctgttgtttagaataatttcagaaggaatggtaccagctcctctttgtacctctggtagaattcggctgtgaatctgtctggtcctgggccttttttggttggtaggctattaattactggctcaatttcagaccctgtttttggtctattcagggatttgacttcttcctagtcttgggaggtgtatgggtctaggaatttatccatttcttctagattttctagtttatttgcatagaggtgtttatagtattttctggtggtagtttgtatttctgtgggatcagtggtgatataccctttatcattttttattgtgtctatttgattcttctctcttttcttctttattagtctggctagtggtctattttgttgatcttttcaaaaatccagctcctggattcactgagtttttgaagggtttttcgtgtctctatctccttcagttctgccctgatcttagttatttcttgtcttctgctagcttttgaatttgtctgctcttgcttctctagttcttttaattgtgatgatagggtgtcaattttagatctttcctgctttctcttgtgggcatttagtgctataaatttccctctaaacaccgctttatatatgtcccagagattctggtacgttgtgtctttgttctcactggtttcaaagaacatctttatttctgcattaatttcattatttacccagtagtcattcaggagcaggttgttcagtttccatgcagttgtgcagttctgagtgagtttcttaatcctcagttataatttgattacactgtggtctgagagacagtttgttatgatttctgttcttttgcatttgctgaggagtgttttacttccaattatgtggtcaattttagaataagcgcgatgtggtgctgagaagaatgtatattctgttgatttggggtggagagttctgtagatgcctattaggtcttcttggtccagagctgagttcaagtcctgaatatgcttgttaattttctttcttgttgatctgtctaacattgacagtggggtgctaaagtttcccactattatcatgtggcagtttaagtctctttgtaggtcattaagaacttgctttatgagtctgggtgctcctgtattgggtgcatatatttaggatagttagctcttcttgttgcattgatccctttaccattatgtcatgctcttttttgtcttttttggtctttgttggtttaaagtctgttttatcggagactaggattgcaacccctgctttttcttttttgctttccatttgcttgataaatattcctccatccctttattttgagcctatgtgtctcacatgcaaaggcatgtgagactggtctcctgaatacagcacactgatgggtcgtgactgtttttccaatttggcagtctgtgtcttttaattggggcatttagcccatttacatttaaagttaatattgttatgtgtgaatttgatcctgtcattatgatgctagctggttgttttgcccattagttgatgcagtttcttcatagtgttgatggtctttactatttggtatgtttttacagtggctggtactggtttttcctttccatgtttagtgcttccttcaggagctcttttaaggcaggcctggtggtgacagaatctctcagcatttgcttgtctgtaaaggattttatttctccttcacttatgaagcttaatttggctggatatgaaatcctgggttgaaagttcttttctttaagaatgttgaatattggcccccactctcttctggcttgtagagtttctgcagacatatccactgttagtctgatgggcttccctttgtgggtaacttgacctttctctctggctgcccttgacgttttttccttcatttcaaccttggtgaatttgacgattatatgtcttcaggttgctcttctcgaggagtatctttgtggtgttctcgtatttcttgaatttgaatgttggcctgtcttactaggttggggaagttctcctggataatatcctgcagagtgttttccaacttggttctgttctccccatcactttcaggtacaccaatcaaacataggtttggtcttttcacatagtcccatatttcttggaggcttagttcatttctttgcattctttttttttaatcttgtcttcatgctttatttcattaagttgatcttcaatctctgacatcctttcttccgcttgttcaatttggctattgatacctgtgtatgctttacaaagttctcatgctgtgtttttcagctccatcaggtcatttatgttcttctatatactggtttttctagttcgcaattcctctaaccttttttcaacattcttagcttccttgcattgggttagaacatgcttctttagctcaaaggagtttgttattacccaccttctgaagcctacttctgtcaattcatcaaactcattctgttcccttcctggtgaggagttgtgatcctttaaatgagaagcggcattctggtttttggaattttaagcctctttgtgctcgtttttcctcatcttcatggatttatctaactttggtctttgatgttggtgacctttgaatggcgtttttctgtggaatcctttttgctgatgttgatgctattcctttctgtgtgttagttttccttctaccagtcaggcccttctgctgcaggtctgatggagtttgcttgaggttcactccagaccctgtttgcctgggtatcaccagcggaggctgcagaccagcaaagattcctgcctgttcctttctctggcagcttcgtcccagaggggtacccaccagatgccagctggagctctcctgtatgaggtgtctgttgacccctgctgggaggtgtctctcagtcaagaggcagggtggttaggaacccatttgaggaggcagcctgtcctttagtaaagctgaagcgctgtgctgggggatccactgctctcttcagagccatcaggcaggaatgtttaagtctgctgaagctgtgtccacagccacattcttcccccagggagaatgctgtgtcccagggagatgggagttttatctataagcccctgactggggctgctgcctttctttcagagatgccctgcccagagaggaggaatctagagaggcagtctggctacagaggctttgtgtgcagcagtgggctccacccagttcaaacttcccagagaccttgtttacactgtgaggggaaaactgcctattcaagcctcagtaatgacggacattccttcccccaccaagcttgagtgtcccaggtcgatttctgctgtgctggcagggagaatttcaagccagtggatcttagcttgctgggctccatgggggtggtatccgctgagctagaccatttgactccctggcttcagcctttccggggaagtgaacggttctgtctgtcttgctggcattccaggcactgctggggtatgaaaaaaaaaactcctgcaactagtttggtgtctgcccaaatggctgaccacttttgtgcttgaaacccagggccctggtggtgtaggcacccgagggaatctcctggtctgtgggttgggaaggccatgggaaaagcataatatctgggccagagtgcactgtccctcacggcacagtccttcatggcttcccttggctaggggagggagtttcttgatcccttgcacttcctggatgagccaacgccccatcctgcttcagctcaccctccgtgggcggcacccactgtctaaccagtaggaatgagatgagccgggtacctcagttggaaatgcagaaatcacctgcctcctgcgttgatctccctgggagctacagaccagagctgttcctattcagccatcttgccagccacccccgcctgttctttttttgtgttcttcttgctaaatttatttagcatgagaacagcaatagcatgttctcacataagaagctgactaacagaatgcacagcatataaaaaatgtgctatttgtatagaaataatttgtcaacttcagcaatcagtttgagacccacatatcacctggatgaatggttctcctgcagaatctgattcagaggaaagagtcatgtggtgcggtgacttgaaagagctgtggtgaataattgaattctaagaatggccacagtagactccctgttaatatttctgaaaagtagggttatggagcacatattattaaactgttatttttaatagacatcttatacttgtatctggtctgtaagaccagtcatattagtgtacatttttcaattagtttactttggaagtgggcacaggggtctacactgctcaaatctgtaattataattaccttatgataatttattatggcaataatgggaatttgcttatttttctttgaaaaatgttttcaagctatacttgtttctgccatgatagagaacttttgcaacattcatttttgttgtgagagtagagccacaatgattttctaatgagaattgattaagccctttccttaccctagcccagttctaagtattgtcagtggtgattgggatagagggtagtctgtttggcatgtttccatgtcatgtgaggatgtcaaccctccgtctttttgaatgactgctaaggcacattactccttttaactgtcaacagagaatgactactactgtggtctgaatgtttgtgccaccacagaattcatatgttgaaacctaattaccaatgcaatagcattaagaggtggggcctttaggaggttattaggtcatgagggtggagccctcatgaatgggattagtgcccttataaaagaggctgcagcggagcttgttcaccccttctgccatgtgaagacatggcaagaaggcaccatctatgagaagtagtccttcaccagagattgaatctgctggcatgttgatcttggactttccagcctccagaattgtgagcaatacatttcctttctttataagccactgagttcgtggtattttgttatagcagcccaaatgaatgaagaaaactgcattccaggggaatgttaggcagtattatctcacctcttcatagtgtgatgtctgtgactggctcagttcatgcagctctacttgtggaatgtgcattacatttatttatctatatcaggaattcttaatcctggagaaatttcaagggattgttaaccccttgaaattatagccctaattttagttgtatgtgcttcctcatggcgttgatacacttctttcaccaaattctcagtcaggtccatgttccaaaaaatggttaagaatcaccattttgaaatccttcttgctattatgccagattctcaaacagctgtatctggatgataggagaatgcctctttgaaggttgcttttgtgcatgttggcatgggggaggtgctaaaatttcagatgggatggccagggcaggctcctttagaaggtgagttgagtggtggggagagcagtggatgacgagtgggatctgggaccttgtagtcctgttcaggacttggacttttactacaagtgacaggagagggctgtagtgctttgagaaagagagacatgatctggtcaatgtgttaataagatcactgtgactactgtgttagagagacatgatctgatctgtgttaagaagatcactttaactgctatgttgataactgactgaactggggagcaaggacagaagtagagagcctcttctgatagttccgggaagaaataattgtggcatagaacagggtattggtagtggagagggtgacaaattattaaattttgaaattgctttgaaactctggtattattaggatgttcatgaggatgttagctgttattttataaaattaatcaataattttcttagtgttaggattatttgtactcttctcctaaactgttcatttcattttaactactcagaatttataattgaacaatacaaccataagaaaagttagaacaaattaatggttcatccttaggaagtgtcttcatattaatggtgtttggtgtattaggcttattttggtcatcctatctttaattttccctttgcttcattcttttttcaccaatttaaaaaatttctgtcactttttctgtcttttatttagacagagtctcactttgtcatccaggctggagtgcagtggtgtgatctcagctcactgcaaccttcacctcccgggttcaagtgattctcttgcttcagcctcccaagtagctgggattacaggaacacgccaccacacccagctactttttgtatttttagtagagacagtgtttcactatgttggccaggctggtcttgaactcccgacctcaagtgatccacccgccttggcctcccaaagtgctgggattgcaggtttgagccactgcacccagcctctttttctgtattatttgtgttttaaaaaacttctttatattcctttttgtacagtttagggtgcatgtttctctcattgaatctatgtcagataccacctttcactgtctcttcaaggttgtgtctatgtcctttttacacttgtgattgtttctctgttatttaagaatgaaacctgattccacgaatccaaaccatcagaatagtttgtgttttgcatggaacattaaataaagaagtggttgttttatgtaaggaaaactgctgatctatttgatcacttaactgaggagaccaggtgagttaaaaacaagccaaatcatttgttgaactgaattactatagtcactagtaagtttcatcaaagcaatccagtgatatgttgtatctgtgacacatcttgactataaaacttgcccttgagtttattttatgagaacatcttatatcaagaacaggtagcataaaaagcagggaggaatttgtactcatttaatataattaaatcatgagggttccaaacagtgtactgatttctagaaatcctaaagaaccattgtgatatcagtgtataaagaacaaaaattctgatgacaaacttgtagtgtgaaaaacaaatttactggactacccactgtttatactcatttattttcttcctgatagtaagttgtaaaataaacaaacacttttttccatttacttatcatgtggtgccaattctcacttatcatatggtgccaattctcagatatgagtcatgagacatgtttcttaatgtttttttttttttttgaatcagaagtttttttttttgttttttttttgtttttttttttttttatactttaagttttagggtacatgtgcacattgtgcaggttagttacatatgtatacatgtgccatgctggtgcgctgcacccactaacttgtcatctagcattaggtatatctcccaatgctatccctcccccctccccccaccccacaacagtccccagagtgtgatattccccttcctgtgtccatgtgatctcattgttcagttcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattatggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtgtaaggtgtaaggaagggatccagtttcagcttcctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtaccagtaccatgctgttttggttactgtagccttgtagtacagtttgaagtcaggtagtgtaatgcctccagctttgttcttttggcttaggattgacttggtgatgcgggctcttttttggttccatatgaacttgaaagtagttttttccaattctgtgaagaaagtcattggtagcttgatggggatggcattgaatctgtaaatgaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatagaatcatgtcatctgcaaacagggacaatttgacttcctcttttcctaattggataccctttatttccttctcttgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagggttgttgaattttgtcaaaggctttttctgcatctattgagataatcatgtggtttttgtctttggctctgtttatatgctggattacatttattgatttgtgtatattgaaccagccttgcatcacagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcctccttgtacctctggtagaattcagctgtgaatccatctggtcctggactctttttggttggtaaactatcgattattgccacaatttcagctcctgttactggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcctttcaaaaaaccagctcctggattcattgattttttgaagggttttttgtgtctctatttccttcagttctgctctgattttacatatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttgggttggagagttctgtagatgtctattaggtccgcttggtgcagagctgagttcaattcctgggtatccttgttgactttctatctcgttgatctgtctaatgttgacagtggggtgttaaagtctcccattattaatgcgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttcattggagcatttagtccatttacatttaaagttaatattgttatgtgtgcatttgatcctgtcattatgatgttagctggtgattttgctcgttagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctgtaaaggattttatttctccttcacctatgaagcttagtttggctggatatgaaattctgggttgaaaattcttttctttaagaatgttgaatattggcccccactctcttctggcttgtagggtttctgatgagagatccgctgttagtctgatgggcttccctttgagggtaacccgacctttctctctggctgcctttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagttttttccaacttggttccattctccccatcactttcaggtacaccaatcagacgtagatttggtcttttcacatagtcccatatttcttggaggctttgctcatttctttttattcgtttttctctaaacttcccttctcgcttcatttcattcatttcatcttccatcgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagagacgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccgtgtgaggtgtcagggtgctcctgctggggggtgcctcccagttaggctgctcgggggtcaggggtcaggaacccacttgaggaggcagtctgccggttctcagatctccagctgcgtgctgggagagccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttggagcttcccgctgctttgtttacctgatcaagcctgggcaatggtgggcgcccctcccccagcctcgctgccgccttgcagtttgatctcagactgctgtgctagcaatcagcgagattccgtgggcgtaggaccctccgagccaggtgtgggatataatctcgtggtgcgccgttttttaagtcagtcagaaaagcgcagtattcgggtgggagtgacccgattttccaggtgcgtccgtcacccctttctttgactcggaaagggaactccctgaccccttgcgcttcccaggtgaggcaatgcctcgccctgcttcggctcgcacacggtgcgtgcacccactggcctgcgcccactgtctggcactccctagtgagatgaacccggtacctcagatggaaatgcagaaatcacccgtcttctgcgttgctcatgctgggagctgtagaccggagctgttcctattcggccatcttggctcctccgtgaatccgtttcttaatgttttacactattctttgtggtaaagtgtggtttccattttaaattacatctctcagaataataggcagctctgaaaggggttgtagagaccatctaacagtctgatttgtagatgaggaacctgaggtctagagtgttgaaaacccaagtcccacagctgattaccggaagagcttagcctggcacccaacactcctgatgcctaattcaggtaggttttcatccaaagtccaagccacatatattaaaattatactactatttggatttatgacatagtagtacaaataatcatatttgtgatactccaacttgagtagaactcataggaaatcttgtctctgaagtcggacttcatgtgggtatattaagccaccagacttttaattattctaactctccaatattacctcatctgcaaataaacaataggtttccaaaggtctactggtaaaatttctcctctttattggaaataaataggcagttgttacctatgcaataattatttggccttacaatatcatagtaaagataaagactttagaaaacagggaaattttaagacctgagcatgaaagaaattgaagacggtgatattaatgatgttaaattagctgttacatattttatcaacattgtgagcacttgcatttagttaaaatttcagtcttatcccgtgatacctgtcctggtttgttatggcataaaggaacattcagtttaaattttttcgacttgtatttttaatgatgtaagataggatgcgtacaggaataaatctgtagcctaattttacgtgagatatttctcagatattgatctagagtatcacatgtaaatttagagacttatctataatccctttccttttatgttttccacagacaacttatatatatgtgtttttgtttttgtgtgtgttctgattttagatttaccttttccaggtgtacttctctgaagtaagatgatttgtcaaaaattctgtgtggttttgttacattggggtaagttatttgctcatttgctgttttaatgcccttaaacatggtagagattttgcctttagagatgctgttttatttattagctaacagaatttcctatttctagttaggaattctcatacatgcttatgattaaaaatgcaaaccatagtataggtgtatcagtgtgaaaacgaaaacccttcccaacctcctaaagacaacctgatggtgtatccttccagaatcctctctctctctcacacacacacacacacagactcacacacacagactcacacacacacatacacagacacactcatatctatagctgcaaaaatagcactggtctgtacatgttgttctggatgtttatttttccatttaacaggtttccaatttatcatgatggctttttacctttatcagtatttaccgggatacttattagtttaatggttgcatgacaatgcactgtatgaatatatataaaattattagtctatttgaccaattcctgattgatagacatttctttttctgtaacaaataatactgcattgaaacttcatgtgtctttgtatatttggaaaaatatttctgtagattaattcttttttttttttttttttttgagacgcagtcttgctctgccgccagactggagtgcagtggcatgatctcagcccactgcaacctctgcctcctggattcaagcaattctcctgcctcagcctctcgagtagctgggactacaggcacgcgccaccatgcccagataatttttgtatttttagtagagacggggtttcactgcgttggccagatggtctcaatctcttgacctcgtgatctgcccgcctcggcctcccaaagtgctgggattacaggcgtgagccaccgtgcccagccgatacattgccaataacttttgagcatactgttctcacgtgtttcttaccacattctggtgacattctgatttccttaaaccaaatcatctaagttagattgtgttccaagtttttgaaattaaagttagagtatctttaacaaaacttatgtgatttggcaattgtttatctagctttctttaacaaaacttatgttgtggcaactttatctggcagctgttacctgtgtgtcaactgattctgagcatctccttggctaccccaatctaaaggggctcttctaagcttccctataggtcttccttgtggtacatacttctctttcattgcagccatctgtatatttccagaaaataacctagatagctccaccattacagatttccaaaaaattatgccacaagggactatcaaagagaaataactcattctctttttatattctctaattttattagatatatttaagggaactgttcattctcttttataattctctattaattttcgttagactctagtgttttacattgactttctggaaggtttctggtttgatcaagtttttgaatcaaaagaattcctgggatattgttacctgataagatatgccttcagatgaaaattctagaccatctttagagtttaggattcatttggagggaaagaaatatcatttgcaaagttgcatgtggataaaatagactcatcttttaatttaactgcatcaatagttgctatgtttttaaagttcatcattacattttacatttaaatacttctgtgaggattttaggctaattcatttcaagcaactgaatcctctatgtagacctagaatatataatgctgtaaattagtaatattacatattcttggttttgtaaacctcctccctcaaaaaactattctgttttctttgaggtgttctgattttagaaacatgttagaaggagtgaagtccaaaggaacataattgtaatatggatttacttttggtaatgttgtgatacctaattgttatcagtatggccatagtcacatttgtcacattaatcactttggcctcaatttttgcatctatacctatttatattaatttatatctatagaaatctttagaaaccaaactattaacagtcattacctatgtattgtttgaatattttcactgataattgcttttgtaatgaaaaaatacatttgtgaattgattaaaaattttattttcttacatttttaaaaagcctttattttttagagcagttttaggttcacagcaaaattgagaggaaggtacagagattttccgtagactccctgccccacacatttataaccccccattatcaactatcccccctcagagtggtacatttgtcacaattgatgaacccatactgacatatcattgtcactcaaagtccatagtttacattatggttcactcttggtgttgtatattgtatgaatgttgactgatgtatgtatagtgacctttatctgcagctttagaaacatacagaagaatttcactgccctacccatcctttgtggccttcctattcctccctccttcttacctaactcctgggaactgccgatctttttactgtttccatagttgtgcgttttatagaatgtcataatgtcatatagttggaataacatagtatatagtcttttcatactggtttctttcccttagtaatatgcatttatgtttcctccatgtcttttttttcctctttaaatttttatttttttagattcagaggttacaagtatggttttgttacatggatatgttgcgtagtatgtacatcacctgaatagtgaactttgtgtacaatactacttataagtgagaacatgtggtattggattttctgtttctgagttatttcacttagaataatggcctttagctccatccacgttgttgcaaagtacatgcttttattcttttttatggctgcatagtattccatggtgtgtgagtgtgtgtgtgtgtgtgtgtgtgtgcatgtgcatgtgtgtgaatatgccactttttttaatgcagtcattcattgagggacacttaggttgattccatgactttgctattgtgaatagtgctgtgacaaacatatgaccgcaggtgtctttttgttacaatgatttcttttcctttgagtagatacttagtagtgggattgctggattgaatgatagttctacttttagttctttgagaaatctacacattgttttccatagaggttgtacaaatttacattgccaccaacagtgaataagcatttccttttctctgcatcctcaccaacatctattattttttgactttttaataatggccattcttactggtataagatggtatctcattgtagttttaatttgcatttttctaatgattagtgatattgggcatttttttcatgttcattggctgcttgtatgtcttcttttgagaaatgtcttcatttcttttgccttctttttaatgggattatttgtttttttcttgttgagttgtttgagttccttctaaattctggatattagtcctttgttggatgcatagttctggaagagtgctggaacctctgtatcttttcgtgacttgatgtctcatttctttttagccctgaataatatttaattgtctggatgtaccacaatttacccattcacctactgatgaacatcatgtttacttctatttccttacattattacatttgccaaactcttcaaaattctcatttcatacaaatccatacaagattctcagaattcgtattctgcattagtgtctatataagccaacacaattgttgcatcatttgggtaacttactgaaaaaacaattatggagaattattttattttcaaacaaatatttaaaaataagtttggctgggtgcagtggctcatgcctgtaatcccagcactttgggagaccaaggtgggcggatcacctgaggtcaggagttcgagaccagcctggccaacatggcaaaaccccgtctctactaaaagtacaaaaattaaccgggtgtggtgggaggtgcctgtaatcccagctactcaggaggctgaggcaggagaattgcttgaacccgggaagcagaggttgcagtgagtcgagatcatgccactgcactccagcctgagcaacaagagcgaaattccatcttaaaaaaaaaaaaaaaaaaaaaaaaaaaagacaaggtttaacttttgcagatcttttggtacaggattatataattgttcttaatttttatatttaaacagtgataatttaatcagcagtgggcatttcccataagaagtctattcttttgcatcattttttgtgtaatgtgctaagggcatgtcttatatgatgatgttttgtatttggaggatcatgggaaaattcaggagatcatcaagccatcatcatgttgaagacaaattctttctaaaagtgctcagcgaaagcagtgttaatattttggtgttactctcttaaatacatattaaaatagcactttaatgtttgtttatataattgcacatccagatatttatttatcatttatactggatattatatttatcatttataatggaagctagaataatatgctttagaaaggaaaaataaaatattcagtgtttgtttccttttattaaaacataaatataaaatgtcagcttaaagagaaaacatgaagtgtgagtcttcaaaaagaaaagagatgtcagaaagtggagtaatttctacaaatgaatgcatcctcttgaatgtaacacattgtacaatggaagcacaaagttattcattagacactcactgaggacttagaaagttaaataattattgagcactacatggtttaatctcagatactttctattcatgtcttagtcaaaatgattacttttttctatgtgtctttttaatatcctaacagaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaataggtaagcattagctatgttttaaatgtattgaacaatgttttttaattctttgatacctgtatgaaatagatgtcttatggctatgattttaacatacataatcatttttatatggataataaaattaggattcattatgtgaacaaactaataaataatttccaaattatcttgtatcccataaaaatataatgagggaattattttacttttaagtacattccttgtagtcttctaaatttgctttgaaatagaaaaacacaccttatttttgttaaatgtataaaatatcaaatgactgataatattgttgaattggttaaattttaaaatattcatgaataataataattcttcaggcaaggaatatctctgaaagaatatacgttttaaagatgggtttttcagaaagaatagctaatggatgctgggcttaacacctaggtgatgtgatgatctgtgtaacaaactgctatggtacatgtttacctatttaactaacctgcacatcctgcacatgtacccctgaactaaaaataaaagttggaaaaacaaaaaaagaaaagaaaaaaattctttttttttgtttaagtataatgcatactgattgtagctagtgtagttaaaaattctgcatctggaaatataaacaacaaaattatcccaagtcttttggaaaagctaggaagagtggagtcaattgactcatccatgtagagagacctccagtatgaaaatacaggcatatcttttcctcccttaaaagcgtgatgattgggttttcacatgtatgagtgagatgtgcctccctcagaccttgttatgatgttggcacattacctgtctaatgttaaaaaaaaaaaaaaaaggctgggcacagtggcttaactgcctgcaatcctagcatttaggaggcctaggcgggcggatcacttgagctcaggagttagagaccagcctgggcaacataatgaaaccccatctctaccaaaaaaaaaaaaaaaaaaaaaaaaaaaaattaactgggcatggtggtgcatgcctctagtcccatctacttaggagactgaggtgggaagattgcttgagagatggaggctgcagtgagccatgatcacatgatcatgccactgcactccagcctgggtgacagagtgacaccccatctcaaaaaaaaaaaaaaaaaaggaaagaaaaagaaaagtgagaactgagctaggtgagttttgagctcttttgtcctatttaagtggtttgaaattaaagaaaatttgagaagcaataattgaatttaattctattactttagaaaaaaggaaactgagggccagagggactaagtgatgggcaaacgcatgccactagttaaagcttgttctttttctctcagaataggcaatggaagttgtatcagaacactggtaaatttgatttagctcttctctttcactgagttgttcagatggtttttgagatttcatgtagttgtttttttttttttttttttttttttttaaattcagatgcaaactggaacatacagtgctggctaaaaggagacttaaaattattcatctgttatgtggagtcattatttaagaatctattcaggaattataactataaggtccatcttttatatgttctgtaagtaccaaataattaatttggcatttctaatacacagtttttttaaaagagctttcatatacggaagtagattataaacctcttgcatccctacatttcctattatatgttttattttttaatatagcattctgctctgttaggtttcctcttttctcctcctgctaattgaggtagcaagacagtcaggtttagggtcacgattgtcaggtccatgagtataccaaatgttcagttcaagttcaggttctagctcacactgaggtccgaagggagtgggtggatgggcaatagctgaacgaacactctgggggccttaaacaggtgaaacgtagttttattcagcagctctctatcagcagcttactcaaactaggtctctcattagcagctctcttagcagcagctttctctcactgtctgctctgttttgactgcttgggccagctgctcctatgcacagctgcacggctggctctctcttgccttcagggtcagcagcttaactctttctctctctgggcatgaacatgaaccatgctgtgccatgttgtgccatgctgagccatgccctggctcccctcgtcagagcaagactgacagctctggtactctctctctgggtacaagagcgcctgtacaagaacatctgtagagtgtcagcagggcaattataccttttacagacaacagtggcatatggccaagggatggccttcccatgttatggctacatggctgtgataacagatggagttatatgcctgcgcactactcgctgagtcatgcaggcctggacatctgccttggcctgattcttgaccgaagcacatccatgtaccttacaaagatattgcaggtataggtgggcatgtagtctgaaagaagagtgaactcagttcaggagtgctagatatttgagtggaaaaggaaaaaaggtgcgttttatatttctttttcagatgatttttcgtattcgatctctttataaacttaaaaatatgggtggctaatatttgtgctagaaagagaacaaagatattgttttcaaatagccatatacttataactcaaacagcgaatatgtcattaagttttctaattactctagtgatgatatacaccatttttatgtcaattttaactctttaaaattctttctcattaattcttctatttgatgcttaaagtctcgcttccttcagttctgcagttattgagataataccgttgaggagcaatgtgctagaaactgtccctatacaaatgaatagagacagaaagtaaagcggggctgagaggagggggaattggggagttactgtttaatggatataaagtttcaatttgggaaaatgaaaaatgttctggagttggggagtggtgatggttgcataataacgtgaatgtatttcatgtcattgcactgtacacttaaaatggttgaaatgttaaattttatatacattttattacagtaaaaatttaaaaagaaacttaaagacatgtaaaaaaggatgaatggttacgatcactgtcctttaggtgctcaaaggctagcagttgggacctgtatgtacagagtttcagtttaagtggttaccgatatgtatttggtaggtacataatgtcatgggagcccatcattgttgtgagatcttagatgggggttatctagttaagctggtgagagaagagaggaggaaaggtttcctaaggaagtagatagctgagttgagtcattagagataaataagagctaatgagaaaatatgtgggcagtatagtgttgggaagagatcagtatcacctggaaccttgttagaaatttaaatttgcatgctaaatgacgagttaatggttgcagcacaccaacatggcacatgtatacatatgtaacaaacctgcacgttgtgcacatgtaccctaaaacttaaagtataataataataaaaaaaatttaaatttgctagctcacccctgtgaataaaaaattagggggggtggagctcattaatatatgttttgccaagtcctttgggtgattctgatggaactcaagtttgaaaattcctgctgtagaggttaatatgacagattttagagtcagactacctggctgtaccacttactaaatgcactcacaaagcacttgctatgtttaacagttgttctacctctagaaattaacacaatggaaatatttacacaatgtttaaaaattatttgttgaatgaatacatattgccaaaatgctttctaaaatattttccaatttaccctccagaaatgtcttaatgagccaaaaagttaataaaaaaataatattgtctgaaggtgtgagtagtgagtagtcaacggtcagatatagcaggaagatataataaggtctgaatgatatgtacggatttggcagtgtgaaagtaatgggtctttaggcagagctcattcgggggagcggaaggagaggttgccagaacaaagggaaacttgaagaaaggacccggaagagctgatctttatgctagttcctcattcagttgatggggggacactgcagagctggaattcatatatccaaggcatactatggctggtgctgagaatatgaaaaaaacctggttactgggaccaactgctgctgcccaggtgaggaacctttggctggagtgatatttcaagaatggtaggcaaaacaggaaggatcaactcccttgtcactccattattctagtctctttctagctcccccacaggtagaatttaacaagaatttaggtagcagaggagaactatggtttgcagagttccagccccagcatggtgaaacagagcatagggtgcatttgaagatggcagtcaatagcttaaccaccagcaaaattcacttcattggctcattggctacttagaacattcacacacacctttctacgcatacctacctttccctacaacttccttataacttcatgctttcacttaattaagtgcaactatactttaaaaaaaaaatcaaaaagatcctttatttcatgtgtatgtagtatcataattcatcaaaataatttataatagttaactgcccctcaaatattgttttataaatgatgccttctgaagttaaacataatgtagattcattttttaaaaattgtctgtttagaacatactaaacaaatgataagttaaaaaaaaatataattctctcctgtgaagtcttctaagaaaatcatggcaagttcctgataagataaaaaccattccatcattaaaggggattaaaaagaggcataaataaatttgaataggaacatctgtttgctgagttttgtcattgtgtacaaatgaaactctagagttaaaattatattctgatttccttctataagcaagaaattccttaatagaagctcagaaatgacctcagtgccttggtgaaacatacttcttcatctgcggacactcagtgctcccatctctatcagatctgctgtgttacctctgttaacattcccaggcatctccaggaagacgggagatgtcatcctctccaagatggctctaccaaaccaaggctttcctggcaccaacaacgttctttctaaagccctacacttcacagaggaggcaaagcccgacgaagcaccatttctgccacggtgtccaccttaagcttccaactgccactgttgtgaggaggagccatcacagattgccatagccacagagtcttcctgaccctgtggagccactgctctcaggcactgtccagctgacgtctggtgtagccaattattttccccaaaggtccatgtctgcctgacccatggcactccacgagttgtggtgggtctgatgagctagtttctgtcatacctagacaaagaagatggtttaaaaccaattcatgctcttcattataaatccagatctgatttgggtccccatgctcacaagtcttaagcactagtaggcctcctttccaacttgggcagccctgagccaccagacatttgttggtctggaggtgatagagccttccaagttgaaggactttggggcattttggccctctactgataaaagtgggttgctgggatttgtcatgggtcccagatatctgcatctttgggtaaatattacccaaataccattcaaatgatttgcatcctaacttctttctcaattcaacatgctcactgatggttccaaagcttttcctctccagattaagtcttaaggaaaaatactgcgcctttattcatccagccagacatgtgccagctgcaaaaagttgtgttcatggcatcccggccttcaggagatccatatggtcccctttttttggaaaatgtgtcctactgtagagcaaggcatgatgaagaacttacctccacacacccagatctgaaatgttatttccaagttttctcctctccagatatccatgccagtatcatactgtccaagttcctggaaatactgtctgttcctggcaaacaatcctccagccattatcggtgactttgttggtgctgtggctttttctgctcatcctagctcagaaaggggaacaagctcctatttgaagtgcagccctcagttgaatcctccacggacaacagaggatgagctgtaggctagcgtgttggcactaatgatatcaatcactgagaacatcatggtctgctagtccacacagatgacagccagcaagggctgctgccacatcacattcacttcaattggctgtctaggaacacaaggacttctgttgtgtggactgctacactcattcttccttgaatcaatccctcacactttatgtttcttataccttaatttttccaaggaggtatttttggacatattcatctcgtcctcctttcaagtcatcaaggtcgctaacaacatccataaagatgatttcatgaagcaggtttgctggcatgcaatttgtgacaatgtgcagcatctggagacagggcagaaaaagcttcattgtggaaacagataacaattatgtaagcaactggcaggtcaggaggtaggactttacatgctgtattctttgtccctggcacatctctgtggtagcctgcagttactgataagcatattaaaagcacatttctgatagcccgtctctcaactcctgagcacgttaattaaaaatcatgcctagttcagaagacaatttcaagtggcctttttctggatcttcaatatgaccatcacatcatcaattttgtttgcttcgaactgtggctctagtaatagacttggaccttgagtgaatcaggaatagaattgttttggaaatggtccatggggtccaggccccttgagcacattctttttttttttaatatagtttaagttctgggatacacgtgcagaaagtgcaggtttgttacataggtatgcgtgtgccatggtggtttgctgcacccatcaacccgtcatctacattaggtatttctcctaatgctatccctcctctagcctcccacccccctacaggccccagtgtgtgatgttcccctccctgtgtccatgtgttctcattgttcaactcccacttatgagtgagaacgtagtgtttgtttttcggttcctgtgttagtctgctgagaatgatggttttcagctttatccatgtccttgcaaaggacatgaacttatccttttttatggctgcatagtattccatgatgtgtatgtgccacattttccttatccagtccatcactgaggggtatgtgggttggttccaagtctttgctattatgaatagtggatgagcacattcttaagtggctgagtcacttcaccgaagttgaaatgaacaaaaaccaaaactgcacaggtcacagatgtaaaaatgtacccataacagaaatattgaactgtgacacttcccataatagacttagcataactaatgggccattttcaatttctgcagcactggcagtggccttccaggactcaggctgtggcatctttcctcctgccacagcccctgtctgagccacaggagctgcccagggggtgaggagtggtgggctacactttgaacaaaaggagacagtcttattctctctcccaaatgggatgatgctatgtcacagttgtcattatgttttctgtgcaacatgtacagtattgctctctgggcagtattaattgctcctcacattcaatcactgtttcacctgaatgaatattgtggaagctaaatataaaattgtaaatttaataattccaggaatccttatataaaataatagggggaaggaaaagattgagaagaaattagttaatatatagaaacacacacacacacaagcatactgtaagggaggaaatatgcacagctgccactgctcttctttctgtattgattaccaggctgtagttaatatttattactagtgttagaccactggactaattctttaagtcacccagaggaggaacccagatatagtgccactgccatcatatctggacattgaatgtccctgtggtcatcatttccacatggaggtcacctgatgccacgactgatgaacctacaagcccctgcatctttgtgcaatcgtcatgagggctagtgtctcagatgtagttatctagttggtgagaaggtgctctagctgccagtgtttcagccttgtatgatggtagattcttcagtcagatattgggcaaccagcaagtagacaaatgtccttaacaaaagtgactgagttataaatctctagaggcctgagaagcctggctggggttggaaagtggaggtggaagactaatggataatgaatgtcccagggtggataattaaaggatgaaatcatgagtttgtttctagtctatagaaagtgacccagcagggagagaaaagttgataatcgaaggggagccattgaagatattttattgagagtgaataatggaataggccaattccatgaaaagagcacagggttggtcttaaagaaggtttacctcaacttctgagtattgagagaagaaaggaagccctatggtggatgaagatatatttgaagctcagggcagtttcctgctttattgagcaaaataggctttagctcagagaaaagtattcctttgcatagtagtaccttcttgcaatgacctaaatgctttggatgtgattaaaaattctcacttgggtgcctactctagacaatttctgatcttatcagcaggttaaggcaaaatgctcagttttaaagccccgtgaatatgtgtaaggtcttaaattctattatgtatatattataattatgatgaggtatttttctgaaaaagataagtatatgtgtaatatatagatatatataatttcagagcattataaatttgaatagttacttagttatagctgagaattttagcttcagtttagtcagccaaacagtcattggtctattcttctaaacaataggacccagaagaatgagaaaattaggtaaattaggtagattttcaaactttcttacaagatgatttttaatttggtcttcttttacttggaacctaggtttctaaaaatattagcacagtaaaacctgtcataatttcaaggaatttgagaaacagtctcccatttttttcctgccacattatatacctctatgatttggttaatatgttcattgcaccaactatcacatgctgtttctgcctttaattgtatttttgtttggctcttaaggcaatgtatctccaaacaattaaataggactctaattcaatgggtagagctggtcaatataggaagagctggtcaatataaccaatgagaactccatggaagagaaaatccataatggtgattactatagaaaagctttgaatcagactcacctattttggacatcagagaattcacaagagaaattttcaaatgcttccatgtgtaaaaaagtatattttaaaagggataaaatctaatgtttgtaagggatttaaaaccatataaatatgtcccttaagggaaagctttgtttgggctcagatattaatgtttgtcagagagtctgaaggacagatactctagaaatgtaatattttgaaactgctctgagattttctcttagatctaggaaggaaattctctttctttattaggtgcctactgtgtgttccaggcacggagctgagcatggggaacaaggttctacaacacagactcagcccttgccctcctggagctaacattctgtggtaaaaacagaagacataacagcaaagtttggaaaggctgtgctgtaataaatacagtgccttgtggaaacaagtactagggatatccagcccaggtgaagagggggcagaggagaatgagccagagagtgaagaacatttgcaaaggcccagaggcacagataccacatggcaggacttgaaaagttgagtgtggtgggactgggaagctggggaatgaagagaaatcaggatggagggatacacaagggtcagattatgaagggccctccaggtcatgcttggagtttgggcttctataactactaacacctactttactttgttttcacaattactcctgccagcattcttgatgatttcagcatccatgtgattaatcttcagtttcttgaatgcttattttcaatattcttgtattttcacaccactttgttcaccccttgtcatggacatgctcgagactttgtcatcaccaataagcatgctttttctataatctccatgtcaagaatcctgctctttgaccatctccccttgcacccttcatgttagtttattccctctactactcaacttcaggaataattctccatggttcttggctcccccttctgggtgccaggttctggcctgagtaaccctctcttcttcatgaaaagcagcccatatgcgcatctaagttgttttcacagcctgctttcctaccagcacaatttttaatggttgaaaggctttttttttttttccattttgttctgtctctgtctctttctgtctctatattagcactatttctgctaatacacttctctcacaaaactacctggacctccagtggatctctctggtgttcactccattagatatgataaaagcctgcaaatctcctagagatcttttctctgtcttctctttgatctttgctcagaaggcatttcttaattttaacagtgtttgctatctggagaggctagacacttcaagactatgaagtcctctttccttttgtttaagggccctttcttcaatgtatatctctcctcttacagcaagaagaaaccaagagacatccgcaacacttgctggaaatctccttaaatatatcattcagttcaataggcacattctatactttccacataactacagatggtaatgttaatgagctctctgctactacacaagaaggaccactgttctccagtttccaataaattatctctcacttccttttgtgccctcactggcagagtctttgaagtccgccagatttctactaacagcctgttcgaggcaatttaggttttcttcaccatgcttctccaaatccttctagcctctgtctgtccgctggttccaaagccactcacacattttcaggttttcattatggcagcaccccactttcaagttccagtatctgcattagtgatctaatgtcatataataaattaacccaaaacttagtggcttaaaacagtaatcatttattatctcacaatttctgtttttaaggaattcagctgcagcttagtgtggggtggaatgggaaaggagtatctgcttcagggtctcttacaaatactgcactgaaggtgtcagccaccaggactgcagtcatttcaaggttcaacttcaggaggagctagttttgagataaattcttggggttccaagttcttcatgggatgttggactgagggcctcagttcctccctggctatcggctggagacctccttcagttccttgttatgtggatctccccataggacagcctgcaccattgcagctggctttcctgagagtgagccagagagactcactgatgatcttgctttttattttcactgagacaacagaagcaggtggagtttctctaatgattgcttttctcacccaaatctaccaggctgcctgtatcagtgcccatgcacttttcctctcttcttttattgtgaataaattctttgagttctgatctaaggcaaaccctttgttacgtgttctgagtcccatctcttattgtcaactcaaggactttcttgccattatcctctattttctgcaccatcatgtttctctctcagctaatagacacgatataataactcccatttaaaaaaataaattttctctgttacacatttctgtcaagtaaccaccccatttcactacttcttttaaagaaaacaaagttttgaattgtatgaatacattatatcttcaaaagttaataaaaaagtcaacaagtgactctggccacgagggaataagagggtctggattactctcctgtgataaacaactagaaaactggaaaaaatgtaggaaataattattttcagacattggacaaagacagacagaactgtgattcctaagagaaggaaacaaaatgagtactcctagtacttaggctttctgaactgtagaaaattcccagaacatggcacagagctgaggaactcaagctgagcccaacaatcttgcagagataagagttcagagagggtaaggggctcaagttcatggggcagagtactttgaaagcaggagcatacagaaaaacttacagtggggccactttaactctttggctgaatatcaatctggccacaatgttgggtaagaaaaacttctagtaagagaacagttatcagggagctataagctaaacaattcacagaattcatagaggtctgggaatcgttcaagttcccacaaacgagattggagagaccttaatgggtatcagtgacatttcataggaactccagaagagctatactttaaaggtggggccaaattagccttagagtcaaggctacactatactattccccaaaatgcttaaaggatgccctaaaagattcaaattagtgctcaagtaacttaactgactttcagaacaaaatccaacactcttcaaggcaaaataaaacaatgtaatattcaaaaatgaaataatcacagtgtctggcagccagtaaacacatgctagatatatgaaaagataggaaaatgtgacccataaccaagagaaaaagaaaaaatagtcaatagaaacagacccggaaatgacagagatgatagaattggtagacaaagacagctatcattaatatgctctacatgttcaagaatgtaaaggaaaatatgaatataatgagacaggaaattgaagatgtaaaaaagaacccagtgacatttttaaagatgcaaaatgcattttttgtaaacaaaaatgctaaatattaatttgggcatttagaataatgttattcaataaaatagtatttatggtgtgcagcccatagtgctaggctctgtaaggggtgcacttttcattctccttcccttctttcctttctatcaggatggactcatggattcttattttagtttgtgggctacaaaagttacatcatttattttattactgaaatcgtctttctttctagcagtataagatgtaccaggttgatcttatacttttcctgatataacactggaattagccatttctccaaggagccatcgttccttttgttgaagaatggtatttacaaaccagtgtctggaggatagttgttcgttgttattgtttctagccctctctgtgtgcagagctagttagtgcacacaatatatacacaatgtgtgtacataatatacacaaatctatatatctatatatctctgtatgtacatgtattaaagggtgtgtgttcatactaatatgtcccattctaggccaaaactgcacagtccgttctaaacttcttttctttctgttttgtaactttcttctccagcagtgagaaagaaacctggcttccctttcccacagtgtgttacttatttgctcagtgctagaatacacacaaagcagttttagcattgctatcccatactgctgtgaaaaatgaaaacaagcgtactaactgaagtgcaatattgtttacactcattttgcctttactaaggctaatgggtacatggtcaaatattatgttccaaagttaaataggataggtcttccctctcccttcaggtggttatattattaacttggtagacattaagttctgtttgtttcagtttgcattcttctttttttcccactttctcttctctttgttgattttccatttatttggtgatatcttacatctgaagagtactttgcattttacaaaatgcttcttaaactttcctccttgataagatttatctaggtcagcactacttacttggcattcaataggtctgggtggaactagattgcttgcatttattcagaacatagattgcttagctctggaccttctgaattcctcatggggtctaggaatctattttttcacaagttctccaggtgatttttatgatgagtctagtctgggacaataactcagtctcaaattattttggattggcaagagaaaattttgaggtaatgtttttatagattaccaatctgaaatttaaaataagtgacttgattaaatgatttacaaaactaatactaaattttctaattccacttcattggtttgttcactattttgctgtcagtttacattacaatcagaaaattaggtggcaccaatttggtgttattcctgtaataatttagcatagaatttgcttggagaagctttaatatattcacattttctgggaagaaaaattggaccaaaagtcagaggacagaatgtgctttctttctaaaccatgtatggctaccaaaaatgaaattccaatactaaagaattatatctctaccttttgtgtaaaaatattaccaaaaaggcaaaaatggtaaagagacaaaattttaagttcatttgacaactgttttcatactattttcactttcaagtaaagtttatttacatgtagaggtattaaataaatagtggcactgagtttgtatatgtgtatgtatactggtaaggcataaaatattttgttgcatataaaattttcaagaattccagaaattcttaatgtttgcttgttttaagccaagtatatctcctgttacttttaaaatttgatgatccttttattctcatactttaaaattatcaaatttgttagagtatgttttgatattagtaaaaacagagttcttaacttcttatactgactttggcatgtaacaaggttggtggattccaggtttcacacaaacttgggaaactcctctcacaaatacaggaaatagctaatgtttttccttaaagaaaagaatcatttgaagtaattatataattctctaattttccatttataaaaatattgacatgattcaggttataattattttttagtcatggttactatggtctttattgatctctaaataaaatggtgatgataacagtgaaatttatcttgtgacaataaggcacgttgggtgtaatgaaatgaatattgaacatgatgcacaagacttcagttgagttccaggtctaccttctctccaaatctcagttttcttacctgtaaagtagatgatgttagttccctcaaagggtgctttgaaaaactggattagataatattactaaaggtgtttcatgtaaattgtaataatgaaatttgatgatatatttaatgtgctttctctatttttgtgtcctttgcccatcaaatacccaccagtagggagtacaaaatacttttggcttatacctggggagggagaattttcttttttcttaaagggccaaatagtaaacattttggggtttgtggaccatcctgtcttggtcacagctattcaactctgtgcttgcagaaaaacaattatagttagtatgtaaattgaattaatgttactacatttatgggcactgaaatttgaatttcatgtatcatgaaacagtcttttttttttttaattgaaaatgtaagtaaccattcttagctcacaggctgtacaaaaacaggcagatggctggatttggcctgtgggccagagtttgctgatcccaagcttagaacattttgaaattagttttagattgatgctgatagtgtcatgatggggttagctgttggcatggttacagaaagcttttttaaaaaccaacaaacaatgaattactataatgcatattttataatgtagatactatatagtcattattaaggatatatactctatatgatgttttgcatgtgtattacaattattaacaaaatgaaaaagagattgaataaatagaaaatacatcagtgaagggatgaggaaaccatagagttaatctgattttaaattcgcccttttttacaaatattcagtgtatttagaaaaggatggctttggcaagaccatctaaagtaagatgatgtgattctaacttttctttttgtcttaaaatatgactaaaattttctatcatttaaaatgttagcagagaatatatttgttgttttgtgctcaacttaggcaaatattcttgctttaaaattctgaagtttttcagccaaagcataataccttgcaagaatgtttccgacataaaacaccacaatttattcaatttgttcacagactttttgtaaaagcttttattttaatatttgaaaaacacctaaaaggtctggcttgatatttttaaaaattacattttgtttgctttgcttaaagatttagataaaatcgaaagtgctaaatcaggctacctctaattcaaaacaatattttatgggtggatagcattttacagttctcaaaaatacttttatgtgattattgtctttgatattcacacccttgtaaacatagatggttcggggattgtcttggttttattgattcaggaacctgaggctcacaaatataaacttacttgtccatgatcctatggctaataagcaaacagaagtacttgattttagatctcaatgttaatttagtgtgcttttgacactaatatcccctatacagttcccagtagattccttggcacattaaagccatgcaaatgttgtttcagggttgattttttttagtagtaaagtaataataaattctattacttgaaaatatatcataattcaaaacatttcatattagtggggtatgcagagaaagactagggtctatttttcatgttttttatatctggatgctcatatatatgctagtttattatagcttctaaagcaacacttttccatactgatttttaaattattacatttgttaattacagtgttttccctctacaaggactgcaagatttctgaaggcagtgatcatgcactatctccctatccccaggttctttgaaaaacagtgtggtttcgatatgaggtagcagatattaatggatagaatggggcagcacaggtgagatgggtagacagagacactgttactccacactcttctccccactgctcttattctatagtcacttcatttacaccaagacttagactccctaaaggatgaggcagatttataaaaaatctagtaagtaagaaataacaactgtctgttcttggttgcatgctattattttttatgccctgtatttggtaaccctacccagctaattataattttttttttaagattgacctacttatttgaaggtttaaaatgataggcaaggtattgcttacaaaaatttcctggattttctttctttttgtaaatagttttattgaggtatagttgatatataataagctgtacatatttaaattataaatttgacaaatattgatctgagaaatcactcataaaaccatcagtataataaagaaagtgaatatatcatcaattagaaaatttcttcctgctcctttgtaatcccaccctcatgctcctaccattggtacttcctcctcccaccccacctctgtccccagggaatggctgatctgatttctagcacatagcctactattactctagcattttttagaactttatataaatgcaatcatacagtactttgttgtgctttcatatacatgattatcttgagattcattaatgttgtttatatcagtatttcattcgttttgattgctgaatagcattccactaaatggttatattgcaatttgttcatccattcacctgttgataggcatttaaattgtttatagtttttgactgttacaaatgaagttgtcacaagtgttagaattgaaatatgttttcatgtctcttggataaatgcctgggcatggaatgggtacatcatgtggtaggtgtgtgtttaacaacttaagaaagtgccaaactgttttccaaaattgtatcattttacattcccatcagcagtgtaagagttccagttcctccacatcttcaccaatacttggtgtagtcagtctttttttaaaattttaaccattctagtatgtggatagtgatatctcattgtgattttagtttgtgtttcttgagtgactaatgatgttgagcatcctttcatatgcttatttgccataactatgatttatatggtgaagtgactgtgtaacattttgcctatctttttaactgggttgtttgtattattattatttagttttgagtattgtagataccttatgtatacaaatcttttatcagatagataattggcaaatatgttctctgtgtatggtttgtctttttgttatctttcatagtgcttctcagaaaacaacttttcaattttgataaagtctaatttatcagtttgttcttttatggatcatgctttttgtgtcatatataagaaatttttaattaacacaaggtcacaaaattttttacttatgttttcttctagaagtttcatagctttaggttttacatttagatttatgattcatttggaattaatttttgtatctgatgtgaggtatggattaaagttcttttcttttattgcatatagatattccattgttccagcacaatttatcagaaagattatcatttttccacagaatttcttttgtgcctttgtagaaaatcagttgtccatgtaagtgttagtctattctagactctattctggtccattcatttacttttttttgtttttacatgaatacttcattggcctgattattgcagctttataatacattttgaagttaggtattgttattcttcaaaatatgttcttcagtttcaaagttgttttggctattctagattctttgcatttccatatgaatttttagattcatcttgtcaatttgtgtaaaatagcctgttgagattgtgagtagcattgcattaaatctgtagataaatttgaggagagctggcatattaaccatattgagtcttctgacccataagcacagtacatctctcattttagttaggtcttaataatttccgtcaacagcatttcatagttttcaatgtgcagatcctaaacatcttttgtcaaatacattacaaagtatttctatttttgatgttattgtaaatgatattttaaaataatttctgtttcatcagttatccaatataaattcagtatcataaaattattcatatttccttattatccttttaatatctgtagactgtgtagcaatatcgtgctttcagtttttatattcttaatttgtgacttctgtggtttttcctggtcagtctgtgatatggtttggccatgttcccacctaaatctcatcttgtagttcccataatccccaagtgtcatgggaggaacccagtgggaggtaatcatgggggtggttacctccatgctgttcttcactattatggcggttacctccatgataatgagtgagttctcatgagagctgatggttttataaggggcttttccccacattcactctgtacttcttgctgccaccatgtttgcatgtccttccaccatgattctaagtttcctgaggcctcctcagccctgaggaactgtgaatcaattaaacctcttccctttataaattacccagtcttgggtatttcttcctagcagcataagaatggactaatacagtctggttaaagcttctttcatgttttaaaatcttttaaccagcttttggctttcttgatctttgtgtattatttttctgtattctatttcattatattctgatttgatatttatgatttctcatctgttttaaagtttggttgaatttgctcttttttttttttcctagtttgttaagacggaagctgaggtcattgatctgagacttttctttttttctcatataggcagttagtgcctatatttagtgttaaacacatttccctggaattattgctgtaagcaatatcctaccttaaagaatatgttgtattttaattttcatgtacttaaaaaatccttctaattttttttgatatgttttttgacccaggaattatttagttgtgttcagtttccaactatttagggcctttccaaatatctttctgttattgatttctgttattaatcctatttttgtgtgactggaatcctttaaaatttattgagacttgttttatggaccagaatatggtcttccttggtaaatgcttttgcaaagaatgtgcattctgctattgttgcatggagtgttcttgaaatgtctattaggtcaagtcagttgatgcgttgttcacgtttttatccttactaatttctgtctatttgttatatcaatggagaagaatgttacatcaatgatgaaatgaaattaatcaataattgtggattagtctatttctccttaaggttctctcaatcttttgcttcatgtattttgaaactctgttattgggttcataaatgttttggattgttatgttctcttggtaaattgatccctttttcattatgaaatgatcatctttatcccatggaatattcactgctttgaaatctactttctctgatgttaatataaccattacaactttcttttgactaatcttataatggtatatcttttcccgttcatttccttttatttgtgtttatagttaaaattgatttcttgtaggttgtttataattgggtctttttaatccagcatgataatctttgccttctaaatgggatgttaaggctgtttgcatttagtgtgaaaattgatatgtttaggtttaaatctttttatttcttttcttatcctattttattatttgtttccctttcctctttttatgccttctttttgattttttaaatgattctacttaatatcctttgttgcttattaattatattttcttgttttattattttagtggttgctttagcatttataatatttgtcttcaatttattatagtccaagagatagtatacctctaagtgatatcataccacttcgtgtaagaacattacaaatttctcccctcccaagcttggtactaatgccatacattttacttttacctacgttgtaaactccacaccacggatctattatttttgctttaaacaatcaataaatatttatcattttagttaaatttaatttctttgtgtgaaaccacatttctatctgctgtcatttttttttttttttttttgcctgatggattgcctttagcattttttatagtgcaagtctgatggtgacgaattatttttgctttggtatgtctgaaaaaaaaagcctttatttcatcattattttgaaagctgttttcgctgggtataggattttagaattgcagtttttcttttattttagtacttcacttttacgtcattatctttttgcttatgttattcctgatgattaacctgctgtaatctttatctttgtttttctaatgtagggtttttttttttcagataccctttaagctgggtgtcccaaatagtttacttcaattagtatttagtatcctgctttaaaagcctatccagtattttcatatctgttttaatatttagctcttatttttcaatataggcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccagtcacctctaatgtcagttcagcccataaatatgggtaagttatgcactaaaatgatgataataggtctaaacatcagtcatatataaaggttaaaaattgcttacaaaaatatttgctagcttatctcactttgcttaacactgtaatgatggtagatgtagtactgggggtattaagagtggcttctagaatgatttaacaatggtatgtatatctctgccattgtcacttaaattctgttttgaaaactgttttctttcaatcctggatctatgtaatggatgtatattgattggatatcactttttcacatctcagataactatttttgaaaatagtagcatgtttcttgcctgaatttattccttcaataaatatttcttagaggctcatgtttgtcagagactgctccaggagctggaaaaagagtgggacattagacatagttcccacctcagagagcagggacaaacaatagtaggcagagacaatgataaaagagtaaatgagtaatttactgtacaaacatgattacaaaaaacttcaaataatagacaacactctgttttctttgtgcaaagatcccccaaatctctttttatcaatttaaatatacaattacaaatgtgaataatacaggaaaatgttagcgctatgtatttaatttattaatttcatttaattatgtataatttagcagtttttctccacttatatttcctgaaacaattatatgcaaactctttatgtctgattttgcatcattggttttgacatcactagagctgcttttccaagtatctgatacaattttccatacaactcaagctttacttctttctaagttactcgagatatagcactttttgaaactgtgtatgacatcatattttaacatgaagactttcaaataatttgtcctgtagggatatagttgtgatctccacaacataattacaatggcatacaagcaattcaatcgtgaagttataccatagagaaaaaagttacaaaatctttattcaatatcattttcttttctttgaaaactaattctacctgatgattttttagtagcatttagagtcaacattgagtgcattgtttttcaaaatgaagtaggtaagggaaagtgctgtggaattttaaagaacttgaaagctttcttaattttgtctttatgcagagataattttggggaaaagtatttccttctatttgaatatatattataatatccccaaattatatgttccatgaaaaaaataaaactggtgtgatggagtgtcagggactattatttctactatgtagatcaaagaagatctcctttaggacatagcatttgagctgaatgaagaagagatatccatgcaaaaatccagagcaaaaggtgctccaagcaggaagaacaatattcacaaaatccctaagatacaatgaacttggtaatttgaggaacaaaacagaagacctttgtgctaggagtgaaagagatatgagagtattaagggatgaggtcagagttacctggtccagagcatattgtaggccagggtggagaagtaaagaactgttttggtttggatctgtttgtgagatggtgctgactggactgtctagtggatggagttgtagagtgtgaaggacagaggggtatcaaggataacctttaaatttagacctgagcatctaggtgaacagagacaccagatactgagatacggaaactcagggaagattaggtgtgtgtacagaaatcaagagctctattttggacacattgtatttgagatgtctattggaaacctaagagacgttgaataagaggttggacatatgagtctaaagtttaggggagatatatatatttgggagttgttagcgtatcaaggtttatagtattgtatgagatcacctatttagagttcaggaagagaaagactgaggggttatcagtaagaatgaaggagtaaaagagtatgttgttgtagaagccaagtgaaaaaaatatttcaagaaggagggaataagcatctatggagtgctgctgaaaggccgagtaaggtgaacaggaaattgacattgggtttatttttgtatttctaatattaatgcatattaatattgtcaacctaaaatgtatgacagataccaactctataaagcaaaaagttgatttgggagtagtaggggattgcagttctagacatgcatgctatggaatgactatgacacatccacaggggattggagtaaaggggaagcttgaaaagacatataggagacctccatgtaagctgttttgaacaaagattattggttacaagagcttgctgcaggggtggcattagctcattggtggagacagccgtagttaggcaagtgtctctgtgcaagcggcttttatggaatactgtggttttgaggaattctttacgttgttccaatgtaggcatacatatacataaggggactccttcatggcctcccaactccattgtgttagggtttcacactagtaactccagtttgatactgataacttttacagtatgcagataggaaatgtacaatagcttgtaatattgtaattttacttttctttggtatatattgttttctctttggtcatggaaacacagtaaatttcacctgctgtttccagacttttgtgtttagctgtctctgctttaaagtaactgaaatttataatacgtctcataaagtaaaacctcattgattttgactaaaagaggaaaattgtgaccaaattcttgaaaatatagaatgtgaaaattatcttatgctctttatttattgaaaataaaattcaaatcagtgtttcaatttaatgataatttctatatatatgaataattcctgttaattgtaaaaaccttgctaatatagagatgaacaaacaagaaaatgcatcgattttctatcactttggcgatctttatattttaactatatcaggaatccaagtataaatgtgtgttaaactttcaaaatttaaacattaaacatttttaatattctgagaaacttcatccctacttctgatgacaagccagggactgctgatgctgcatttattgcatgggaatatttatgctgtcagttatttgagtaggtttgtctagattatagtgatctaaaattaatagacaagctgaattttgggtagttttgtgtatttccaaatagtgttctgcaaaatgcttttttcctttttaaccactaaaataattgaagtgggtgaggttcaggggagacttcagataagttttaggatgctgggtttaataaagttaagtgggattcttacaaggggaaatcacatttagcaaaataatctcatttactgattcatagtctttaccacttaaggggagggtaatgaatatacatggattgctatgataaggtacaaggacgagacccagtattcaagcttgtttcggttctataattagtccttggataaagtcaccttttaagtacttgaaaggcaagatatgatgaaaatttatcttgactttattttattcagctataattgtcatgaaaattacttgacttaaaagtattctcttttttttccttaagtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagtaagtatattttagtaagtaaaaggaaaagttgagaagtaaataaagaccctcttaagtcccatagcaattaccctctgcatactaaatatatacatttcttctaaagcagaatgaattataattcaacatttcatattatatatcatatatagatagatatacgtatgtatatatatggctataggaaatctagttacagaaacttgaattcataattacaattattttccaccaacagaccactgatttcatcttttttttaattgctcaatctatttgaatgtttttctgaatgtggcaacagaaagatttttgcttggctaatcattagtcgagcttctgaatcttctgctagcccgatctgtgcacattcctgtaaaatccagttttagcaaagaactctgctaggtcattttagcaggaacacccccaccctggatatctgatgaatatttgatcagatttctcatcctccaccattccccaaatgatgtttgatcaccatggcctgtcttcagcaagaattctgttaggtcagtttagccagaatccctcttaccatgatgtttttgcttagtaattttctatctactccctccttcttggctataaattccctgttgtccatgctgtgtttggacttagcccacataccccgacccaccacaagaccccattgcagtgctccatatacctattgtgatgattccaaataaagtcttccttacttcctttctctttttctttaacagttcgttccgtaagtatttattgaacacctgctacatgcctggaactgttctgcttgcatcaggatacactgagatagcaggacaggataagaggaatctgggggtgctggtagggaatggaaggttgcaataataaatggaggttggggagggtgacatttgagcaaggatgtgaaggagatggtaatgtagatatctgggtagttgggttctaaacagggagaacagcagtgcaaaggatggtgtggctgagggcagtgaaggtgacagcagtagtggttgaattcagaggccagcaggggaagagaatgtggagctcaatgaaaggcctcttgggccatgtgaatactttggcactttactttgtgaaactaagtttcatataatttagaagtaaaaatcagtctttttagaactggcaaaaaaatttaaaacattttattttcacaaagagaatgatgggaatcctcagtgtcacatatggagaaaacagagttaaggcttctgtgggtttcagctttcttatctgtaaactggagataatttgtgaacttgaggattttaaataggagttattaatatctgatgttgttttatgcattcctgatgcttttcataatttttagtctgtgacatgctccccttaccccaagagcagtcattagagccagagaatttattaactttggagtacatttttgggaagctgaattttgatctcctaggctcaagtgatcctcctgcctcttttttttttttttttttttaagagatgaggtatcactatgttgctcaggctggtcttgaactcctgggctcaagtggtctacccacttcggtctcccaaagtgttgggattacaggcatgagccaccatgcctgaccaggctcaggttcttaagacttttcatgctcttctgtacagggacacttgtagttctttgtctacccctgcacagcattttctaccaggtgtgtgttataggtgtcagtagtggcttaaagcttcccacagattttagctgcatttcttaaaattctaaaggtcatatattcatcatgattcaattaacagtatttgttaattatcattatgattttttcttggacccatgggctatttaaaattttattgactaatgtgcaaactttttttttggttattgatgtttgttttaattccgctgtggccagataactactgtgtaagatattaattctttgaaatttgatgagattagcttatcctcacttttagtaaaggttccacatcaacttgatgttctgatgttttaatataatatttaacaggctgacaagattgtctcagctacatccctgctagtagacagtatacttcctgggtcttcgtatgaggttcaggtgaggggcaagagactggatggcccaggaatctggagtgactggagtactcctcgtgtctttaccacacaaggtaggttatgtaatagccacttctactgggagggaaatatatttcctgaacttgcctttgtatagtataagcatcttacattttgaggccttaaaatgaaaggaggaacacagtatcaacttccttgtttaaactttgaacaggccaatttgtgaattaaaattctgtcagagcctctaggcttgtgtgtttctattgcagtatattgtaggatcacttttcctattaaaaagaaaaaattaatataacagctccaaattaacaaactcagaaagccatttgtattgataattccttaatttacattttaaaaccaagcatatttatttgacataaaattcaaatattaacattttactttatattatataataaatgaattatttttactccagatgcttgcttttgagagttttcagtgccaatgttcatattttaaaggttatttttagcatcggaacatctacagttcattcacagcttcttcatgcagctgatgcgcaaagttttgcatagaggctccagaggcttggaatggtcctagacctgttgcatgcaaagttgggactatagaaagacaatagtcctttggctggttgtccgatctgtcaaaagggcaaaatttttcttgttcagacttactgagattgattatggcctgtacagagataacaggtaccatgcaaatatcaatccatttaacaagtttacttgttgattgcttactattttaaaagcattgattcgtcaaaaggcaagtagcaatagtagtttaagacattgacttcggagtccaacagaagtttataggagttctggctccaccacttatttggaaagtttcttaacctttctatgccttaatttccttatctgtaaaatagggatgttttacatggatatgaaatatccatataaaattaaataatgaaatgaaataattaacattggtcatgtgaagaaaaccattattgttttcttattctgcaaattaaaaattgcatagtatgtcatatgcagataaaatgtgtatctatattattaaaattttgcaaattaaatattcaatatctcatatcaatttcaataaatttatccagtgtaaatttcacaaattgtcaggtttttattaacttagttttcttattttaagctaatattttagcatctaatcatgtaaaaatactatgactttaatcttatttctcagttaagccttactatatgtatttgatttcaaagtgaaatgctttgaattttcttgtcatctttaaaatgaaaaacttcagcttaatccatgaaaactcaattatattttttatttttaaataagaattattctgagacttttgaggcagttgagtaaggaggttgtggcgcatactgaaggtaggttaagataggttaatgtactaggtacttgtccacagtaagtaatgtacaagtgaagcttgagtgccacctcggctaggattatactcagtcacgctcataaatctaatggtctggctcctgtgcagtaattttatgctactaagttttttcctgtttctatttgattatggacatacaaaacacaaatgttttgtatgaattgtaaatatatagacattgacgtttaccatgctattacagaataaagaaaacttaataaaaaccaattaaagtatttttgtttctgtttttaagggtaatcccaagatatgtgtgaaaacaaattttcatagtctatcaacagaaaatggtttaccttaactttacaactgaaatgtactgacgtttttgcagtgcactgtggtggaaataatttcttcctatgtaaaccatcatttacttgtatctcgcatgtctttgaaaatgataggcaaatgaaatttacaacaacagaggactttaaaaatagtatagaatcatgtgtaggcattaaaaaaatcatgttttaggaaaatatcgcttccctttaccctcatccataggatattggcattaaataactcaaaatgatagtacaaaccagtatttcccattttctctgctttgtatattgctgcattatcattcatacgacattcctattttttaatttatatctcgtatctttacctacttacttgaaatttttatgtatccaaacaagacaatagcggcaatcatttttacttcaggatttggcttcatagtgatttgctttaagaacttgtcctagtttcactgattcccaaagcagggtctgttggaaaatatgtcattgttgaattaagctatattttgttttagtcactttcctgcctatcagttagcaagtgacaattactggctaaaacatattttatgatgaataagcctctgtgtttagaagatagtaaagacattcatggaagctcaactcactttagaatgagagcactcgggacactagataactgtacacaaacaggtaatttcagcattatccagtttttaaattacactcattttatttttggcagtgtaactctggaatgtgttgtgaatatttttcgatgtggtacaaattacttacagaatgttttgtcttcatctgatatcctttcttccctcattacagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattggtaagaaaacagaggttttgttcattttgttccacaacttgaattttcattatggaccctccttatattagagtcctgttaaagatgtaagaaaaaatttttttcattgaattttttggagtttttgctttatattaatattttaatatgtttcaaatagatgtcaatatcaatatctcatgtgaaactgatgggtacttaactaaaatgacttgcagatggtcaaccagtacaatccagtcacttgcggaaagcactttgcaattgaggtatcataggtacgtattatttttgctgttttgtttttctgtgggcacagtgagataaaaattttctttagaaatattacaacagtagtcttacagattatttgcttcctgaaagaggaaagtataatataatgaatcaggaaatttttgagggattatataaattggtgattcttgaaaaatattcacacctgagattaaaaaattgtaatttgtttttacttcaaattatcttttctgaaaatcaatcaattctgaaaaatttgtattttaactcttgaatgaaatgcaagaaaatgtagtttatatatattttaatttgacttagttgactagaggagaatgtgaaagattataaaagtttcgtatcatttggctaaagattaatgttttggaaaaaagaggtaaaaacagattataagagataatatgaatggtttttagaactgagtgagattacttaggaaataaatacttatggttaataaagggtaatgtgttctaatgagaagtaatttgtgcttgtttatttttactcttctatgttttaaaaagaattcaaggcatcgtcttatagtggtccctttctttctaaaatcattttatctaaaatgatacaacccttgattatataatagatttttatttttaaaaatatcccatagtagtagtcaagtaaatatatactgctgttaaacactgtgtcccaatttatatttttatttgtagtggagactttcaatttgtataacatgctcatttattcttaaaatataaattttcaactagaaaaataaatcccttctctcaaatactgtgatctgaagtctattcctaatgctgccagtctcttcttatgtagcgttaggaaaaaaatgtggcaattcgtacatttctcaaatagctgccttcatcctacctaatatgagtattttaaaatcagtagaattgttcatgatatgaaattttacttttataatctgtctttacattcttttcatggcattttcacattagaaaaggtgtttatggaaaactattatgttaagccccatgccttgtttctcttattaacatttacagaataactatgaaactacatttacttgggtgagtttcttaacttccctaagcctcaatttccttgtctgtaaaacagagagaataataggacttacagtgtttctgcgagagttaatgacatatttcatctaattataatcacatggtataatttctccttgtaaatattcaatatatggtttttgctgtcatgataatgatgccaacttttcgatttcaagtgtactagtactgtgcttctactttgttcttattttctacccccagatgacccctcactcctcattttcatttttgcccacgcaccaccatttattcacacacacacacacacacacattcatgattgtaattttgagaagacaagaaaaagaagtggtatagaaaatagaaaatgacagaagaatatagattttttagcttcttctaacttcctcactcccatctctttggaaagagtaattgctacttcagctatttaaatatagtattcagagcaaacattggcccaagaggttatttcaaagaagaggaaaaagactttatgtcaagtttgtccaacccatggcctggggcccccatgtggactaggatagctttgaatgcagcccaacacaaatttataaactgtctgaaaacattaggagattttttttgcaactggtttttttttttttttttgattcatcagctatcgttagtatattttatgtgtggcccaagacagttcttcttccagtgtggcctagggaagccaaaagattggacacccctgctttatgggttctgaggtggagtgttggctaggactcacttataaaattttttttaaattttcttttctgagaaaatgaggaatatacatggttatataattcacatacatatctgaaattggtattatattaacttatattaatttgaactagaaaattatattcaccactcatttgtggtgaaatttaattctttcttcaaagtgtgaggaatttgccttccttgccatctcaggaatgctccatgactactttcatctatattttaaatattctatcactaatacataatgtttgtttaattttcaaattattgtaggttctgtctctaactggatcattttcttctttttagagtatttatttcatttgcatccctgcttagtgtctaatgaaatatttaataagagttactgtcagtttctgtggaaagatatagaattgggaaaaattaaaaaatgcctttctaataagaatgtctttttttagatggagtgaaattgtctgtattttatttattttaatttaatttaatttaattttattttgtttttgagacagtctccctctgtcgcccaggctgcagtgcagtggtaccatctccgttcactgcaacctccgcctccccagttcaagcgattctcctgcctcagcctccctagtagccaggactacagatgtgcatttgtagagacagggtttccccatgttgcccaggctggtctggaactcctgggctcaagtgatcagcccgcctcagcctcccaaagtgctgggattacaggcatgagccaccgcaccgggccttctgcctgtcttttaaacttggggtccccagtccctgggccacggaccggtacctgtctgtggcctcttaggaacccggccacaaagcgggaggtgagagagcagcattaccacctgcgctccacctcctgtcagatcagcgcagcattagattcttagaggagcagaaccctattgtgaactgggcatgcgctcctcatgagaatctaatgcctggtgatctgaagtggaacagtttcatcccgaaatcctgaaccatctcccatcccccattagtggaaaaattgtcttccatgaaaccggtccctggtgccaaaaaggttggggactgctgttttaaacaacaaatcagaattctcagatatcttcttgttgcttttattaatgtatactaattgactatttttgtatcttttaaaggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtgggtatgtcaagctgcgttgtgtcttcatttgtgttagcagatttgtatgcagattgatgcagatttaatgttatattttgccattttctgatcacattagattttgaaaaaaaaattgttcctgtttacagtggtattgagaaaatcagccttaggaagttttacagttttgaattcatttcaaattatttatagcagactttttttagcaataggaatattttctgcacactattagatgaaatacatgggtcattatgaatgaattttagtagtgtttttctaaataaggcattattttatgtttttgttccaatgtagttatgaaaacatgtaatatttgtaatccaaacgtttaatttgaatattctgaggttctcaataatctgagtactcataactcaagcctttaatttgtgaggctatgtagggcacagaagcatttaaaatagctaaattgaagtggaggaaatagacaacaatgacatacattatattttaaacattcttttcaaaaaacttttgatttcaaagatattaagagagcccttggaaaatgtgatatattctttccggttcattgtgaaatctctgagaaatgattgtgcaacaggaatgcaaaaatatcttttggtgctgttacatatgtataactaaggaagcttttgtagatcttttctaaatgtttgttttcaagataagatgtctaaaaacaaaacaaaaatgggattttcagtgaattttcccctcaaataaaatattcctcagtaggaaacatgttagaataatgttccataaaaatattaatatatactattttgttgggggattatgtcaaaaatcaatatttgagtcattatttttcaattaattaatacacatttgaattaaaacctataaccaaaaaatacacgataagattgtcttaattataagatttctttttcaatgtaaagtcccaatgaattctctccccactgtttaattccattttaagtgatttttactgcagtgatacttaatatcccaggatagcaaggaaccctcctacactcccccaaacatgcacagataataacacactcacttataagatatgacaaatgaagcctggattcagtaacatatgttacttgaataacctatggtgttatccttttcaaaactaaaataacgagtttaggttgggcttatattgcctacttagtactagaaagtaactcaacgttgggatccaaataccatctccacttattactagcctttaaatccggactagccacacaggcactatgtgtctgttttgtcatccataaaatgtagacagctcctcataccttcccagcatgggtattgagggaatcacgtaaactattgaacttcaagcatatcctttctgcagactggatattcactgccagtctgcagaaaggatatgattcatatgattcagttaattgcaaacacagatttaacctcttacagtctcttgaatattgatacttcctttcctgacaagaaattatcaagaggtgaaatacagtatatatcatcttcctgggttggtggagaatgtctttttgttctatgaagaattgaataatcatgataaactttacatgacggaaaaagtttaggtatttttgttatcaacagtcaaaagtattattgttgattgcttaaaaatgattttaaaataccatatgaaagggagactatacctttacacagtgttggtttttggcaagtgagacttggagcaagagaataataaacacccatattgtgccaatccaggtattaagttttccctgtgaatcataacagtagcatgatttataagacatggggaaataaatcaagaaggtaaaccctggaactctatcgtcagttctctcttaatttttcttacacagagtgtctacatttggccttagttatggtttgggttatttaggtttctttttgttggtggtggtttgttggttggatggtttcatacattagcccttcagcttccctttttgctactgcagttgtttcctgcatattccagccaagggccatctctcactttagattgtccactggcaggggtgactgtcaaaataatgaccaagaggagggccattccagctgcaatcccagaggcctctgctgtaccaggcattgaccttttaggttctgagccgtgggcaggtgtggagggcatccaacctgagcagttctggaggagatattcctcaggagagcacctctttaccagttggtatggatgtacttaatatttttaacaactgttttgacataccaactgaatatatgtcctctaaatggaatcttctagtcttagtgcagataatcaagacatgactatgtaaatgtagtgtgtatcataaagttgatgcttggagtcataacagagttagggcttcagagacgcactgttatgcttgggctttcaggcttttagtttaaaatatgccacatttccatattgcctgttattgtcaggaagattggccctcaaagttaaaaattaagaacttgggggaaaacttatgtagtgaatctaagcctaaggtagtttttactttagctctgaaagcagcatcataaaaaggtgataggaaaacagggaagataacctttttctttgcatttctatgatttttacattacacctttaaacatgtcttgttatgtacatatacgtatctattttaaaaatcacttgctattcagaccatctttgcctctattactgcccattaaaagcctgttttcctcagattatagaaaaccaaggctttgctctgagagactatctctgaccttgacctagaaatatttaatgatacacagcagcataagagtttcacactcacacatatggaaattgatgcagtccatgggttttttttttttttgcctttaattaaagttcaatggagaacagtttgttattgatatttagcatgtgttcagcatggtatctttttttttttttttgagacggagtctggctctgtcgcccaggctggagtgcagtggcgcaatctcggctcactgcaagcttcacctcccgggttcatgccattctcctgcctcagcctcctgagtagctgggactacaggcgcccgccaccacgcgtggctaattttttgtattttttagtagagacggggtttcaccgtgttagccaggatcggcatgttatcttttgcttgcagagccaatggttcaatttctaatcaggtactactactagctttcagagtaacatgaataatgtattgacttttttcagtcaagtctatatttgcgaaaaagagataaatccctcttttaatatatcacataaagtaatagggaaacaaatgagataatgagtgagaaagttatgaagaagatattgcttgatgaatacagatgtatgaaaatataacacaatgtttttaggcattattactatttaaattaccatcacttaatactattgtaaaaatttctagtgaagccactgcctccatccagtgtgaaagcagaaattactataaacattggattattgaaaatatcttgggaaaagccagtctttccagagaataaccttcaattccagattcgctatggtttaagtggaaaagaagtacaatggaaggtaccttttacttagaacttcagctttcctcattaaatgctatttttataatatgtaagagtttaattgcattagattaattttattggcataaaagtacattctcctgtattgtgtagctattttcattaaatagatttatctaagtctaacttttttaaagaacaaagtttcctgaaatccatcattccctgaagtgtgttttatagaacgttggttgcatattatgttccttggaaaaagattaaatggctaaatcagtttaggaaaccctgtatcactgtatcttccttgtgtagtcacggtatacatattacatattcaaggtttggagaggtccttcattaaagaaaaatttgtgaccttatttcatctcatgttccccaaactaatttttccaaggaactgttgtttctctaacatctgttgatatcttttagtacatacatgtttagtggaatgcattttggaagaagctgcttttcaaacaaacagagtcattcccgtagtggcaagtgtgcctatcatggcattccacatcagctttgtgacggcagcctgcaaagacctagaaatatcagaaacccttattgtatcattagatcacaatgatatcaactaaaacaaatgtgacagtttagctgctattgaagaatactgaatatcagcgatttgctacagtaggtcctatctaaccaatacgtttaaattctttttaaattcttaaaacatctttgtgggtagaggattagtggacagggattagtaggagggtaagagagtgtttgggaaacaaggttgcaagtaaaccagttcaaaatcttgtcatcatcagcaagggagtgacaagataaataagaaaatccttgacttgaaggagtttacaatccaagcctaattgtgactatttctgaaggcagagaacacagaatcagttctcttaattttggaatagtgttaaggtttaaaataaaatgtacttcagggccctttagatacatatgtgttggtaatgatcaatctaatgctttgacttattttacagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaaggtctgcagagattttgtaaatgtgttttgaaagtgcataagtgtgtgcttcaaatatggctgaaaagtatttcttcaaaaacatatacacaacttgtcattttgcagttcctatgagaggacctgaattttggagaataattaatggagatactatgaaaaaggagaaaaatgtcactttactttggaaggtattcccaattttaatattaatcttaaattgtatttttatactcttaaaaatttacttcatggtccataatcctgttattaatcttcggaaagctcaacaatcctgtattttcattgcatttatgagatgtatttaaagagagctaagatgtacagtggctgaagcactggcatagtgttaggagactttcattctcttcttagcttcacatattatagttacgtcagtactatttgggcaaagttacttagactctttgggcctcagttttctcatctgtgtaaatgtaatattgaactagatgataggcagtgtttcttggagtctaaaaattgtattcatatttaatcctgaacaatgtaaatgtcaccttccccgcacaccccaagggcatctaacacatgacagagtattccatttatgtgatggcataaaaacagtggatagtcccatatatgatggctgtttagcctagtaattttcaaagcatcctctcccaaatgaactgatttctatttcaagtgaatagtttatttggtcagtaaatgccaaatttaagattgacttgggaatacaacacatgaagtcaaagagtatttctgtcactccaaatgtgaattgtaagtttaatacccaaggttgaatgagcacatgtttgaaaatggtttcctgatgtaagaccaaagcctctgtaaaagttgtggtatataagaatttatgttcatttggtttctaaatccagttactctataatttcatttggtgaataatcaatgcaatttctaaagtcttccatttcaatatttcttaaaataattttttattcttttatttcatttcttttatcattgctctccttaaaaaatttagtttcttttgttattgctctcttttctttttctagcaaaccattccttcaacacattttaatatttccaacttaaagttagcattagaactgacagacatttatgagccatttattgtattctgaacacttcatacagatctccacctcccggggaattcaggacctgtattctgagagattgagtgggcggttgaacccaccgcggaagggggcactgctgaataagaaacaagagtcttgcccgacagattatttttctcatatttttggttttatctccatgggcactgttccagatacctgcaaacttctacagtgaaggacaggcagtgatgttcccatgtttgtggtagggccagctatgagcagaatttaagtagcttttctttttctttgatttgtcctctcagagctgtagtcaacagccctttggcctaggctacagctaccctctcccattgcaatatactctagaacaaaacagttgtctttctccagacagttcttatgttttcctcatatcatggattccacatttcctcagcaatgctgccaatagaagtttctgtaatgatgaaaatggtttatatctgcattgtccaatatggtagcaaccagccacatgtggttattaagcacttgaaatgtgcctagtgtgactcagcaactgaattttaaattgtatttaattttgattaatttaaatttaaatggctgcaagtggccagtggctatctttttggacaacaaagctctatgggttctttaggggtgatttgtgggagggagacaggacccttgctaatctaccatctttgcagaaccttgaatgccttttattagtcaatttgcctttcattaattttgttttgtgctgttttgttgtgttttcctaaactgagataatagttcaatgattacggttctccaagcctatgcctcttaaaccgggataagatttgcttaaggagtaagccacaaggccacaggataagtatggcactttttaaaaaatatcatttctctggcatttttaaaataataaactttacgttaaggcagttttagagttacaaaaagacggcaaagatagtacagagaattcctatgtattcccacaccaagttttctctagtattaacatcttaggctagtatgatacatttgttacaatgaattaaacaatattgatatgtcatcattaactcatctgtaatttatttcaaatccaaatttccttagcttttacccaatgttctttttctggttcaggattccatccaggatagcagatttcatttagtagtcatacctccttatgcttctcttggttgcaaaagtttcttagatcttctttgtttttatgaacttgacacaattgagaagtactggtcgggtattttgtagaatctccatcaaatgggttttgtctaatgttttctcatgattaatttagggttatgtgtcatacctccttatgcttctcttggttgcaaaagtttcttagatcttctttgtttttatgaacttgacacaattgagaagtactggttgggtattttgtagaatctccatcaaatgggttttgtctaatgttttctcatgattaatttagggttatgggtttgggggaggaagatcacagatgtaaaatgccattccatcacatcatattaaggatacattctaccaatgtgacttaccatagttgatgttaaccttgctcgtctggctgaggtagtgttgtctggctgaggtagtgttgtctggcttcccactggaaagttactcttttttctcctttctccattttagttttaaaaatgaagtccccatgcttaaggagtaggagtcatgttccacctacttgaaggtagaggacctacatatattatttagtgttcttctgcatgggagatttgtctgttctcccacattaactattttatttattcaatcatttatttatattagtatggacaatgaacatttattttagacttggtttgtaatccaatactactttattttgttgctgaaaatattcctgcttcagtcattgggagctcttttaattgactcatgttcctttgacatgcccccgtcattgtggggttttttattttaatttttgagtactggtaagttcgactttattaaaattaaaaacttctgatctgggaaagactgtcaagaggatgaaaagttaaggcacagactgggtgaaaatatttgcaaaaacacacatctgataaaggacttataaccaaattacacaaagaaatctttaagattcaacaggggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaaaaaaaaccaagtatctgaacaaaaacctagccaaagtagatatacagatgacaaatatgaatattaaaagatgttcaacatcattcatcactaaagagttgcaaattaaaacaagataccactccacatctattagaatggctaaaatccaaaaaaaaaacctgacaatacaaattgctggtgaggatgcagggcagcaagaacttttattcattgctgtggaaatgcaaaatggtacagccactttggaagccagtttggtaatttcttacaaatttaaacatagccttaccaaccacatgatgcaacattgcatcctaggtatttactcagctgatttgaaaacttaagtctacatagaaacttgcacatgaatgtttaagcagctttagttatattcaccccaaactagaggcaactaagatatccttcaaaaatgaaacgattctgtatacttctgaaatggtgggtatatagcactatgcatttgccaaaactcctcgaacttcatagcacaaagagtgaatcttaatgcatgtagattaaaaagaaaatcatttaggaggttgaaggatcccaggattgactgtaaactgtgacaaaggaatctacctgtattacaagtgtatgaagcaacttcactgaaggtggtgggagaaaaggccactttggaacttgagtggagttgttggaaatgtgtggaatcttaagactaaaggcaaaagaaactgtacataagcactgtactctagttgatacagttctcacagggctatgggctaacaattatggtactgctctacatgtactctggaaggggacaagcaagtaaatggatggtggatggtgggacccagatttctcactgttggattgggaggttacacacaagcacaggatgatccatgtggcaatgaattagagttggggatataggtatgaacttatatctagcttaatatagatatagctagattctggtttaggatacatgtacattttcttgatttgtaaggtaagagggcctaaaagtaatgacatccagtagtaagacatgtgcccagacttgtttctaattaccatcgttcaataatagaaacaagggctattggaagaaatggctaattttagggttggggcagaaaatatacgagattagcctggaggatcttgtagtaccagaaagtaaggaagcttaacattctcttacttgatggttaccaaaaaagtattcattaaaactgacatgtttttttttcaaataaaatgcaacatttgcatgactttgaaacatttctttcttgcggtggctgctaaaatcttactttcaacctatccagatgattccaagttttgcagggatacatgtatatgtgtttatttttctctgccatttctaacttagaggcatctcaccggcaagaaattgagatgtactgttctagtctatgatatacagtccagccttctctgtctttataagggattgccagcatttaatcttacctgccataggtgaagttgattggggaaatggggtacactgttaacctctgtggaatataagaatagaattgaactagacacttattttacattcggatctttaatgacctgatattattatttttaattatatgacagaaattctggggtgccatagacactgttttgatggcctctgttactcattaacctttgcagacattcttacattctagataatcttccaagagtatcagaggaaaggaaaatgaatgacaaatcttactatgatcaatatatgatgattaacaccttcacagctcttgttgttgcttttcattttctgagggttattccttgtttgctttttagatgaggaaactctctactccttatgtctttcatttctctaaaattagagtgaaacttcttggtagaaaagtgtcttgatcatatccctactttattatcttcaagtgatttattctctgggccttaagaaaaaaacctcaaaaaggggaaaataagtttgctatgctccataacgatccagacaccttcatggagactgtggcagaggcaaactctatcccacccatctccccagcctctcagccttgtaatagtacctgccctgatctggcccctgcctcctaataagaaatgtagaatgagagttatgtgagctcagttagtataaaaagcactgcagcccttaaactaatcaatttctatatttactacagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaaggtaagaagaggtacagagtggtaatccattgcctcttttaatatttaacttttgcaaactctcctattttaaattatctttcaagcagcctgcaattctctgcatctgaaagtctctctttcacctttcatttcctttgtctggaaaaataacaaagtacattgtacaatgatcacataatacagtccttgagctttcatttgggagaacattgttgtaatggtgttataatatatgagaatgttttagtgaatctaatacttaaatcttttggaccaatggagatctttaggtcaataattctctctccctatgtacatatacatgtatatatttatattcatacatacacacatataaatatgtaaaaataagtatatatcatattaaatatatatttaacactatgtaaaatagtaatagcatgacatgttatatggatgcaggttaattgctgagacttaaaattactatggacttcattgaatgtgagtagcaaaccttcttgcattaattttgatatatctgattaatcggagaattgagacccactttcaataggaatttctagtctagattacatattcaaagtgtaaatttttaatggaaaatacaaattttctgtgtctctaccaatctataaaggcctttccaactgttacctcctttatgaaatctttgcttattgctttaattgaatatgccctatctcttctttaaatctcagagtgcttcctgtctttcttattttatgtcctgtttacattatgattacctttgtatttatagtgttaagcatcgagttccatagcacccagctcagtgttttatgcttaacatttcctaagtatatatattctagaaatatctgtagaatgcgtcagtggggtaggtagtgggaattgtaatgtgagaaaaactataatggttggagtgtccagagcctaataggtaagacaggtattaatgaaataatcatacaagtgaatgtctatttgcaaactgagagataagggcctgcaggaaaggaatataattttatgaaaggaatgaaaaaaaggaacctgacctggcattgagattcagagaagccaccttgaggaagtggtactgaactgaaatctgaaatgtgagtaggaattaaacttccccaaaagatgtaggggagggcaggaaaagcattggctcctaacaagagcagccagatcaaaagtctatggcacaggatagaaaatgaagaaagaccagggtggctttggtgtgggaaatcatggaaggcagagaggtgcgttgagacttggccctcagggccttgcaggcatgataggaattttaccctcaaatgtagaaatccgctggaggcttttaagtgggatgctgtgcagatggtgttaaaatgaacagatttgtgctttgagagtatcactccatcagtgggagaggatggttaataggcttgtgcagtattccatatgagaatgcctttttgaatatatcaaaaaattgctttttaaggttttagggagtatcatgtttctcttcaatgtcatctattcccatatctctctgtttaaatgactctcatgatgcaaaagtaattgtcatgtatcatatttatttgtgtaaattgtctgtcttctcttccttattccctttagtaggttataagttcctcaagagtattagtagatttttattaatttttaatttaaaaattaatttccttcttttcccctcagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatggtaagtttactatactttagtaagttgctctcatggattaatatgacactacagattattaattctattaatatagccagttaatgaaaacttcaaaaatatagaggatactaccatcctaatacatataatcctataacctttatcaaaacatttaattctcttcctcttctcttctcttctcttttcttttcttttcggcagggtctctctgtgttgcccaggctaaagtgcagtggaacaaacatggctcactgcagcctcaaccttctgggctcaagctatctttccacctcagcttcctgagtagctgagactatagacacacaccatcacacccagctaattaaaattttttttttttggtagagacaaggtctcactatgttgctcaggctggtcttgaactcctaagctcaagtgatcctcctgccttggcctcccaaagtgttgggattacaggcatgggccaccacacccagcctaattctgtttcctttgacattttctcattttaacattttatacaggggttatcatatcatatcatatcatatatcctatcctatcatatcatatcaattttctcctcatttctttctaccattatttttaatgatatagcattttattccaaagtccacttaaactgtttgagattctttatgttgcttccagctttatcttttcttaaatcattttttaacagcttctgatatcttctgccaaattgtttcctcaaactgtgtaccaacttataatgccactaacaatgagtgggaatgctagcctgaaggtctgaggagctaggactgggtgacctagaccagggtattctcccaaagttagaccagttattccaggaggtgagtcaagcacaaagtataagtgcacaagacagcatttctaagtctgagtaaggattgaggaaagttaactagggaagctaaggattgctatgatcttattatacaatatcattctaaggactcataccattattttattccagggacctagaatttagcatcagggtaaatttatttacaaattgttgaactgaatttagttcatcaccactgatgcgcaggtagtttctctctgtgcttttctttaaaccatgaggatataaaatttaggcttcacagagatctctcttcttctggatatattcttctagaagaatattcatatattattagcatttgtgaaaatcatgatggatccatctggagctttgctatagggttggtcattttccatggatcaaaatcccagatcttgcaaggggtctcgtggtctccaccaccattttgtttgcataggatttcacaagactttagtctcccagctaccttgaatggaatggggaaactaagtaagctgaattcctattaaaaaaaggagtattgcccactttgggggtaagggagaggtagtagaacatattgctctggaaaaggaaatgaaggaaagaaaaagctcatacaccctgcacttgaacaaattggctatcactggaacatgcctttgaaaaattgcaatcttctgtctctggctaagatttttagaaaaatatttggaaaactattgtcatgactagataattagaagtgcttaagtttgttttgaaactcccttgataatttaatccacaaataataagtaatttctatgtttggaaatatatgatagtcactttaattcttttttaaaatgtatgttccactcattactattaattttgtataaatgagccttttacgtatttttctcctcagatcattttatccccattgagaagtaccagttcagtctttacccaatatttatggaaggagtgggaaaaccaaagataattaatagtttcactcaaggtaaaaattataattttagtttccttttacaccaatgtgtgtgcctaatttgtttgcagtaatattgccatctgattattctttttctgatagaatcatggaagagtccaaagtcttctgtagatttttcatggtgaggttccaaaggaaatatttttttcctctaaaaataaaactggagctatagaaatagagtcactgggcctcttatatttctgattcatcttactgtacttggaataccaacattttgattttgttattactttttaaattgtcttcaaatctaagcaacctagcaatgatatttcaagagataaacatttcatttgttgttagaataaaaatcattaaaaaaattcatacatgtattatccaacagatattaattgagcattgttctaagcactgtggattgaatagtgaacataagtttctgcccttatggatcttaaataccagtgctctaattgagagtgatgggcaaaaaataattatataatgtcagatagaaataagtgccatgaaggaaaacaaaagcaagataaagggatggcattaaatgtggcactttagttgatagccagaaatggtctttctatggaggtggatgatattcgagtaaaaccttgcaagtacagtaagaccctacttgatatagtcaatagattcttggaaactgcaactttatgcaacatgaactacaggaggtccttgaataacatcattttgttcaaggtagtttcattataatgttgatgagaaaaaaaaggttttgttatacattgccatttcacttaacattgcagtttccaagagcctatcaatgatgttcagtgaagacataactgtacaaatagcaaaagcattccaggcaaagggacagtgtgtgaagagcccctaaagagtggggatgcttggtggttcaagaaacagcaaggaaatcagtgtgtgtggagtgaacaagatagagattggcaggtgtggaaggttgggtcctccaggagtagatactgagacagtcatcataacaagtttgacactttggcccattataatgtaaaaatgatcaggtagagaggaatggcaaataaataaatttgaaaaaatattttgctaatttacagtagatatgatgctgaacaaaataataagtattttattaatgtgatcacaacatatttttatcttcattttttatttttatatttttgaaggtaataagagatttgtgatgaattcagaaaatgtctactataatttttgatacagaaagaaattaatatttcctcaagtttctgagttgtgtaaattgtatttctttttcagatgatattgaaaaacaccagagtgatgcaggtttatatgtaattgtgccagtaattatttcctcttccatcttattgcttggaacattattaatatcacaccaaaggtattgtacttgaggttaagaatctttacggcaaaagtccttacgcgtattcaaaccctgatttaaaaccttctaaattaggaatattaaagtcttctaagtgcttttatatgtagtctgtatacaattaagatagcataaaaaggaaaggcctgttgtgaggaaatggcattccattttgctaggactgtaagagttaaagaatgaggaaagaaacacgaaacacagcttaacagttaaagacaggttttctttagataaaacctgaggggcttctggccaattttgttcaggagcccctttctcttacagactaagagtatgtattggttttagggtgagggggcttatcacaagcttggaatgtttatgtgtgagggagaagtttatggcggggttggaatgtctctgggaggaggggaggttatcttggggctgacatctttccagctggatggggagggttatcttggggctggcatgtgcctggtcagggaggatggaatgtttctggttggagatgttatttgtggtttatggtaatgctgaccttagccattaggctgatgccctttggatttaggtggtttttgattaaggggaattttaatatgaggtgcttgtccatgatggtgatgctcctgctctgtcaaggacaacataacttcaaggaagaatttagttttttaaaaaaaatgtacatacattcaggaaacaacaagcttataacaggaaatcctaagcagtatgttcttggaggtggcaaaaatggctttcagagttctgcagtttgggttaaggacgttttgtggtgaagtgggtggtaaaagtagccttttagtggtgacctggagcagtcagttcatttatgatcagcaggcactctgctttttagagatcagcactgtgtggctccagtctgcttggcttgtcaggcaaatgcctgagttccgtggatggtggcatgggtgccatgatactctctgtgctgagaagtccagtgtggttattttacacatgccaaatctctgtagaaaccatcgtcttcaggcaaaaaagagagagaggagattttagaatctgaatttatcttgtagttaagtgagttgatggggccacatcaaatggaattttttctggtacccactttgtgaccatttttaatatttcaatttctttgagagaaatctatccagtgtttagcatggtgcttggcacacagctttcaataagtattggctatttctattattacagtgattttcagcttgggtctagataaaagtttggtagaaatcttcatgggctagcatgtgaaaatgcatctgaccctacggaggcatagttgatctggtggactaatttctagcttgtctgttcactaactgttcacattttcaatatggatgtttttctctaattttgatgccctgtttatcctttgtagaatgaaaaagctattttgggaagatgttccgaaccccaagaattgttcctgggcacaaggacttaattttcagaaggttgctttttcaattttttttaacccagaatatatacgattgcaatctagacgccatatgacttatagagcattaagcatttttaagatttaaaaggtcatattttattcaattcatcttaatatatctgttattatatactttcaagaatagcaggatgcagggatttgaaatcaggaagaaacaaatttcagcgcatagtttatcgtatgagagttcacaatatacatatgttgcttctgtgtcacagtacataataaaataaatattagaaagttaagggtcaatctgatggagaacagatatttggatacactttttttggtataaactgtatttaggcaaaaggctggaatcaatatttttaatgtctataattatctccataattatttaaataaattagaaaattatataatcctcaaacattacaatctgaaaaatgcagtgatcataataaaacttatatttatgcagaagttccattcaagtacaagtactttatgagagttagtcaactataataaaataatttgtatttacttctatagtaggatttttcagaaagctctaaatttagtgactgttttattaattctcataatgtcccttgaagcaaagctagctttccactcataaaactggaaaaatagaattcagtcaagtcaaaatatacagatttttaaacaatacttatttggaggttattatccaggtttggtgattgcatctttatcattagtcacttgttaaaagttttcaatggtttccttttgaatacaagatataaactaaagccccctgaagctattaatagtactcaaggacctctttctacaatctgttatcaacctacctatacgactttttctatccctgggccttgatgatacctttactgttcccatccaccttcacagagccttccttgtacatgaagatcttgctctaggcccttctttcctcaagccttcctttaaccagtgtaattcaaaagaatttctaccccctttaagttcctagatcattgtactgtttttttaattgtggatagtgctctgaattcaaagactgtattttatccatcacaaatatttgtagtactcctcctgctgttctttatgtgcaaagcactgagatacatattcttacatttattaagatttttacttacattctcaatgtttcagtttcctcttctgtgaaataggctgcttaccttattaggttgtttgcgggactaaagaagatggtacttgtgacatagtaaggtctcaacaaatattaattattattgtacatatttatgtattttatattactattattattctttcagttaccctatgggacaagtgttattctctctattttgcaaaagagaaagctgaagctcatagtggttcggtaacttgttttagaggcaagattagcttaccagtttgtctggctttggagcctgttctaatagcagctgttctctatagcagtggcttctttttctttctttcttcttcgccatgacccacagtgaaaaaaacttaggttggtgcaaaagtaattgcagttttggcatttttaatgtataaatacgttttaccttccaacctagtacaccatagatacagatatgcaagaccgaaatgaaagatacgcaaagcagctttacttcttgcttgaaatagaatgttttaaaattctattttatttgttaaaaatgctggttgcaagacactaaattgatttcacaacattcgaatggcctatgatttgcagttagaaaaacactgttctacagcttatcaatgaataagtaaacaactaatattgtagacataatgaacaaagaaaaagattgaattgtaatttttcagcaggagaaagaatgccctgtcttcagaagcagcagtagtgttgttttatatacgaacaattctttttatagaaacttcgctttgcctgagtctaatcagccacactcctatatactcctcacctgtgctgttgctcactaagccagagtcttctttcattaaaacagtgttgccgagtttttcaagtaaatattttttctctcatttatcttttactaagaatttatacagtgacattttgtgtagttgtgatgatatttcagagagagatatatatatgtcgttcattcatttgttcaacaagcacatggtgagtatttatatgtaaggcttggctgttgctagggtctgggagaacagatttttcttaccatatgagaaataagacagtgaggtcagagaagagtggctgggttgaaagtagaataggaagagcttgtctccttttgcctctctaaaatagttcttttctattcatttcatccatatattcaatatgattgaatacttaccctataccagtcactatagtatgccctggcattataaggataagaaaaacactatgtgctcctgagtatacagtttaatggggatgataatcattaatacatttatcatggaaatagcattactttttttttgtacaaatttatggggcacatgagaaattttgttacatgtatataacatataatgatccaatcacaaccttatagttgtaaactacatgttgtgaaagaaggggttccattgtgctgagcgcttataatgtgggaacctggcttagtgtatccgtgggggtgagtggataaagttaagcaaattacatttgggccaagatctggtagatgaacaatcattaactaggttttgaggcagagatgtggtgtccagctaagtacctgcaaacactaagtcatgtggaaggcagtacctagcatattcacaaactggaaataggaagactataagactttttcttaaatatgagggttttatgtcaaaaaacctatatacttatctaagtaaaattgccaaattttcagtatataggtatatattaattcagggaatgatcatcttactttttaatgtcacttaaaaagaggctgaaacactctctcttcagcatttaagctctgaaatcttacctatggaccaccatgaagtggtttctcagtgttcaggagggccatgaaatgatcaggcccacatcagcaaaatgcagtttaaacctgcagcaaattatttttcccttttccagaaaatgcctggcacaaaggaactactgggtggaggttggttgacttaggaaatgcttgtagactacgtcctacctcgctgccgcacctgctctccctgaggtgtgcacaatgctgccacaggtcatctgacagaccttatatacaagtagattgaaatattgccacattttttcaagttctggtaaattaaagaaatgtgaagaatttttataatacagtgggtgtgaatgttcttatttgtaggactgattttttaaaaatctctggaaatatttgactttctaatcttataaattattttttaagcacagctaacccacaagatgcttagtttattactagggctgaccaggcgcataaataacactattaggaataaattaggttttggaatataatagaacatttaaagagtaaaggagaatataacttcaaagattttattaatgataaaaatcttctaaaattcattaacttttttctctttagcctgttgttttaatctcctaaacaattaaaatgtacccttttctttttgagacagggtctcgctctgtcacccaggctggagcgcagcggtgagatctcagctcactgcagcctcgacgtccttgggctcaactgatcctcccacctcatcccctttagtagctgggaccataggcgcgtgccaccacgcccggctaatttttgtagatatggggttttgtcatgttgcccaggctggtctcgaactcccaggctcaagtgatccacccacctcagcctcccaaaatgctggacttaacagatgtgagccaccacaccctgcctaaaatatgctttttaaaggaaaaataatatagtgtaactcactttatattactaaacaggaaaaggcaaatttaccatccaccctatgtttcatattcatgttatttaaattatttcatagggctaatagccttatattttctgatgataaaactgaggcccagagtggttcagtagcttgtcttgctcacccagcctgtccatgtaacatctgtggttcaaatccagatctatctgactcaaattgatacccgtgccatcagttccatattaacaatgtatttcttaatatgcttaatgccactaaattatacacttaaaaatagttcaaatggtaaatattgttacgtatattttaacatcataaaaatgggcaaatgatgtgaataggcatttctccaaagaagatacacaaatagccaagaagcacaaatgaaaatatcctcagtgtcattagataatagggaaacacaaataaaaaccacaagatgcccagtaggatggctataataagagacagatagtaagtgttggtgagaatagagagaaattagaattatcatatactgacagtgggaatggaatagcaactctttcggtaaatagtctgacaattcttcaaaaggttaaacatagaattattatatgatccagtaattccattcctaggtatgtactcaatagaaatgaaatagcaaatccacatgggaagttttataagaatactcatagcagtattattcataatagccaaaatgtgaaagtaacccaaatgatgaataaataagcaaacaaacaaaaaactcacactatattgcaaagaaagcagaccagaggagcctattgtttttaaaaataattcaaatacaaatatagtattttttaaaggaagtaataatttctatatcaagtgtttcctttaatttgttctccaaattcagatattttgaatattgattattatgaaagtactcttaacctgaaatttctagacatctaacatgattttcaaaatcttccctaaaattaatctattccacttttgaagctgtcattttccttccccttggtttatattaaatctaaatcctgaacctataattatgttaatcaaatgtgtttttaaaaatccaatattttgaatgtatttctaaaagaaaaatgaaaagaaaacatttatttaaaaccactatatgccagacattgctaacaataggataataccatatgtgattaaaaataattttgccaatataatttcctgccagatcttttttcttttgtatgttccacttccttttctcttttaaaattagtttttctggataatataaagatgaaaatataggacaatatgaaaacagctctatattaacacaatattttaaaactttctgcattttcttcatttttaaaataaataaaaactacaggtaaagtttgtcctgcttgttccactatttccggtccctcctcttcctggaggaacccatgatttcaagaatgctgtagcctgtgtttgtctagtttgtgcatttatactttcctactttcacatgtgtgtatccatgaccaatgaagagtaatcctttgaagtactgaaaatgttaatgtacctttcatattattccaaaaatatctctgaacattgtgttttgagctctctccaagttgatgtagttaatttagttcacacatttggactggtctgtagtattccattatacaaacatagcacaattcatttattcctctactggtggatgtttaaggtgtttgaacacttttttatatttattacaaaaagtgctgcaggaagtatggttgtatatgtctctttgttctctcatgtatatgatatttctcaatatttaaaattttttgaaaaaatatatgtgaatgacttaataatgaaatgttacagttaaatatttgagtttggaagaccacttcatgaaaaggacagtccccttttccacccctccgtacccttagtcttgctctccaaatgcctctttagttaactgtctgacttttggtttttctggtatgtcacctttttatttctaaaaaccatatgcttatgccactatgaaatgtagacggtatctattgatttctggctacaacgaggatttactcccacacattattccctccttgtgtttctacccatattgtcttgtcacttttttcaattccttaagtaatcatttctccaacctcagaaaaatctacttaaacttccatttcttgttcttttaaacagaagactatttcttggagctcccctgctatttttttttttaaataaaaacattagcactcttacgcttccctccatttctccctctactttccaatctctaaatctaagtttatgtttttccttaagtcagggttgatatgatgttctgtgttgtaatttgtctgtggtttatttttaaaaatagaaaaactaataaactgaatttgcattgttatgattatgtaaatattgtgacttactgaaccaagtatttaataatatgtgattacacttctcagtggttccgatgtcaaaggggaattttttaaaaaatatattagatatattccacctgttgatcaaaattgtgccgaattttagttagcttcatttttagtttttatcttttttcttttccttaagtttctaattgtcccttccttcctcttcctccctccattctttcatccattcatccctctctccctccctctctttctttcttttcatgctgtctttctttctccttccccttctcttccctcccctcccattatataatctatgctgttatgttacctattttatccactaccccatctttactggaggtgttgttctagtggactctccaggaactcctctatcctcctacttcaatcaggactaggctttctctaaaattactataagccatcactctaaactttcccttaactggtttctggttagtactgtttcctggattcctttccttcatctttcttaactacacccttaagtaacctcctaagaagtatgcgataagtctccatctctccatgcctgaactgccttttattctgccctcctcgattgttagtttggtggagtatcaattcttagaaatagcctttccaagagaacattgagataattcctgccttaacatatagtatccagtgttgcttctgagcagtcagatactattgtgatttttactcctcactgtttacttataatttcctttttaaacagatgcttgaaggcagcatgttcgttaagagtcatcaccactccctaatctcaagtacccagggacacaaacactgcggaaggccacagggtcctctgcataggaaaaccagagacctttgttcacttgtttatctgctgaccctccctccactattgtcctatgaccctgccaaatccccctctgtgagaaacacccaagaatgatcaataa

SEQ ID NO: 96 - DNA, 109740 bp, Homo sapiens
accttgggcgaggagttcggagcggccccatcgcagagcccacggccagccgagcgcgcgcgacgcaggtgcccgagccccggcgccgccgccatctctgccttcggtcgagttggacccccggatcaaggtgggacctgcttccctctccgacaccccctattgccacctcttcccgctctgggtaactcgagaatggggctttgggacgcgcgtggcagacgcggagccccgcgggccgcttagggactgggagtccggggcagcttagcgggaccaccagaggggccagcgcccggcgggcggcgggggtggggtgggtgcgacgccgggcgactctcggctcccgtggggcgaggaagatctggacacacggctgacagcagccggcagcgcctggagcgaacctgctcgggaccaccgagagagcatgccacccggccaacttcttttccaggcttcgtgcctactttggaaactgaagggactgccacctaaaacagtaaaccctggggtcctgaagagaatttgctggttcgaatgacaagagaaaaaataattgttctgtagggatggtttagacctcagcttttgtttcccacctccccccttccctgcaagcaaattaaacaacaacagtagcagcatcagcagcaaaaccccaaacccaatcctaaccaaaccacttactgaaagagatttgtagtggtgagaaaaagagacccaactgaggaatcatttgggaaccgcaggtatggtgccatttaaaaactggttctttctggtgttatttctagaacttgtgtttgcaaacagattagaattctgggctcttgtcagcctaatggagttctttatactgaagggtggcctggggtgtcctctgttaacatttatttctgtaagtattaaagtatattgaaacaaataccctttcacggctctggaattggaatcagaaaatctgagttttggtgtgatttccattttattacctatgacactgtggttcgtttaacctcagtgggcctcagtttcctcattttttcaagttggagggttggattaagataatttctgagggccttttgagaatatctaaggtatgccccagaataaaaaagtataattccttaactctctttaacttgttacaaacattgctagtttcataatttcatgaaataaaaacaatctgtattaatcttggcactagtttatatgcatttatgacttaggcttttaggattttcccaccaaaaggtatagagaaaaacatgtataaagagctcagaaacatatagatttatatgaatatttacacctctcatactaccttaaataatctttaagccagtatttgcaacactgcaacaaaaatacatggctttagcatagcacgtattctctttaagtattgtacatctggaggaaataaaaatgtgtttgaaggaaaacaaacattgcacctttcctatcaattattgttcttgaacagtgctggctactttttagcataaagttgtgggcagaatgttaaaaaattggtttcaggtcacttctgagccgctgtgaaattaagcacaatagcagagatgccaattttagtaatgcagttagttgccttggaatgaatcccagaaaatagcagagattaactaaacagataaaccagaaattaggaatggacacacgcacacacaaaagtgtctacagtgagtatgtactgtgaagggttagtgtacttcatactttctttttgattagaagaaaatgtcgggttgttttagcagacagagaatgttacagtagcttttgttgctacttctaatgttttatcagtagcattttcaagattatttgaaacttagttatcactagtaaggacaggtttaagaatatttctgcctcttttcggtggcttggattcaaaataataaaacaatcttttctcacccacatgtactttgtatgcagtttgggagagtgaaatggatttgaagtactcttttatgagtacattttaacttattttcagtgactttttgcctttgggctggaaatgtcgtaagttactcaggcatttatcttccctcatattctctggtgaagtagagatagtcatctccgttgaaacagatgctcagagatgtaagtaaattgcttgttgagtgaacagggaatcgtagaactcaaatataccctggttgctaagtcatttggaaaacaactgaaactggatggatccaacagctcacggtccacagccaactcattcatggcttgggagtgtcatcatgggtggcagaggctctgttcctcctttgtaatgtggggacttactctctcagcaatttactgagaaaaaagtaatctcttcacacttagatcactattataggaacaaatggtgtgtatttgtgaagtgcaatatttctgggaggtcttggaaataaatactaaaagtatccagaaaaaaaaaaaaaagaactctcttggcagatattgtactgcatttttcatactgagagccaaacacacccacttaaagagtatgtcctgtggagttaaaaatgaagaaaaaggcttatagtctgctctaattcttaagactttatgtgatttacaaattccagttttaattaaattagaaagttgcaaatgttcacctactggccacactcagtatgtacaaccttttggagttgctcttcaaatacgatctgcttatagtttggaatattccttctcaaacatgttttttggagtcttgctatgttgcccaggctgatttaatactttttgtgacttaatagtgatattacctgttatcatcacacataatcttattaatatttaaaatattttaaaactacaaatcttatataaatataaataaaatctttaaaacatttgaactgtaatgaatatagagagaagcatataaaacaaatttaatggttgacagataatatgataaatcattataataattgtaaggcaaatttctcattattcaccacccccaaaaaaagaacattgcaaatatcccaaaacttcttgtttgttccttcttcatcacaaatctaatttacctttttttaaaaaaagaaagttatttacttatttattttgagacggtgtcttgctctgtcgcccaggttggagtgcaatggctcgatcccagctcactgcaacctccgcctcccaggttcaagcgattctcctgcctcagcctcccaagtatctgggattacaggcgtgtgcctccacacctggctattttttttttttttttgtatttttagtagagatggggtttcaccgtgttagccaggatggtctcaatctcctgacctcatgatctgcccacttcggcctcccaaagtgctgggattacaggtgtgagccatcatgcctggcccaaaaaaagttttatatgattatggtaggcattaaatcatagattattttgcttaacattatgtttatgagattaagggatttcttctctctcctttaaaacaatattttttgaaagagttatctcggctgggcatggtgcctcacgcctgtaatcctagcattttcggaggctgagacgggtggatcacaaggtcaggagttcaagaccagcttggccaagatggtgaaatcccatctctactaaaaatataaaaaaatttatccagacctggtggcaggcgcctgtaatcccagctactccggaggctgaggcagagaattgcttgaacctgggagacggaggttgcagtgagccaagatcgcaccactgcactccagcctgggagacgagtgagactctgtctcaaaaagaaaaagaaaggaaggaagggaggaagggagggagggagggagggagggaggattgtctctattccctgtctccaattattctcttcacactgttaaaaaaaactcattcctattaatcttgttttcaatattctgctaaaactacgtcaaggtctactactgtcaagttcaccaatgatactacctttgctcatccagtagtcagttgtcagtgttcattttacttcactactggtagcattgtcacggttattactctgctccttgaaacagtcccttactgacttccaggacaccatgcattcttgattttcctccttcttcactggctgctcctttctgtctcctgtgctagcctctcctcttttcttagaggttttaaccttggaataccttaaggtttagctcttttttctccatgctttttgatgatttcatgcaatctctctatgtgtgtgtgttgatgattccgaaagtgatagctcaagccttgactgctccctctggacttcagatctttatattccagctgtctactgagcatttccatttggatgtctagtaggcatctccagttcaaattctccacatggaatcttcatctttcccaaacctgcactatctgcagtcttcctcatctccatctttcaagttagttaggccccaaaccttggagtcatcttcgattcctcctattctctcatacctcgtttgtaatgtgttggggaattctctgtgctctatcttcaaaacaaatccagaatataatgacttctcattacttccatggctctgttacaggaaaggggtcccaatccagaccccaagagagggttcttggatctcatgcaagaaagaattcagggcaattaggtagagtaaagtgaaaacaagtttatttggaaagtgaaggaataaaagaatggctactccatagagcagccccaaggtctgctggttgcccatttttatggctatttcttgatgatatgctgaacacggggtggattattcatgcctcccctttttagaccatattgggtaacttcctgacattgccatggcatttgtaaactttcatggcgctggtgggagtgtagtagtggggacaaccagacgtcactctcgtcatcatcttgattttggtgggttttggccatcttttttactgcaacctgttttatcagcaagatctttatgacctgtatcttgtcctgacctcctatctcatcctgtgacttagaatgtcttaactgtttgggaatgcagcccagtaggtctcagcctcattttacccagcccctactcaagatggagttgctctggttcagacgcctctgacagctcccaccctagtacaaggtgccatcaactctcacgtgagttattgcaaggacctccaaactggtctccctgcttttattttttgccctcttcaatacattctcaaaatagcaatcagagcactccttttataatgcatgtcggatcatgtcacttttctcctccaaactctccatggatttctggttcacacagagtaaaaaccaaagtccttaggataacctccaaggccctacctgatcattctgcttgccactttacctgtctggtctcatttcctactgttcttcctttcactttactcagttccagccacactgggctccttgctatttcttgactatattagaaaccatcttttcattttagcttttcctgccttgaatgcttgtcctccagatttccacatggttcgctttgttactgtcacttcttttaagtcttcgttcaaatgtctccttttcaatgaggcctactctgattacagtatttaaaattccatatcttcttaccttgtaatatattctttttcctttcctttcctttcctttcctcctttcctttcctttcctctcttctcctctcctctcctttgtgtctccctatagcattattttaccttataaaatactgtgtgactttctaattatcttttttttttctgtcccatttccactagaatgtgaactccacaagggcagaattttgtcctgttttgctcactgttgtgtccctagtgtgtgaaatagggcctaacatgtaagaggtgctcaatgctttttttggtgattgaatgctattgtttgttcatttttattcctggatatattcaattctataaatataacacgttaatttaaaacatgaattctgattatgcacatttagtttccttcctttcttcttccctcacccatcacttcttccttcctgccttcctcccttccttcttttttgccactataaataaagcagctatgatccatctacaagtgtgctagtatacgaagtttctttagagcgtaaaaccaatagacaaattacgggctagcaggacttgcagacttcaactttattagataatgaatgccacacatttttagtgtggattcaccaatttgcattcctgtttttattgctctacaccagatggacaaacttcgtattgccagaacatttaatttttcgccatctgatgggtattatctcattaatagttactactttaattactggtgagattaagcctggtgtctgtgaggataggttaggttatgctgcagtaacagataatcttcaaatctcatgggcttaatgcagttcttcactgatgcaaagtctcctatggactaagacaactctctggggcaacttctccatgtaataacttggaggtctaagttcagggaaactccatcattctgtaactgtaacaatctggaacatggaactttcccatttggtgtggtaggggaaaagacagcagggatggatactcgtgagccatcttcaaatgcttccatctgaaagtgacatgaattattttcaaatgctaaacgtaagtgtttaagatagtcatatggtaatatgacccagtaattctattcctaggcatatacctaagatggatgaaaatatacatccacacaaaaagttgtacagaagtgtcagtggcaacattcttcataataaccaaaaaacagaaactgcccaaatgtccatacactgatgaatggataaacaaactgaggtatatccatacaatggaatattattaggcaataaaagggaatgaagtgctgataaatgcttcaacacgatgatccttgaaaacatgatgctaacagaaggaagccagttactaaagaccccaggattttatttatatgaactgtccagaataggcaagtccataaacacagaaagcagatcagtggttgccggggatggaggaagctggtgaaaggggagcgactgctaatgaggaagaggtgcattgtggggtgatgataatattttgaaattagacagtggtgatgattgctctgttagatacattcactcaatgtactaaacctagtgaattgtatgctataaaagagtgaactttatgatatatgaataatagaccaataaaactgatattttaaaaaatactttaaaaataaagtatatttctatatgccatcaagaaacagaaaatgaaatattttagaaatgcatcatttaaaatgattccaaaaacatgaagttcctgtgaaaaacatctaacaagatgttcagggacttttatggaaaaaattagatgagatttacatctcatattagggaagaactcagtatatggagacagatagtcatacattttaggactgaatgattaaaggatatcaatttccttttcattgttatagactcaaaacagtctcaataggatctctattaaattcctaacaatttttttagaacttgacaagctgattctaagatgtatatggaaagtcaaaacccaaagaatgctaaagcactcttgaaaaagatgcaaaatgggagaatttgtgctatcggatagcaagactcgttttaaatctgtagtaatcaagacaatgtttctttattatttctttttcccttctactttctttgattttttctgttctaactgcttaagtgaatgttcgattaaatgttttattctaacagattataaaggaatgatagcacattaattttcagcctttcttctttttgaaaagtattatttatggctttgagctgccttctacatacttctttatctgtgtgaaataaattttgagatactgttttcactaagatcagtttaaaataggttctgattttcatatttctttttgcccagttattaacttaaaagtatttttctggttaattgaaactttagtcaatttggagtaagcttcttgatttctaatgtttctttttgcattaaagcctattttgtatgatattgatataactccaccagctttcttttgttccgtatgtgcatgttaaatcttttttccatcctttgctttcagatttctacatacttattttaaatgtgtctctgtatcctatatcatttttctgtcattctgcattcaacctttctatattcttatgttttagatgtgtctgtagtaaacagcatttatttcttaaggtattttaaattcaatgtctttccactggagaattttgtcagtttacatttaatacaattactgatatattgaggcttgtatttactttctgctttctttatttgcccataattctggttattttcttttttattgccacattttaggttgattatttttatcacttcaaattttctttcattactttaagagttatacactctatttctattgttcagtaactactgtggaagttaccatatgaatccttaagttatcgaagttgaaaatgaatacactttgagcactaatgagtacaggaaaatacagaggccttagcttactttaacttcatttaatactctcttgccatatattgtgagcatcttgaattccatttatttattcaaatatttattgagagcttactcggggctaagcattattctagatactgaacaaaatagatgagcatccctgtgcttgtaagacataacagagtgcaaacaataaacttaatagagtaaattataccatatactagaaggtagtaagtatatggaaaaaaaactagagcaaggcgaaagagattaggagtgccgagagagggagaaagagaatgaatgagagtgagtgcacataagtacaagtgaaagtgagtgagtgtgccctagctttggaccaatactgtctataaagtttgtggggacatataaatgttttatctattttcactagataacagctgaaaggtttgagccaaatagagagtctcaggtgcttctataatggtattataataggctttaaaaacgtgaaaaactcatgtttaagaacagctgttaccaactatctgttttgtgagggtggaggacaacttagtttttctcagaattaattatactttcttattgtaactttagccgctgttatttgggtctctaaacctatacaaattaagaagctatgaacatgagagaatcaaacaattagatttctgtgcacaccaacagaatttctgaaccaaagtggtttgtgtttaggagatgaaagagatgataaatcatacacacacacatagataaacacacatattatatgcatgtgtgtgcatgtgtgtgtgtgtataaacacagagagaaaacatactggcatacacataagcacctgttaattgtagttgctgttatagtagtaagatgttatctcttagaattatggtatacttatcatattagacctatccaggaggtagctgggtatctagtgtggtgatactatctagtgtggtgtcttgcaacaacactgctagtcataggtctgatttgggggagaaaatatttttttaagacagtgtctcgctctatcacccaggctgaagtgcagtggcatgatcatagctcattgcagcctcagtctctgggttcaagctaccctcctgcctcagtgtccccactgcatgctaccacacctggctaattttttcaaatttttagtagggacgaagtcttgctatgttacacagggtggtctcaaactcctgaactcaagtgatcctcccgctttggcctcccaaagcgcagggattacaggtgtggaccatcgtgccaggctgggagaaaagttttgttgacacaacaaacaggatgcaaagaaacaatctataaaaacagtaatttaggtaagtggcttcttggtcttttgattaataggattctaaacttgcaaatcaattcttatgcaggagttcttattggcatttaccgatgctctttggctgatgtttgtttttactgaccagaggttctgtgggaatctcatttattaatacttacaatgtgcttcatattcctctgcatctttgagggacaattaaatgtccactctatggaatcttttataatttcccaatcataagtaattactctgatttctcctaattacccttttttctaggtagttgtgattctttaagtctaagacagcatggatttttaagctacaccactgatatagtttggataatagtcccctccaaatctcatgttgaaacttgattcccagtgttagaggtgagtcctgaagtgggaggtgtttaggtcatggagcagatccccaaagagtggcttggtgacatcatcacagtaatgagcatgttcttactctattagttcctgtgagcactgatttttaaaaagagcttggcttgtccctcctctctcttgcttccatgctgtcactatgtgatctctgcatgctggcttcctttcccctctcctttgcctgcactatgagtggaagcaactcgaggccctcaccagatgcagtacaggtgccggtgccatgcttcttgtatcgcctgtggaaccatgagccaagaaaccttttttcttcataaattacccagtctcaggttttcctttgttacaacatgaatgaattaagataaccatcatttttgtatcagtaaaaagaaaaagctctgcgtatttaactattatacagtattttttatcatttaaaaatttatacttattcagatagctcactaagaattatatatataaacatttttatttaaatcatgccattctcataaggaaagtataaatcaaagatttcggttaagggattcttattcatattcaaagtctgtttttttcaagttgcttttcatctcagaactgttgatgtaaatattttcccaaacagtatcatactctgggctatcaagaatatttgtgatacagcaattcaaaaaagaatgcctcactattgtttctgggattttcttccaagctggttcattttgctaattttgatgcggcttttaactgatcttgtaagatgtcaatatcgggttttttggagttcatattctttcctcaaatggtctttaaatagtttgttgaccaaaatattgataggttaaaattgtccagttggtcattaagaaagtgtccagttttgatgtatgcaatcaataacaaccagatcacagctgctaccaggccatcgggaattgtaagatgctataaatttaaacaatgatgctgatgccagaggtgttaaaatgttgtgaatcttaaaacagaagacatacaatactactctcttcctttgtatttcctgtagttcaactaaaaatctcacctttcgttggcccctaggactttgtgagtagctattttctctgaaatcccatagtactttatttaatgaaaggaactaagtaataatttggggtgaaaataatccatgtacatggttaaaaaaaacttacttatgtataaaccagtagccctctgctctactacctacactaaagggtataacctgaccctaggaacaactagtttgaaccatttctggttttagtccttcttcctctagggctaaattgtatgtttatactgtctgcttttctttttttttcatttatcatttaagcagataccatagtagaagataatttagcctactcatttcacctccttttcttttttgctcctccacatatattaattttatgagctcctttattggttacatttgtcatttccaccacgatatttgttccattaactacagacagtttctcttgaacccctgcttcatgagtttgggatatttcaccctttctcctctcaccatctctccttgtatattataacacctaaatctgacaactgtgtggtgagagtattgataatattttaggtttagtatttgttattaaattttgtatttttgtctattggttgaccctaaaagttgaaaaattaataaatagcattaaagttattatgaccctgtaaatgttgtttactgcagaatcaagaagtattctacagttacatttcattcagtatggctcctgagccacccaaagaatgttcctagaatcaaagttaaggagattctttctttcaaatggattatttaattctagcatttgctaaaaatttgccatattttcttttcattcatatttacattgtgaatttctgtgacgctttttcaaattacctttattttttcttattgggaaagcatatgtgggccttcctggtttcatccttaataattttcagctttttactttctttatttttttgaatgcattttcttccttttttttttgaagtccactgactcatattctagtggcttcaattttgaattatgacttcctttttccctggtgtttattctgtttttattttattttcaagtttttttctggcttcaggattatattatgtgtcaggttgccttccatctccaccttcctccttgccatctccttttgggggccatctatactacagctgctatctggactagtcatttgaaagtttgcagagccagcaaacttgtttgtaaccacgatttcctgaatgtgtatgtttttgtcgtttttggttttctcctcattttgctggaatactttataaaattacttctggcaaataaatttatactatataaattttgtaagccattacattactaaaagtatatttgtttctctcggatacttctttgactggatgtaaaattctaaactgaaaagaattttctataagtcagttgctggattattttctagtattcggtgttttgggatgaaacatttgttttccattctctttcttactcctttagtgatttttttcttctctggaatcttttcttatattctttttttctttgttgtttggtaatttcttaattatatgtttaggaatgaatctgtttccattcttctttcttggagcctggtagccatatttttcactttgaacacttgtgccttttatctctgggaaatgtgccttttatctcttgtgccttttatctctggaaacacttgtgccttttatcgctgggaaattttcttgtattttttttgtgtgattattttctcctttctattctttttttctggaagtactgttggttggatttgggtctcttggatttatttttaagtgacttctttttcttaaacatttatttcctggttttttttttttgcctttggggggaaatgttaattatgcattttttttaaaaccattgaaattttttttttgtactatgcatgtaattttcaaaagctctttcttgctctcattattcctttgttattttatggatccaaaactttctgaaatgtctctgccaatactcattaaagatttgttaaagcttttttttttttctttaatttatccctgtgtccctggtggttagtttcctttttactttctttttataaaagaaaaatttaacacaatgctaaagactttcttcatgtctttgtgtctccattcagcatggctgttaaatgaagaaacaggaagaatgtgacttctgtgcatatgggcagtgttttatcaactgataggcttcatgttaggcactcaatcaaagagctgccatttatgctaaaggcctgttgcctaaatgtcagggctttaccataccggtgccaagtttacatgaaaagctcaagttctcaaacaacttgtactttttcctcctttaacacataggagtgtatactataatttttaaattgtctttggccatttgacacctttgaatactttgctcgtgtttgaggaatttccacttaataagcccctgttttcccaagcttcctggcagtctgcctgtagagtgtgaagtaggctccatcagttagaggcatttgtgccagattttagatcagaagtgtgggacatgaaagggcagatgagctccccggagctcagaggtagtaggcattgaggtttcagtcataacatgcagtatcctggtatggtgcagggctgtcttctctagagcaattctgcatgggattttgggtgtggtcttggctgtgtgcttttctagcttggttctctggcactcactgaggttcggagagctacccagtaaactttaataaatttctttcctgcttagactagtcaaagttcatttcagttgtttgttagtcactctcctgacagttacatggagctagtttagctgctgtgcaatgtttgtgaggaggtgaattacatacgcagatattacatgtgcagaccaaaatggcctctccttttagccccacctcaccctcctgcccttatcatttagaacatctgcaggtttgttttctcattgttgacagcctattctccaaatatcctatgtagttactacctttgttatacctcattagtctttgctaattgatatggtttggatatttgtcccctccaaatctcacgttgaaatgtaatctccagtgttggtggtggggcctggtgggagatatttgggtcatggggtgggtccctcacgaatggcttggtgccctccctgtggtaatgagtgagttcttgctctgagttcatgcaagatctggttgttaaaggagcctggcatcttcttccaccctctcttgctcccccttgccatgtgatgcacctgctccccattcactttccaccatgactgtaagcttcttgaggccctcaccagaagcagatgctggcctcatgcttcctttatagtctacaggaccatgaaccaaaataaaacacttttctttataaattacccagtctcagatattcctttttaacaatgcaagaatggactaacacactaatgttttagaaatttgtttttctcttttgctgctgatcgctctctcattcactcttgtagtgggttgatattatttactttactataattttcaaggtatctcaggagggaaagatcagtttgttcagtttaccatttttttttgagacagcatctcactctgtcacccaggctagagtacaatggtgcaattttggctcactgtaatctctgcctttcaggctcaagcgattctcatgcctcagcctcttgagtagctgggattacaggcatacgccaccatgcatggctaatttttatatttttagtagagatggggtttttccaggctggtctcgaactcctggcctcaagtgatccgcctgccttggggttccagagtgctgggattacaagcatgagccaccgtgcctagtcccagtttaccatcttgaacctgaagtcccactggtattatcgtgctttgacatgtaaaaaaattaataaaatgttatttcttaaagtaaataaattttaattattttctacatttctagcatcacatgtggtagcttgcattttattgaatatctggttaatatttaaatgagtcaatttatgtagagcttttagattacaccgtaggtaagatgcctactctgactcaactttgttgactttatggtacccacatctgtgaatcatagcttatccttatgcattttttaggaattaatatgtgacaagttcacacagagtaatatcaggaattaaagtacttgaaattatgttttccaagtgacaaatatttatgccaggatgttggaaggttttttttttaattaaaaaataatttaagtctttaacagctacttgatgggaataacatgaccaatttatattccaagtgaataaataaaagttaacatacttaaaatgacaaggctactggaaatagatcaggctatatttattttgttaaatttttgatacttgaagaaatagtgtttttcagttgcatttaaattaaatgtttaaatgcttatttaagtgagagatagacagatgcttctctaacaaaaagtaaaagcaaaaattagtggcatttggagctcattgagttaactcatcaaagcaacattattgtcagaattgcttttcttactcataaactttcctacacactcagagattttttgagatcaatggagcaagttgtaaataattttatttctgctcaaacactgattgagactgttctgttttatatttaagtagaatttgataggtaaaaataacacaaataatcctttacaatagaaattaaacagtctgatcttcctttgaaagcccaaattatgcttattcagtagaatatagatttggattttttcttcatagtaataactgaagagtaagcatgattaatatgcttactgtgctgggcatattatgcaaattaaattactgcttgcatacccatacatcatggatgtatcatttagatcagactgtggatttgtctttgtatactttatacagatttcttcaaatatttgtatatttcaacataggcttttttttcttttcatttctttctaaattcctaagggctgtttttctttttaaacgtgagaataaatatctacattaattatttattatatactttaattgattcaacaactatttatgagtacttacgatgttccagagaatatattaaaatacttgtttttcagaagtctaatatggatgagaaacattgtgcctattctttttttttttttaaattgtactttaagttctgtgatacatgtgcagaatgtgcaggtttgttacataggtatacacatgccacggtggtttgctgcacccatcaacccgtcacctacattagatatttctcctggtgctatccctcccctagccagccaccccccgacaggccctggtgtgtgatgtttctctccctgtgtccatgtgttctcattgttcaactcccacttgtgagtgagaacatgcagtgtttggttttctgttcctgtgttagtttgctgagaatgatggtttccagcttcattcatgtccctgcaaaggatatgaactcatccttttttatggctgcatagtattccatggtgtatatgtgccacattttctttatccagtctatcattgatggccatttgggttggttccaagtctttgctgttgtgaatagtgctgcaataaacatgtgtgcatgtgtctttatagtagaatgatttataatcctttgggtatatacccagtaatgggattgctgggtcaaatggtatttctggttctagatccctgaagaattgtcatactgtcttccacaatggttgaactaatttacactcccaccaacagtgtaaaagcgttcctatttctccgcatcctctccagcatcttttgtttcctgaatttttaatgatcgccattctaactgacatcagatggtatctcattgttgttttgatttgcatttctcaaatgaccagtgatgatgagcttttttttcatatgtttgttggacacataaatgtcttcttctgagtagtgtctgttcatatcctttgcccaccttttgatggggttgtttgtttttttcttataaatttgtttaagttctttgtagattctggatattagccctttgtcagatggttagattgcaaaaattttctcctattccgtaggttgcctgttcactgtgatgatagtttcttttgctgtgcagaagctgagctgtttagtttaattatatcccatttgtcaattttggcttttgttgccattgcttttgatgttttagtcatgaagactttgctcatgcctatgccctgaatggtgttgcctaggttttcttctagggcttttatgggtttaggtcttacatttaagtctttaatccatcttgagttaatttttgtataagttgtaaagaaggggtccagtctcagttttctgcatatggctagccagctttcccaacaccatttattaaatagggaatcctttccccattgcttgtttttgtcaggattgtcaaagatcagatggttgtagatgtgtggcattatttctgaggcctcttttggttccattggcctatatatctgttttggtacagtaccatgctgtcttggttactgtagccttgtagtatagtttgaagtcagttagtgtgatgcctccagttttgttctttttgcttaggattgtcttggctgtgcaggctctcttttggttccatatgaaatttaaagtagtttttaaaattctttaaagaaagtcaatggtggcttgatggggatagcactgaatctataaattactttgggcagtatagctgttttcacaatattgattcttcctatccatgtgcatggaatgtttttccatttgtttgtgtcctctcttatttccttgagaagtggtttgtagttttccttgaagaggtcattaggtattttattctctttgtagcaattgtgaatgggagttcactcatgatttggtgctctgtttgcctattattggtgtataggaatgcttgtgattttcacacattgattttgtatcctgagactttgctgaagttgcttatcagcttaaggagattttgggctgagacgatggggttttctaaatacacaatcatgtcctctgcaaacagagacaatttgatttcctctcttcctatttgaatacccttaatttctttctcttgcctgatttccctggctagaacttccaatactatgttgaacaggagtggtgagagagggcattcttgtcttgtgccagttttcaaagggaatgcttccagcttttgcccattcagtatgatattggctatgggtcataaatagctcttattatttttagatatgttccatcaatacctagtttattgagcgtttttagcatgaagcagtgttgaatattatcgaaggccttttctgcatctattgagacaatcatgcggtttttttttgcatataaatataatagaatattattcagccttaaaacggggtgaaattttgatacgtggtacaacattgataaactttattttattttattttatttattattattattatactttaagttttagggtacatgtgcacaatgtgcaggttagttacatatgtatacatgtgccatgctggtgtgctgcacccattaactcgtcatttagcattaggtatatctcctaatgctatccctccccactccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatacacccagtaatgggatggcggggtcaaatggtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctacataaatgtcttcttttgagaagtgtctgttcatatcctttgcccactttttgatggggttgtctgtcttcttcttgtaaattagtttgagttcattgtagattctggatattagccctttgtcagatgagtagtttgtgaaaattttctcccattttgtaggttgcctgttcactctgatggtagtttctttggctgtgcagaagctctttagtttaatgagatctcatttgtcaattttggcttttgttgccattgcttttggtgttttagacatgaagtccttgcccatgcctatgtcctgagtggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcagtgttatttctgagggctctgttctattccattgatctatatctctgttttggtaccagtaccgtgctgttttggttactgtagccttgtagtatagtttgaagtcaggtagagtgatgcctccagctttgttcttttggcttaggattgacttggcgatgcgggctcttttttggttccatgtgaactttaaagtagttttttccaattctgtgaagaaagtcattggcagcttgatgcggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagctggattcctaagtattttattctctttgaagcaattttgaatgggagttcactcatgatttggctctctgtttgtctgttattggtgtataagaatgcttgcgatttttgtacattgattttgtatcctgagactttgccgaagttgcttatcagcttaaggagattttgggctgagacaatggggttttctagatatacaatcatgtcatctgcaaacagggacaatttgacttcctgttttcctagttgaataccctttatttccttctcctgcctaattgtcctggccagaacttccaacactatgttgaataggagtggtgagagagggcatccctgtcttgtgccagttttcaaagggaatgcttccagtttttgcccattcagtatgatattggctgtggatttgtcatagatagctcattattttgagatatgtcccatgaatacctaatttattgagagtttttagcatgaagggttgttgaattttgtcaaaggccttttctgcatctattgagataatcatgtggtttttgtctttggttctgtttatatgctggattacatttattgatttgtgtatattgaaccagccttgcatcccagggatgaagcccacttgatcatggcggataagctttttgatgtgctgctggattcggtttgccagtattttattgaggatttttgcagcaatgttcttcaaggatattggtctaaaattctcttttttggttgtgtctctgcctggctttggtatcaggatgatgctggcctcataaaatgagttagggaggattccctctttttctattgattggagttgtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctgatttagtcttgggagagtgtatgtgtcgaggaatttatccatttcttctagattttctagtttatttgcatagaggtgtttgtagtattctctgatggtagtttgtatttctgtgagatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttacatatttcttgccttctgctggcttttgaatgtgtttgctcttgcttttctagttcttttaattgtgatgttagggtgtcaattttggatctttcctgctttctcctgtgggcatttagtgctataaatttctctctacacactgctttgaatgtgtcccagagattctggtatgttgtgtctttgttctcgttggtttcaaagaacatctttatttctgccttcatttcgttatgtacccagtagtcattcaggagcaggttgttcagttaccatgtagttgagtgtctttgagagagtttctgaatcctcagttctagtttgactgcactgtggtctgagagacagtttgttataatttctgttcttttacatttgctgaggagagctttacttccaaccatgtggtcaattttggaataggtgtggtgtggtgctgaaaaaaatgtatattctgttgatttggggtggagagttctgtagatgtctattaggtctgcttggtgcagaggtgagttcaattcctgggtatccttgttaactttctctgtcgttgatctgtctaatgttgacagtggggtgttaaagtctcccattattattgtgtgggagtctaagtctctttgtaggtcactcaggacttgctttatgaatctgggtgctcctgtattgggtgcatatatatttaagatagttagctcttcttgttgaattgatccctttaccattatgtaatggccttctttgtctcttttgatctttgttggtttaaagtctgttttatcagagactaggattgcaaccccggtctttttttgttttccatttgcttggtagatcctcctccgtccttttattttgagcctatgtgtgtctctgcatgtgagatgggtttcctgaatacagcacactgatgggtcttgactctttatccaattttccagtctgtgtcttttaattggagcatttagtccatttacatttaaagttaatatcgttatgtgtgaatttggtcctgtcattatgatgttagctggttattttgttcattagttgatgcagtttcttcctagcctcgaaggtctttacaatttggcatgattttgcagtggctggtaccagttgttcctttccatgtttagtgcttccttcaggagctctttcagggcaggcctggtggtgacaaaatctctcagcatttgcttgtctgtaaagtattttatttctccttcacttatgaagcttagtttggctggatatgaaattctgggttgaaaattcttttctttaagaatgttgaatattggtccccactctcttctggcttgtagagtttctgccgtgagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccaagttggtcactttcaggtacaccaatcagacgcagatttggtcttttcacatagtcccatatttcttggaggctttgttcgtttctttttattcttttttctctaaacttcccttctcgcttcatttcattcatttcatcttccatcactgataccctttcttccagttgatcgcattggctcctgaggcttctgcattcttcacgtagttctcgagccttggctttcagctctatcagctcctttaagcacttctctgtattggttattctagttatacatttgtctaaatttttttcaaagttttcaacttctttgcctttggtttgaatttcctcctgtagctcggagtagtttgatcgtctgaagctttcttctctcacctcgtcaaagtcattctccatccagctttgttctgttgctggtgaggaactgcgttcctttggaggaggagaggcgctctgctttttagagtttccagtttttctgctctgttttttccccatctttgtggttttatctacttttggtctttgctgatggtgatgtacagattggtttttggtgtggatgtcctttctgtttgttagttttccttttaacagacaggaccctcagctgcaggtctgttggagtttgctagaggtccactccagaccctgtttgcctgggtatcagcagcagtgtctgcagaaccgcggattttcgtgaaccgcgaatgctgctgtctgatccttcctctggaagttttgtctcagaggagtacccggccgtgggaggtgtcggtctgcccctactggggggtgcctcccagttaggctgctcgggggtcaggggtcagggacccacttgaggaggcagtctgcccgttctcaggtctccagctgcgtgctgggagaaccactgctctcttcaacgctgtcagacaggaacatttaagtctgcagaggttactgctgtctttttgtttgtctgtgccctgcccccagaggtggagcctacagaggcaggcaggcctccttgagctgtggtgggctccacccagttcgagcttcctggctgttttgtttacctaagggagcctgggccatggcgggtgcccctgccccagcctcgctgccgccttgaagtttgatctcagactgctgtgctagcaatcagcgagactccgtgggcgtaggaccctccgaaccaagtgcgggctataattctcctggtgcgccctttcctaagcctgtcggaaaagctcagtattcaggtgggagtgacccgattttccaggtgccgtctgtcacctctttccttgaccgggaaagggaactccctgaccccttgcgcttcctgagtgaggcaatgccttgccctgctttggctcgcgcacagcgcgctgcacccactgtcctgcacccactgtctggcactccctagtgagatgaacccggtacctcagatggaaatgcagaaatcacccgtcttctgcgtggctcacactgggagctgtagaccagagctgttcctattcggccaccttggctcctccccccatcatgtggtttttgtcattggttctgtttatgtgatagattatgtttattgatttgtgtatgttgaagcagccttgcatcctagagatgaagccgacttcatcgtggtggatgagctttttgatgtgctgctggattctttttgccagtattttattgaggatctttgcaccaatgttcatcagggatattggcctgaaattttctttttttgttttgtctatgccaggttttagtatcaggatgatgcgggcctcataaacgagttatggaggaatccctcttttcctgttgtttagaataatttcagaaggaatggtaccagctcctctttgtacctctggtagaattcggctgtgaatctgtctggtcctgggccttttttggttggtaggctattaattactggctcaatttcagaccctgtttttggtctattcagggatttgacttcttcctagtcttgggaggtgtatgggtctaggaatttatccatttcttctagattttctagtttatttgcatagaggtgtttatagtattttctggtggtagtttgtatttctgtgggatcagtggtgatataccctttatcattttttattgtgtctatttgattcttctctcttttcttctttattagtctggctagtggtctattttgttgatcttttcaaaaatccagctcctggattcactgagtttttgaagggtttttcgtgtctctatctccttcagttctgccctgatcttagttatttcttgtcttctgctagcttttgaatttgtctgctcttgcttctctagttcttttaattgtgatgatagggtgtcaattttagatctttcctgctttctcttgtgggcatttagtgctataaatttccctctaaacaccgctttatatatgtcccagagattctggtacgttgtgtctttgttctcactggtttcaaagaacatctttatttctgcattaatttcattatttacccagtagtcattcaggagcaggttgttcagtttccatgcagttgtgcagttctgagtgagtttcttaatcctcagttataatttgattacactgtggtctgagagacagtttgttatgatttctgttcttttgcatttgctgaggagtgttttacttccaattatgtggtcaattttagaataagcgcgatgtggtgctgagaagaatgtatattctgttgatttggggtggagagttctgtagatgcctattaggtcttcttggtccagagctgagttcaagtcctgaatatgcttgttaattttctttcttgttgatctgtctaacattgacagtggggtgctaaagtttcccactattatcatgtggcagtttaagtctctttgtaggtcattaagaacttgctttatgagtctgggtgctcctgtattgggtgcatatatttaggatagttagctcttcttgttgcattgatccctttaccattatgtcatgctcttttttgtcttttttggtctttgttggtttaaagtctgttttatcggagactaggattgcaacccctgctttttcttttttgctttccatttgcttgataaatattcctccatccctttattttgagcctatgtgtctcacatgcaaaggcatgtgagactggtctcctgaatacagcacactgatgggtcgtgactgtttttccaatttggcagtctgtgtcttttaattggggcatttagcccatttacatttaaagttaatattgttatgtgtgaatttgatcctgtcattatgatgctagctggttgttttgcccattagttgatgcagtttcttcatagtgttgatggtctttactatttggtatgtttttacagtggctggtactggtttttcctttccatgtttagtgcttccttcaggagctcttttaaggcaggcctggtggtgacagaatctctcagcatttgcttgtctgtaaaggattttatttctccttcacttatgaagcttaatttggctggatatgaaatcctgggttgaaagttcttttctttaagaatgttgaatattggcccccactctcttctggcttgtagagtttctgcagacatatccactgttagtctgatgggcttccctttgtgggtaacttgacctttctctctggctgcccttgacgttttttccttcatttcaaccttggtgaatttgacgattatatgtcttcaggttgctcttctcgaggagtatctttgtggtgttctcgtatttcttgaatttgaatgttggcctgtcttactaggttggggaagttctcctggataatatcctgcagagtgttttccaacttggttctgttctccccatcactttcaggtacaccaatcaaacataggtttggtcttttcacatagtcccatatttcttggaggcttagttcatttctttgcattctttttttttaatcttgtcttcatgctttatttcattaagttgatcttcaatctctgacatcctttcttccgcttgttcaatttggctattgatacctgtgtatgctttacaaagttctcatgctgtgtttttcagctccatcaggtcatttatgttcttctatatactggtttttctagttcgcaattcctctaaccttttttcaacattcttagcttccttgcattgggttagaacatgcttctttagctcaaaggagtttgttattacccaccttctgaagcctacttctgtcaattcatcaaactcattctgttcccttcctggtgaggagttgtgatcctttaaatgagaagcggcattctggtttttggaattttaagcctctttgtgctcgtttttcctcatcttcatggatttatctaactttggtctttgatgttggtgacctttgaatggcgtttttctgtggaatcctttttgctgatgttgatgctattcctttctgtgtgttagttttccttctaccagtcaggcccttctgctgcaggtctgatggagtttgcttgaggttcactccagaccctgtttgcctgggtatcaccagcggaggctgcagaccagcaaagattcctgcctgttcctttctctggcagcttcgtcccagaggggtacccaccagatgccagctggagctctcctgtatgaggtgtctgttgacccctgctgggaggtgtctctcagtcaagaggcagggtggttaggaacccatttgaggaggcagcctgtcctttagtaaagctgaagcgctgtgctgggggatccactgctctcttcagagccatcaggcaggaatgtttaagtctgctgaagctgtgtccacagccacattcttcccccagggagaatgctgtgtcccagggagatgggagttttatctataagcccctgactggggctgctgcctttctttcagagatgccctgcccagagaggaggaatctagagaggcagtctggctacagaggctttgtgtgcagcagtgggctccacccagttcaaacttcccagagaccttgtttacactgtgaggggaaaactgcctattcaagcctcagtaatgacggacattccttcccccaccaagcttgagtgtcccaggtcgatttctgctgtgctggcagggagaatttcaagccagtggatcttagcttgctgggctccatgggggtggtatccgctgagctagaccatttgactccctggcttcagcctttccggggaagtgaacggttctgtctgtcttgctggcattccaggcactgctggggtatgaaaaaaaaaactcctgcaactagtttggtgtctgcccaaatggctgaccacttttgtgcttgaaacccagggccctggtggtgtaggcacccgagggaatctcctggtctgtgggttgggaaggccatgggaaaagcataatatctgggccagagtgcactgtccctcacggcacagtccttcatggcttcccttggctaggggagggagtttcttgatcccttgcacttcctggatgagccaacgccccatcctgcttcagctcaccctccgtgggcggcacccactgtctaaccagtaggaatgagatgagccgggtacctcagttggaaatgcagaaatcacctgcctcctgcgttgatctccctgggagctacagaccagagctgttcctattcagccatcttgccagccacccccgcctgttctttttttgtgttcttcttgctaaatttatttagcatgagaacagcaatagcatgttctcacataagaagctgactaacagaatgcacagcatataaaaaatgtgctatttgtatagaaataatttgtcaacttcagcaatcagtttgagacccacatatcacctggatgaatggttctcctgcagaatctgattcagaggaaagagtcatgtggtgcggtgacttgaaagagctgtggtgaataattgaattctaagaatggccacagtagactccctgttaatatttctgaaaagtagggttatggagcacatattattaaactgttatttttaatagacatcttatacttgtatctggtctgtaagaccagtcatattagtgtacatttttcaattagtttactttggaagtgggcacaggggtctacactgctcaaatctgtaattataattaccttatgataatttattatggcaataatgggaatttgcttatttttctttgaaaaatgttttcaagctatacttgtttctgccatgatagagaacttttgcaacattcatttttgttgtgagagtagagccacaatgattttctaatgagaattgattaagccctttccttaccctagcccagttctaagtattgtcagtggtgattgggatagagggtagtctgtttggcatgtttccatgtcatgtgaggatgtcaaccctccgtctttttgaatgactgctaaggcacattactccttttaactgtcaacagagaatgactactactgtggtctgaatgtttgtgccaccacagaattcatatgttgaaacctaattaccaatgcaatagcattaagaggtggggcctttaggaggttattaggtcatgagggtggagccctcatgaatgggattagtgcccttataaaagaggctgcagcggagcttgttcaccccttctgccatgtgaagacatggcaagaaggcaccatctatgagaagtagtccttcaccagagattgaatctgctggcatgttgatcttggactttccagcctccagaattgtgagcaatacatttcctttctttataagccactgagttcgtggtattttgttatagcagcccaaatgaatgaagaaaactgcattccaggggaatgttaggcagtattatctcacctcttcatagtgtgatgtctgtgactggctcagttcatgcagctctacttgtggaatgtgcattacatttatttatctatatcaggaattcttaatcctggagaaatttcaagggattgttaaccccttgaaattatagccctaattttagttgtatgtgcttcctcatggcgttgatacacttctttcaccaaattctcagtcaggtccatgttccaaaaaatggttaagaatcaccattttgaaatccttcttgctattatgccagattctcaaacagctgtatctggatgataggagaatgcctctttgaaggttgcttttgtgcatgttggcatgggggaggtgctaaaatttcagatgggatggccagggcaggctcctttagaaggtgagttgagtggtggggagagcagtggatgacgagtgggatctgggaccttgtagtcctgttcaggacttggacttttactacaagtgacaggagagggctgtagtgctttgagaaagagagacatgatctggtcaatgtgttaataagatcactgtgactactgtgttagagagacatgatctgatctgtgttaagaagatcactttaactgctatgttgataactgactgaactggggagcaaggacagaagtagagagcctcttctgatagttccgggaagaaataattgtggcatagaacagggtattggtagtggagagggtgacaaattattaaattttgaaattgctttgaaactctggtattattaggatgttcatgaggatgttagctgttattttataaaattaatcaataattttcttagtgttaggattatttgtactcttctcctaaactgttcatttcattttaactactcagaatttataattgaacaatacaaccataagaaaagttagaacaaattaatggttcatccttaggaagtgtcttcatattaatggtgtttggtgtattaggcttattttggtcatcctatctttaattttccctttgcttcattcttttttcaccaatttaaaaaatttctgtcactttttctgtcttttatttagacagagtctcactttgtcatccaggctggagtgcagtggtgtgatctcagctcactgcaaccttcacctcccgggttcaagtgattctcttgcttcagcctcccaagtagctgggattacaggaacacgccaccacacccagctactttttgtatttttagtagagacagtgtttcactatgttggccaggctggtcttgaactcccgacctcaagtgatccacccgccttggcctcccaaagtgctgggattgcaggtttgagccactgcacccagcctctttttctgtattatttgtgttttaaaaaacttctttatattcctttttgtacagtttagggtgcatgtttctctcattgaatctatgtcagataccacctttcactgtctcttcaaggttgtgtctatgtcctttttacacttgtgattgtttctctgttatttaagaatgaaacctgattccacgaatccaaaccatcagaatagtttgtgttttgcatggaacattaaataaagaagtggttgttttatgtaaggaaaactgctgatctatttgatcacttaactgaggagaccaggtgagttaaaaacaagccaaatcatttgttgaactgaattactatagtcactagtaagtttcatcaaagcaatccagtgatatgttgtatctgtgacacatcttgactataaaacttgcccttgagtttattttatgagaacatcttatatcaagaacaggtagcataaaaagcagggaggaatttgtactcatttaatataattaaatcatgagggttccaaacagtgtactgatttctagaaatcctaaagaaccattgtgatatcagtgtataaagaacaaaaattctgatgacaaacttgtagtgtgaaaaacaaatttactggactacccactgtttatactcatttattttcttcctgatagtaagttgtaaaataaacaaacacttttttccatttacttatcatgtggtgccaattctcacttatcatatggtgccaattctcagatatgagtcatgagacatgtttcttaatgtttttttttttttttgaatcagaagtttttttttttgttttttttttgtttttttttttttttatactttaagttttagggtacatgtgcacattgtgcaggttagttacatatgtatacatgtgccatgctggtgcgctgcacccactaacttgtcatctagcattaggtatatctcccaatgctatccctcccccctccccccaccccacaacagtccccagagtgtgatattccccttcctgtgtccatgtgatctcattgttcagttcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattatggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtgtaaggtgtaaggaagggatccagtttcagcttcctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtaccagtaccatgctgttttggttactgtagccttgtagtacagtttgaagtcaggtagtgtaatgcctccagctttgttcttttggcttaggattgacttggtgatgcgggctcttttttggttccatatgaacttgaaagtagttttttccaattctgtgaagaaagtcattggtagcttgatggggatggcattgaatctgtaaatgaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatagaatcatgtcatctgcaaacagggacaatttgacttcctcttttcctaattggataccctttatttccttctcttgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagggttgttgaattttgtcaaaggctttttctgcatctattgagataatcatgtggtttttgtctttggctctgtttatatgctggattacatttattgatttgtgtatattgaaccagccttgcatcacagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcctccttgtacctctggtagaattcagctgtgaatccatctggtcctggactctttttggttggtaaactatcgattattgccacaatttcagctcctgttactggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcctttcaaaaaaccagctcctggattcattgattttttgaagggttttttgtgtctctatttccttcagttctgctctgattttacatatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttgggttggagagttctgtagatgtctattaggtccgcttggtgcagagctgagttcaattcctgggtatccttgttgactttctatctcgttgatctgtctaatgttgacagtggggtgttaaagtctcccattattaatgcgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttcattggagcatttagtccatttacatttaaagttaatattgttatgtgtgcatttgatcctgtcattatgatgttagctggtgattttgctcgttagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctgtaaaggattttatttctccttcacctatgaagcttagtttggctggatatgaaattctgggttgaaaattcttttctttaagaatgttgaatattggcccccactctcttctggcttgtagggtttctgatgagagatccgctgttagtctgatgggcttccctttgagggtaacccgacctttctctctggctgcctttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagttttttccaacttggttccattctccccatcactttcaggtacaccaatcagacgtagatttggtcttttcacatagtcccatatttcttggaggctttgctcatttctttttattcgtttttctctaaacttcccttctcgcttcatttcattcatttcatcttccatcgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagagacgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccgtgtgaggtgtcagggtgctcctgctggggggtgcctcccagttaggctgctcgggggtcaggggtcaggaacccacttgaggaggcagtctgccggttctcagatctccagctgcgtgctgggagagccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttggagcttcccgctgctttgtttacctgatcaagcctgggcaatggtgggcgcccctcccccagcctcgctgccgccttgcagtttgatctcagactgctgtgctagcaatcagcgagattccgtgggcgtaggaccctccgagccaggtgtgggatataatctcgtggtgcgccgttttttaagtcagtcagaaaagcgcagtattcgggtgggagtgacccgattttccaggtgcgtccgtcacccctttctttgactcggaaagggaactccctgaccccttgcgcttcccaggtgaggcaatgcctcgccctgcttcggctcgcacacggtgcgtgcacccactggcctgcgcccactgtctggcactccctagtgagatgaacccggtacctcagatggaaatgcagaaatcacccgtcttctgcgttgctcatgctgggagctgtagaccggagctgttcctattcggccatcttggctcctccgtgaatccgtttcttaatgttttacactattctttgtggtaaagtgtggtttccattttaaattacatctctcagaataataggcagctctgaaaggggttgtagagaccatctaacagtctgatttgtagatgaggaacctgaggtctagagtgttgaaaacccaagtcccacagctgattaccggaagagcttagcctggcacccaacactcctgatgcctaattcaggtaggttttcatccaaagtccaagccacatatattaaaattatactactatttggatttatgacatagtagtacaaataatcatatttgtgatactccaacttgagtagaactcataggaaatcttgtctctgaagtcggacttcatgtgggtatattaagccaccagacttttaattattctaactctccaatattacctcatctgcaaataaacaataggtttccaaaggtctactggtaaaatttctcctctttattggaaataaataggcagttgttacctatgcaataattatttggccttacaatatcatagtaaagataaagactttagaaaacagggaaattttaagacctgagcatgaaagaaattgaagacggtgatattaatgatgttaaattagctgttacatattttatcaacattgtgagcacttgcatttagttaaaatttcagtcttatcccgtgatacctgtcctggtttgttatggcataaaggaacattcagtttaaattttttcgacttgtatttttaatgatgtaagataggatgcgtacaggaataaatctgtagcctaattttacgtgagatatttctcagatattgatctagagtatcacatgtaaatttagagacttatctataatccctttccttttatgttttccacagacaacttatatatatgtgtttttgtttttgtgtgtgttctgattttagatttaccttttccaggtgtacttctctgaagtaagatgatttgtcaaaaattctgtgtggttttgttacattggggtaagttatttgctcatttgctgttttaatgcccttaaacatggtagagattttgcctttagagatgctgttttatttattagctaacagaatttcctatttctagttaggaattctcatacatgcttatgattaaaaatgcaaaccatagtataggtgtatcagtgtgaaaacgaaaacccttcccaacctcctaaagacaacctgatggtgtatccttccagaatcctctctctctctcacacacacacacacacagactcacacacacagactcacacacacacatacacagacacactcatatctatagctgcaaaaatagcactggtctgtacatgttgttctggatgtttatttttccatttaacaggtttccaatttatcatgatggctttttacctttatcagtatttaccgggatacttattagtttaatggttgcatgacaatgcactgtatgaatatatataaaattattagtctatttgaccaattcctgattgatagacatttctttttctgtaacaaataatactgcattgaaacttcatgtgtctttgtatatttggaaaaatatttctgtagattaattcttttttttttttttttttttgagacgcagtcttgctctgccgccagactggagtgcagtggcatgatctcagcccactgcaacctctgcctcctggattcaagcaattctcctgcctcagcctctcgagtagctgggactacaggcacgcgccaccatgcccagataatttttgtatttttagtagagacggggtttcactgcgttggccagatggtctcaatctcttgacctcgtgatctgcccgcctcggcctcccaaagtgctgggattacaggcgtgagccaccgtgcccagccgatacattgccaataacttttgagcatactgttctcacgtgtttcttaccacattctggtgacattctgatttccttaaaccaaatcatctaagttagattgtgttccaagtttttgaaattaaagttagagtatctttaacaaaacttatgtgatttggcaattgtttatctagctttctttaacaaaacttatgttgtggcaactttatctggcagctgttacctgtgtgtcaactgattctgagcatctccttggctaccccaatctaaaggggctcttctaagcttccctataggtcttccttgtggtacatacttctctttcattgcagccatctgtatatttccagaaaataacctagatagctccaccattacagatttccaaaaaattatgccacaagggactatcaaagagaaataactcattctctttttatattctctaattttattagatatatttaagggaactgttcattctcttttataattctctattaattttcgttagactctagtgttttacattgactttctggaaggtttctggtttgatcaagtttttgaatcaaaagaattcctgggatattgttacctgataagatatgccttcagatgaaaattctagaccatctttagagtttaggattcatttggagggaaagaaatatcatttgcaaagttgcatgtggataaaatagactcatcttttaatttaactgcatcaatagttgctatgtttttaaagttcatcattacattttacatttaaatacttctgtgaggattttaggctaattcatttcaagcaactgaatcctctatgtagacctagaatatataatgctgtaaattagtaatattacatattcttggttttgtaaacctcctccctcaaaaaactattctgttttctttgaggtgttctgattttagaaacatgttagaaggagtgaagtccaaaggaacataattgtaatatggatttacttttggtaatgttgtgatacctaattgttatcagtatggccatagtcacatttgtcacattaatcactttggcctcaatttttgcatctatacctatttatattaatttatatctatagaaatctttagaaaccaaactattaacagtcattacctatgtattgtttgaatattttcactgataattgcttttgtaatgaaaaaatacatttgtgaattgattaaaaattttattttcttacatttttaaaaagcctttattttttagagcagttttaggttcacagcaaaattgagaggaaggtacagagattttccgtagactccctgccccacacatttataaccccccattatcaactatcccccctcagagtggtacatttgtcacaattgatgaacccatactgacatatcattgtcactcaaagtccatagtttacattatggttcactcttggtgttgtatattgtatgaatgttgactgatgtatgtatagtgacctttatctgcagctttagaaacatacagaagaatttcactgccctacccatcctttgtggccttcctattcctccctccttcttacctaactcctgggaactgccgatctttttactgtttccatagttgtgcgttttatagaatgtcataatgtcatatagttggaataacatagtatatagtcttttcatactggtttctttcccttagtaatatgcatttatgtttcctccatgtcttttttttcctctttaaatttttatttttttagattcagaggttacaagtatggttttgttacatggatatgttgcgtagtatgtacatcacctgaatagtgaactttgtgtacaatactacttataagtgagaacatgtggtattggattttctgtttctgagttatttcacttagaataatggcctttagctccatccacgttgttgcaaagtacatgcttttattcttttttatggctgcatagtattccatggtgtgtgagtgtgtgtgtgtgtgtgtgtgtgtgcatgtgcatgtgtgtgaatatgccactttttttaatgcagtcattcattgagggacacttaggttgattccatgactttgctattgtgaatagtgctgtgacaaacatatgaccgcaggtgtctttttgttacaatgatttcttttcctttgagtagatacttagtagtgggattgctggattgaatgatagttctacttttagttctttgagaaatctacacattgttttccatagaggttgtacaaatttacattgccaccaacagtgaataagcatttccttttctctgcatcctcaccaacatctattattttttgactttttaataatggccattcttactggtataagatggtatctcattgtagttttaatttgcatttttctaatgattagtgatattgggcatttttttcatgttcattggctgcttgtatgtcttcttttgagaaatgtcttcatttcttttgccttctttttaatgggattatttgtttttttcttgttgagttgtttgagttccttctaaattctggatattagtcctttgttggatgcatagttctggaagagtgctggaacctctgtatcttttcgtgacttgatgtctcatttctttttagccctgaataatatttaattgtctggatgtaccacaatttacccattcacctactgatgaacatcatgtttacttctatttccttacattattacatttgccaaactcttcaaaattctcatttcatacaaatccatacaagattctcagaattcgtattctgcattagtgtctatataagccaacacaattgttgcatcatttgggtaacttactgaaaaaacaattatggagaattattttattttcaaacaaatatttaaaaataagtttggctgggtgcagtggctcatgcctgtaatcccagcactttgggagaccaaggtgggcggatcacctgaggtcaggagttcgagaccagcctggccaacatggcaaaaccccgtctctactaaaagtacaaaaattaaccgggtgtggtgggaggtgcctgtaatcccagctactcaggaggctgaggcaggagaattgcttgaacccgggaagcagaggttgcagtgagtcgagatcatgccactgcactccagcctgagcaacaagagcgaaattccatcttaaaaaaaaaaaaaaaaaaaaaaaaaaaagacaaggtttaacttttgcagatcttttggtacaggattatataattgttcttaatttttatatttaaacagtgataatttaatcagcagtgggcatttcccataagaagtctattcttttgcatcattttttgtgtaatgtgctaagggcatgtcttatatgatgatgttttgtatttggaggatcatgggaaaattcaggagatcatcaagccatcatcatgttgaagacaaattctttctaaaagtgctcagcgaaagcagtgttaatattttggtgttactctcttaaatacatattaaaatagcactttaatgtttgtttatataattgcacatccagatatttatttatcatttatactggatattatatttatcatttataatggaagctagaataatatgctttagaaaggaaaaataaaatattcagtgtttgtttccttttattaaaacataaatataaaatgtcagcttaaagagaaaacatgaagtgtgagtcttcaaaaagaaaagagatgtcagaaagtggagtaatttctacaaatgaatgcatcctcttgaatgtaacacattgtacaatggaagcacaaagttattcattagacactcactgaggacttagaaagttaaataattattgagcactacatggtttaatctcagatactttctattcatgtcttagtcaaaatgattacttttttctatgtgtctttttaatatcctaacagaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaataggtaagcattagctatgttttaaatgtattgaacaatgttttttaattctttgatacctgtatgaaatagatgtcttatggctatgattttaacatacataatcatttttatatggataataaaattaggattcattatgtgaacaaactaataaataatttccaaattatcttgtatcccataaaaatataatgagggaattattttacttttaagtacattccttgtagtcttctaaatttgctttgaaatagaaaaacacaccttatttttgttaaatgtataaaatatcaaatgactgataatattgttgaattggttaaattttaaaatattcatgaataataataattcttcaggcaaggaatatctctgaaagaatatacgttttaaagatgggtttttcagaaagaatagctaatggatgctgggcttaacacctaggtgatgtgatgatctgtgtaacaaactgctatggtacatgtttacctatttaactaacctgcacatcctgcacatgtacccctgaactaaaaataaaagttggaaaaacaaaaaaagaaaagaaaaaaattctttttttttgtttaagtataatgcatactgattgtagctagtgtagttaaaaattctgcatctggaaatataaacaacaaaattatcccaagtcttttggaaaagctaggaagagtggagtcaattgactcatccatgtagagagacctccagtatgaaaatacaggcatatcttttcctcccttaaaagcgtgatgattgggttttcacatgtatgagtgagatgtgcctccctcagaccttgttatgatgttggcacattacctgtctaatgttaaaaaaaaaaaaaaaaggctgggcacagtggcttaactgcctgcaatcctagcatttaggaggcctaggcgggcggatcacttgagctcaggagttagagaccagcctgggcaacataatgaaaccccatctctaccaaaaaaaaaaaaaaaaaaaaaaaaaaaaattaactgggcatggtggtgcatgcctctagtcccatctacttaggagactgaggtgggaagattgcttgagagatggaggctgcagtgagccatgatcacatgatcatgccactgcactccagcctgggtgacagagtgacaccccatctcaaaaaaaaaaaaaaaaaaggaaagaaaaagaaaagtgagaactgagctaggtgagttttgagctcttttgtcctatttaagtggtttgaaattaaagaaaatttgagaagcaataattgaatttaattctattactttagaaaaaaggaaactgagggccagagggactaagtgatgggcaaacgcatgccactagttaaagcttgttctttttctctcagaataggcaatggaagttgtatcagaacactggtaaatttgatttagctcttctctttcactgagttgttcagatggtttttgagatttcatgtagttgtttttttttttttttttttttttttttaaattcagatgcaaactggaacatacagtgctggctaaaaggagacttaaaattattcatctgttatgtggagtcattatttaagaatctattcaggaattataactataaggtccatcttttatatgttctgtaagtaccaaataattaatttggcatttctaatacacagtttttttaaaagagctttcatatacggaagtagattataaacctcttgcatccctacatttcctattatatgttttattttttaatatagcattctgctctgttaggtttcctcttttctcctcctgctaattgaggtagcaagacagtcaggtttagggtcacgattgtcaggtccatgagtataccaaatgttcagttcaagttcaggttctagctcacactgaggtccgaagggagtgggtggatgggcaatagctgaacgaacactctgggggccttaaacaggtgaaacgtagttttattcagcagctctctatcagcagcttactcaaactaggtctctcattagcagctctcttagcagcagctttctctcactgtctgctctgttttgactgcttgggccagctgctcctatgcacagctgcacggctggctctctcttgccttcagggtcagcagcttaactctttctctctctgggcatgaacatgaaccatgctgtgccatgttgtgccatgctgagccatgccctggctcccctcgtcagagcaagactgacagctctggtactctctctctgggtacaagagcgcctgtacaagaacatctgtagagtgtcagcagggcaattataccttttacagacaacagtggcatatggccaagggatggccttcccatgttatggctacatggctgtgataacagatggagttatatgcctgcgcactactcgctgagtcatgcaggcctggacatctgccttggcctgattcttgaccgaagcacatccatgtaccttacaaagatattgcaggtataggtgggcatgtagtctgaaagaagagtgaactcagttcaggagtgctagatatttgagtggaaaaggaaaaaaggtgcgttttatatttctttttcagatgatttttcgtattcgatctctttataaacttaaaaatatgggtggctaatatttgtgctagaaagagaacaaagatattgttttcaaatagccatatacttataactcaaacagcgaatatgtcattaagttttctaattactctagtgatgatatacaccatttttatgtcaattttaactctttaaaattctttctcattaattcttctatttgatgcttaaagtctcgcttccttcagttctgcagttattgagataataccgttgaggagcaatgtgctagaaactgtccctatacaaatgaatagagacagaaagtaaagcggggctgagaggagggggaattggggagttactgtttaatggatataaagtttcaatttgggaaaatgaaaaatgttctggagttggggagtggtgatggttgcataataacgtgaatgtatttcatgtcattgcactgtacacttaaaatggttgaaatgttaaattttatatacattttattacagtaaaaatttaaaaagaaacttaaagacatgtaaaaaaggatgaatggttacgatcactgtcctttaggtgctcaaaggctagcagttgggacctgtatgtacagagtttcagtttaagtggttaccgatatgtatttggtaggtacataatgtcatgggagcccatcattgttgtgagatcttagatgggggttatctagttaagctggtgagagaagagaggaggaaaggtttcctaaggaagtagatagctgagttgagtcattagagataaataagagctaatgagaaaatatgtgggcagtatagtgttgggaagagatcagtatcacctggaaccttgttagaaatttaaatttgcatgctaaatgacgagttaatggttgcagcacaccaacatggcacatgtatacatatgtaacaaacctgcacgttgtgcacatgtaccctaaaacttaaagtataataataataaaaaaaatttaaatttgctagctcacccctgtgaataaaaaattagggggggtggagctcattaatatatgttttgccaagtcctttgggtgattctgatggaactcaagtttgaaaattcctgctgtagaggttaatatgacagattttagagtcagactacctggctgtaccacttactaaatgcactcacaaagcacttgctatgtttaacagttgttctacctctagaaattaacacaatggaaatatttacacaatgtttaaaaattatttgttgaatgaatacatattgccaaaatgctttctaaaatattttccaatttaccctccagaaatgtcttaatgagccaaaaagttaataaaaaaataatattgtctgaaggtgtgagtagtgagtagtcaacggtcagatatagcaggaagatataataaggtctgaatgatatgtacggatttggcagtgtgaaagtaatgggtctttaggcagagctcattcgggggagcggaaggagaggttgccagaacaaagggaaacttgaagaaaggacccggaagagctgatctttatgctagttcctcattcagttgatggggggacactgcagagctggaattcatatatccaaggcatactatggctggtgctgagaatatgaaaaaaacctggttactgggaccaactgctgctgcccaggtgaggaacctttggctggagtgatatttcaagaatggtaggcaaaacaggaaggatcaactcccttgtcactccattattctagtctctttctagctcccccacaggtagaatttaacaagaatttaggtagcagaggagaactatggtttgcagagttccagccccagcatggtgaaacagagcatagggtgcatttgaagatggcagtcaatagcttaaccaccagcaaaattcacttcattggctcattggctacttagaacattcacacacacctttctacgcatacctacctttccctacaacttccttataacttcatgctttcacttaattaagtgcaactatactttaaaaaaaaaatcaaaaagatcctttatttcatgtgtatgtagtatcataattcatcaaaataatttataatagttaactgcccctcaaatattgttttataaatgatgccttctgaagttaaacataatgtagattcattttttaaaaattgtctgtttagaacatactaaacaaatgataagttaaaaaaaaatataattctctcctgtgaagtcttctaagaaaatcatggcaagttcctgataagataaaaaccattccatcattaaaggggattaaaaagaggcataaataaatttgaataggaacatctgtttgctgagttttgtcattgtgtacaaatgaaactctagagttaaaattatattctgatttccttctataagcaagaaattccttaatagaagctcagaaatgacctcagtgccttggtgaaacatacttcttcatctgcggacactcagtgctcccatctctatcagatctgctgtgttacctctgttaacattcccaggcatctccaggaagacgggagatgtcatcctctccaagatggctctaccaaaccaaggctttcctggcaccaacaacgttctttctaaagccctacacttcacagaggaggcaaagcccgacgaagcaccatttctgccacggtgtccaccttaagcttccaactgccactgttgtgaggaggagccatcacagattgccatagccacagagtcttcctgaccctgtggagccactgctctcaggcactgtccagctgacgtctggtgtagccaattattttccccaaaggtccatgtctgcctgacccatggcactccacgagttgtggtgggtctgatgagctagtttctgtcatacctagacaaagaagatggtttaaaaccaattcatgctcttcattataaatccagatctgatttgggtccccatgctcacaagtcttaagcactagtaggcctcctttccaacttgggcagccctgagccaccagacatttgttggtctggaggtgatagagccttccaagttgaaggactttggggcattttggccctctactgataaaagtgggttgctgggatttgtcatgggtcccagatatctgcatctttgggtaaatattacccaaataccattcaaatgatttgcatcctaacttctttctcaattcaacatgctcactgatggttccaaagcttttcctctccagattaagtcttaaggaaaaatactgcgcctttattcatccagccagacatgtgccagctgcaaaaagttgtgttcatggcatcccggccttcaggagatccatatggtcccctttttttggaaaatgtgtcctactgtagagcaaggcatgatgaagaacttacctccacacacccagatctgaaatgttatttccaagttttctcctctccagatatccatgccagtatcatactgtccaagttcctggaaatactgtctgttcctggcaaacaatcctccagccattatcggtgactttgttggtgctgtggctttttctgctcatcctagctcagaaaggggaacaagctcctatttgaagtgcagccctcagttgaatcctccacggacaacagaggatgagctgtaggctagcgtgttggcactaatgatatcaatcactgagaacatcatggtctgctagtccacacagatgacagccagcaagggctgctgccacatcacattcacttcaattggctgtctaggaacacaaggacttctgttgtgtggactgctacactcattcttccttgaatcaatccctcacactttatgtttcttataccttaatttttccaaggaggtatttttggacatattcatctcgtcctcctttcaagtcatcaaggtcgctaacaacatccataaagatgatttcatgaagcaggtttgctggcatgcaatttgtgacaatgtgcagcatctggagacagggcagaaaaagcttcattgtggaaacagataacaattatgtaagcaactggcaggtcaggaggtaggactttacatgctgtattctttgtccctggcacatctctgtggtagcctgcagttactgataagcatattaaaagcacatttctgatagcccgtctctcaactcctgagcacgttaattaaaaatcatgcctagttcagaagacaatttcaagtggcctttttctggatcttcaatatgaccatcacatcatcaattttgtttgcttcgaactgtggctctagtaatagacttggaccttgagtgaatcaggaatagaattgttttggaaatggtccatggggtccaggccccttgagcacattctttttttttttaatatagtttaagttctgggatacacgtgcagaaagtgcaggtttgttacataggtatgcgtgtgccatggtggtttgctgcacccatcaacccgtcatctacattaggtatttctcctaatgctatccctcctctagcctcccacccccctacaggccccagtgtgtgatgttcccctccctgtgtccatgtgttctcattgttcaactcccacttatgagtgagaacgtagtgtttgtttttcggttcctgtgttagtctgctgagaatgatggttttcagctttatccatgtccttgcaaaggacatgaacttatccttttttatggctgcatagtattccatgatgtgtatgtgccacattttccttatccagtccatcactgaggggtatgtgggttggttccaagtctttgctattatgaatagtggatgagcacattcttaagtggctgagtcacttcaccgaagttgaaatgaacaaaaaccaaaactgcacaggtcacagatgtaaaaatgtacccataacagaaatattgaactgtgacacttcccataatagacttagcataactaatgggccattttcaatttctgcagcactggcagtggccttccaggactcaggctgtggcatctttcctcctgccacagcccctgtctgagccacaggagctgcccagggggtgaggagtggtgggctacactttgaacaaaaggagacagtcttattctctctcccaaatgggatgatgctatgtcacagttgtcattatgttttctgtgcaacatgtacagtattgctctctgggcagtattaattgctcctcacattcaatcactgtttcacctgaatgaatattgtggaagctaaatataaaattgtaaatttaataattccaggaatccttatataaaataatagggggaaggaaaagattgagaagaaattagttaatatatagaaacacacacacacacaagcatactgtaagggaggaaatatgcacagctgccactgctcttctttctgtattgattaccaggctgtagttaatatttattactagtgttagaccactggactaattctttaagtcacccagaggaggaacccagatatagtgccactgccatcatatctggacattgaatgtccctgtggtcatcatttccacatggaggtcacctgatgccacgactgatgaacctacaagcccctgcatctttgtgcaatcgtcatgagggctagtgtctcagatgtagttatctagttggtgagaaggtgctctagctgccagtgtttcagccttgtatgatggtagattcttcagtcagatattgggcaaccagcaagtagacaaatgtccttaacaaaagtgactgagttataaatctctagaggcctgagaagcctggctggggttggaaagtggaggtggaagactaatggataatgaatgtcccagggtggataattaaaggatgaaatcatgagtttgtttctagtctatagaaagtgacccagcagggagagaaaagttgataatcgaaggggagccattgaagatattttattgagagtgaataatggaataggccaattccatgaaaagagcacagggttggtcttaaagaaggtttacctcaacttctgagtattgagagaagaaaggaagccctatggtggatgaagatatatttgaagctcagggcagtttcctgctttattgagcaaaataggctttagctcagagaaaagtattcctttgcatagtagtaccttcttgcaatgacctaaatgctttggatgtgattaaaaattctcacttgggtgcctactctagacaatttctgatcttatcagcaggttaaggcaaaatgctcagttttaaagccccgtgaatatgtgtaaggtcttaaattctattatgtatatattataattatgatgaggtatttttctgaaaaagataagtatatgtgtaatatatagatatatataatttcagagcattataaatttgaatagttacttagttatagctgagaattttagcttcagtttagtcagccaaacagtcattggtctattcttctaaacaataggacccagaagaatgagaaaattaggtaaattaggtagattttcaaactttcttacaagatgatttttaatttggtcttcttttacttggaacctaggtttctaaaaatattagcacagtaaaacctgtcataatttcaaggaatttgagaaacagtctcccatttttttcctgccacattatatacctctatgatttggttaatatgttcattgcaccaactatcacatgctgtttctgcctttaattgtatttttgtttggctcttaaggcaatgtatctccaaacaattaaataggactctaattcaatgggtagagctggtcaatataggaagagctggtcaatataaccaatgagaactccatggaagagaaaatccataatggtgattactatagaaaagctttgaatcagactcacctattttggacatcagagaattcacaagagaaattttcaaatgcttccatgtgtaaaaaagtatattttaaaagggataaaatctaatgtttgtaagggatttaaaaccatataaatatgtcccttaagggaaagctttgtttgggctcagatattaatgtttgtcagagagtctgaaggacagatactctagaaatgtaatattttgaaactgctctgagattttctcttagatctaggaaggaaattctctttctttattaggtgcctactgtgtgttccaggcacggagctgagcatggggaacaaggttctacaacacagactcagcccttgccctcctggagctaacattctgtggtaaaaacagaagacataacagcaaagtttggaaaggctgtgctgtaataaatacagtgccttgtggaaacaagtactagggatatccagcccaggtgaagagggggcagaggagaatgagccagagagtgaagaacatttgcaaaggcccagaggcacagataccacatggcaggacttgaaaagttgagtgtggtgggactgggaagctggggaatgaagagaaatcaggatggagggatacacaagggtcagattatgaagggccctccaggtcatgcttggagtttgggcttctataactactaacacctactttactttgttttcacaattactcctgccagcattcttgatgatttcagcatccatgtgattaatcttcagtttcttgaatgcttattttcaatattcttgtattttcacaccactttgttcaccccttgtcatggacatgctcgagactttgtcatcaccaataagcatgctttttctataatctccatgtcaagaatcctgctctttgaccatctccccttgcacccttcatgttagtttattccctctactactcaacttcaggaataattctccatggttcttggctcccccttctgggtgccaggttctggcctgagtaaccctctcttcttcatgaaaagcagcccatatgcgcatctaagttgttttcacagcctgctttcctaccagcacaatttttaatggttgaaaggctttttttttttttccattttgttctgtctctgtctctttctgtctctatattagcactatttctgctaatacacttctctcacaaaactacctggacctccagtggatctctctggtgttcactccattagatatgataaaagcctgcaaatctcctagagatcttttctctgtcttctctttgatctttgctcagaaggcatttcttaattttaacagtgtttgctatctggagaggctagacacttcaagactatgaagtcctctttccttttgtttaagggccctttcttcaatgtatatctctcctcttacagcaagaagaaaccaagagacatccgcaacacttgctggaaatctccttaaatatatcattcagttcaataggcacattctatactttccacataactacagatggtaatgttaatgagctctctgctactacacaagaaggaccactgttctccagtttccaataaattatctctcacttccttttgtgccctcactggcagagtctttgaagtccgccagatttctactaacagcctgttcgaggcaatttaggttttcttcaccatgcttctccaaatccttctagcctctgtctgtccgctggttccaaagccactcacacattttcaggttttcattatggcagcaccccactttcaagttccagtatctgcattagtgatctaatgtcatataataaattaacccaaaacttagtggcttaaaacagtaatcatttattatctcacaatttctgtttttaaggaattcagctgcagcttagtgtggggtggaatgggaaaggagtatctgcttcagggtctcttacaaatactgcactgaaggtgtcagccaccaggactgcagtcatttcaaggttcaacttcaggaggagctagttttgagataaattcttggggttccaagttcttcatgggatgttggactgagggcctcagttcctccctggctatcggctggagacctccttcagttccttgttatgtggatctccccataggacagcctgcaccattgcagctggctttcctgagagtgagccagagagactcactgatgatcttgctttttattttcactgagacaacagaagcaggtggagtttctctaatgattgcttttctcacccaaatctaccaggctgcctgtatcagtgcccatgcacttttcctctcttcttttattgtgaataaattctttgagttctgatctaaggcaaaccctttgttacgtgttctgagtcccatctcttattgtcaactcaaggactttcttgccattatcctctattttctgcaccatcatgtttctctctcagctaatagacacgatataataactcccatttaaaaaaataaattttctctgttacacatttctgtcaagtaaccaccccatttcactacttcttttaaagaaaacaaagttttgaattgtatgaatacattatatcttcaaaagttaataaaaaagtcaacaagtgactctggccacgagggaataagagggtctggattactctcctgtgataaacaactagaaaactggaaaaaatgtaggaaataattattttcagacattggacaaagacagacagaactgtgattcctaagagaaggaaacaaaatgagtactcctagtacttaggctttctgaactgtagaaaattcccagaacatggcacagagctgaggaactcaagctgagcccaacaatcttgcagagataagagttcagagagggtaaggggctcaagttcatggggcagagtactttgaaagcaggagcatacagaaaaacttacagtggggccactttaactctttggctgaatatcaatctggccacaatgttgggtaagaaaaacttctagtaagagaacagttatcagggagctataagctaaacaattcacagaattcatagaggtctgggaatcgttcaagttcccacaaacgagattggagagaccttaatgggtatcagtgacatttcataggaactccagaagagctatactttaaaggtggggccaaattagccttagagtcaaggctacactatactattccccaaaatgcttaaaggatgccctaaaagattcaaattagtgctcaagtaacttaactgactttcagaacaaaatccaacactcttcaaggcaaaataaaacaatgtaatattcaaaaatgaaataatcacagtgtctggcagccagtaaacacatgctagatatatgaaaagataggaaaatgtgacccataaccaagagaaaaagaaaaaatagtcaatagaaacagacccggaaatgacagagatgatagaattggtagacaaagacagctatcattaatatgctctacatgttcaagaatgtaaaggaaaatatgaatataatgagacaggaaattgaagatgtaaaaaagaacccagtgacatttttaaagatgcaaaatgcattttttgtaaacaaaaatgctaaatattaatttgggcatttagaataatgttattcaataaaatagtatttatggtgtgcagcccatagtgctaggctctgtaaggggtgcacttttcattctccttcccttctttcctttctatcaggatggactcatggattcttattttagtttgtgggctacaaaagttacatcatttattttattactgaaatcgtctttctttctagcagtataagatgtaccaggttgatcttatacttttcctgatataacactggaattagccatttctccaaggagccatcgttccttttgttgaagaatggtatttacaaaccagtgtctggaggatagttgttcgttgttattgtttctagccctctctgtgtgcagagctagttagtgcacacaatatatacacaatgtgtgtacataatatacacaaatctatatatctatatatctctgtatgtacatgtattaaagggtgtgtgttcatactaatatgtcccattctaggccaaaactgcacagtccgttctaaacttcttttctttctgttttgtaactttcttctccagcagtgagaaagaaacctggcttccctttcccacagtgtgttacttatttgctcagtgctagaatacacacaaagcagttttagcattgctatcccatactgctgtgaaaaatgaaaacaagcgtactaactgaagtgcaatattgtttacactcattttgcctttactaaggctaatgggtacatggtcaaatattatgttccaaagttaaataggataggtcttccctctcccttcaggtggttatattattaacttggtagacattaagttctgtttgtttcagtttgcattcttctttttttcccactttctcttctctttgttgattttccatttatttggtgatatcttacatctgaagagtactttgcattttacaaaatgcttcttaaactttcctccttgataagatttatctaggtcagcactacttacttggcattcaataggtctgggtggaactagattgcttgcatttattcagaacatagattgcttagctctggaccttctgaattcctcatggggtctaggaatctattttttcacaagttctccaggtgatttttatgatgagtctagtctgggacaataactcagtctcaaattattttggattggcaagagaaaattttgaggtaatgtttttatagattaccaatctgaaatttaaaataagtgacttgattaaatgatttacaaaactaatactaaattttctaattccacttcattggtttgttcactattttgctgtcagtttacattacaatcagaaaattaggtggcaccaatttggtgttattcctgtaataatttagcatagaatttgcttggagaagctttaatatattcacattttctgggaagaaaaattggaccaaaagtcagaggacagaatgtgctttctttctaaaccatgtatggctaccaaaaatgaaattccaatactaaagaattatatctctaccttttgtgtaaaaatattaccaaaaaggcaaaaatggtaaagagacaaaattttaagttcatttgacaactgttttcatactattttcactttcaagtaaagtttatttacatgtagaggtattaaataaatagtggcactgagtttgtatatgtgtatgtatactggtaaggcataaaatattttgttgcatataaaattttcaagaattccagaaattcttaatgtttgcttgttttaagccaagtatatctcctgttacttttaaaatttgatgatccttttattctcatactttaaaattatcaaatttgttagagtatgttttgatattagtaaaaacagagttcttaacttcttatactgactttggcatgtaacaaggttggtggattccaggtttcacacaaacttgggaaactcctctcacaaatacaggaaatagctaatgtttttccttaaagaaaagaatcatttgaagtaattatataattctctaattttccatttataaaaatattgacatgattcaggttataattattttttagtcatggttactatggtctttattgatctctaaataaaatggtgatgataacagtgaaatttatcttgtgacaataaggcacgttgggtgtaatgaaatgaatattgaacatgatgcacaagacttcagttgagttccaggtctaccttctctccaaatctcagttttcttacctgtaaagtagatgatgttagttccctcaaagggtgctttgaaaaactggattagataatattactaaaggtgtttcatgtaaattgtaataatgaaatttgatgatatatttaatgtgctttctctatttttgtgtcctttgcccatcaaatacccaccagtagggagtacaaaatacttttggcttatacctggggagggagaattttcttttttcttaaagggccaaatagtaaacattttggggtttgtggaccatcctgtcttggtcacagctattcaactctgtgcttgcagaaaaacaattatagttagtatgtaaattgaattaatgttactacatttatgggcactgaaatttgaatttcatgtatcatgaaacagtcttttttttttttaattgaaaatgtaagtaaccattcttagctcacaggctgtacaaaaacaggcagatggctggatttggcctgtgggccagagtttgctgatcccaagcttagaacattttgaaattagttttagattgatgctgatagtgtcatgatggggttagctgttggcatggttacagaaagcttttttaaaaaccaacaaacaatgaattactataatgcatattttataatgtagatactatatagtcattattaaggatatatactctatatgatgttttgcatgtgtattacaattattaacaaaatgaaaaagagattgaataaatagaaaatacatcagtgaagggatgaggaaaccatagagttaatctgattttaaattcgcccttttttacaaatattcagtgtatttagaaaaggatggctttggcaagaccatctaaagtaagatgatgtgattctaacttttctttttgtcttaaaatatgactaaaattttctatcatttaaaatgttagcagagaatatatttgttgttttgtgctcaacttaggcaaatattcttgctttaaaattctgaagtttttcagccaaagcataataccttgcaagaatgtttccgacataaaacaccacaatttattcaatttgttcacagactttttgtaaaagcttttattttaatatttgaaaaacacctaaaaggtctggcttgatatttttaaaaattacattttgtttgctttgcttaaagatttagataaaatcgaaagtgctaaatcaggctacctctaattcaaaacaatattttatgggtggatagcattttacagttctcaaaaatacttttatgtgattattgtctttgatattcacacccttgtaaacatagatggttcggggattgtcttggttttattgattcaggaacctgaggctcacaaatataaacttacttgtccatgatcctatggctaataagcaaacagaagtacttgattttagatctcaatgttaatttagtgtgcttttgacactaatatcccctatacagttcccagtagattccttggcacattaaagccatgcaaatgttgtttcagggttgattttttttagtagtaaagtaataataaattctattacttgaaaatatatcataattcaaaacatttcatattagtggggtatgcagagaaagactagggtctatttttcatgttttttatatctggatgctcatatatatgctagtttattatagcttctaaagcaacacttttccatactgatttttaaattattacatttgttaattacagtgttttccctctacaaggactgcaagatttctgaaggcagtgatcatgcactatctccctatccccaggttctttgaaaaacagtgtggtttcgatatgaggtagcagatattaatggatagaatggggcagcacaggtgagatgggtagacagagacactgttactccacactcttctccccactgctcttattctatagtcacttcatttacaccaagacttagactccctaaaggatgaggcagatttataaaaaatctagtaagtaagaaataacaactgtctgttcttggttgcatgctattattttttatgccctgtatttggtaaccctacccagctaattataattttttttttaagattgacctacttatttgaaggtttaaaatgataggcaaggtattgcttacaaaaatttcctggattttctttctttttgtaaatagttttattgaggtatagttgatatataataagctgtacatatttaaattataaatttgacaaatattgatctgagaaatcactcataaaaccatcagtataataaagaaagtgaatatatcatcaattagaaaatttcttcctgctcctttgtaatcccaccctcatgctcctaccattggtacttcctcctcccaccccacctctgtccccagggaatggctgatctgatttctagcacatagcctactattactctagcattttttagaactttatataaatgcaatcatacagtactttgttgtgctttcatatacatgattatcttgagattcattaatgttgtttatatcagtatttcattcgttttgattgctgaatagcattccactaaatggttatattgcaatttgttcatccattcacctgttgataggcatttaaattgtttatagtttttgactgttacaaatgaagttgtcacaagtgttagaattgaaatatgttttcatgtctcttggataaatgcctgggcatggaatgggtacatcatgtggtaggtgtgtgtttaacaacttaagaaagtgccaaactgttttccaaaattgtatcattttacattcccatcagcagtgtaagagttccagttcctccacatcttcaccaatacttggtgtagtcagtctttttttaaaattttaaccattctagtatgtggatagtgatatctcattgtgattttagtttgtgtttcttgagtgactaatgatgttgagcatcctttcatatgcttatttgccataactatgatttatatggtgaagtgactgtgtaacattttgcctatctttttaactgggttgtttgtattattattatttagttttgagtattgtagataccttatgtatacaaatcttttatcagatagataattggcaaatatgttctctgtgtatggtttgtctttttgttatctttcatagtgcttctcagaaaacaacttttcaattttgataaagtctaatttatcagtttgttcttttatggatcatgctttttgtgtcatatataagaaatttttaattaacacaaggtcacaaaattttttacttatgttttcttctagaagtttcatagctttaggttttacatttagatttatgattcatttggaattaatttttgtatctgatgtgaggtatggattaaagttcttttcttttattgcatatagatattccattgttccagcacaatttatcagaaagattatcatttttccacagaatttcttttgtgcctttgtagaaaatcagttgtccatgtaagtgttagtctattctagactctattctggtccattcatttacttttttttgtttttacatgaatacttcattggcctgattattgcagctttataatacattttgaagttaggtattgttattcttcaaaatatgttcttcagtttcaaagttgttttggctattctagattctttgcatttccatatgaatttttagattcatcttgtcaatttgtgtaaaatagcctgttgagattgtgagtagcattgcattaaatctgtagataaatttgaggagagctggcatattaaccatattgagtcttctgacccataagcacagtacatctctcattttagttaggtcttaataatttccgtcaacagcatttcatagttttcaatgtgcagatcctaaacatcttttgtcaaatacattacaaagtatttctatttttgatgttattgtaaatgatattttaaaataatttctgtttcatcagttatccaatataaattcagtatcataaaattattcatatttccttattatccttttaatatctgtagactgtgtagcaatatcgtgctttcagtttttatattcttaatttgtgacttctgtggtttttcctggtcagtctgtgatatggtttggccatgttcccacctaaatctcatcttgtagttcccataatccccaagtgtcatgggaggaacccagtgggaggtaatcatgggggtggttacctccatgctgttcttcactattatggcggttacctccatgataatgagtgagttctcatgagagctgatggttttataaggggcttttccccacattcactctgtacttcttgctgccaccatgtttgcatgtccttccaccatgattctaagtttcctgaggcctcctcagccctgaggaactgtgaatcaattaaacctcttccctttataaattacccagtcttgggtatttcttcctagcagcataagaatggactaatacagtctggttaaagcttctttcatgttttaaaatcttttaaccagcttttggctttcttgatctttgtgtattatttttctgtattctatttcattatattctgatttgatatttatgatttctcatctgttttaaagtttggttgaatttgctcttttttttttttcctagtttgttaagacggaagctgaggtcattgatctgagacttttctttttttctcatataggcagttagtgcctatatttagtgttaaacacatttccctggaattattgctgtaagcaatatcctaccttaaagaatatgttgtattttaattttcatgtacttaaaaaatccttctaattttttttgatatgttttttgacccaggaattatttagttgtgttcagtttccaactatttagggcctttccaaatatctttctgttattgatttctgttattaatcctatttttgtgtgactggaatcctttaaaatttattgagacttgttttatggaccagaatatggtcttccttggtaaatgcttttgcaaagaatgtgcattctgctattgttgcatggagtgttcttgaaatgtctattaggtcaagtcagttgatgcgttgttcacgtttttatccttactaatttctgtctatttgttatatcaatggagaagaatgttacatcaatgatgaaatgaaattaatcaataattgtggattagtctatttctccttaaggttctctcaatcttttgcttcatgtattttgaaactctgttattgggttcataaatgttttggattgttatgttctcttggtaaattgatccctttttcattatgaaatgatcatctttatcccatggaatattcactgctttgaaatctactttctctgatgttaatataaccattacaactttcttttgactaatcttataatggtatatcttttcccgttcatttccttttatttgtgtttatagttaaaattgatttcttgtaggttgtttataattgggtctttttaatccagcatgataatctttgccttctaaatgggatgttaaggctgtttgcatttagtgtgaaaattgatatgtttaggtttaaatctttttatttcttttcttatcctattttattatttgtttccctttcctctttttatgccttctttttgattttttaaatgattctacttaatatcctttgttgcttattaattatattttcttgttttattattttagtggttgctttagcatttataatatttgtcttcaatttattatagtccaagagatagtatacctctaagtgatatcataccacttcgtgtaagaacattacaaatttctcccctcccaagcttggtactaatgccatacattttacttttacctacgttgtaaactccacaccacggatctattatttttgctttaaacaatcaataaatatttatcattttagttaaatttaatttctttgtgtgaaaccacatttctatctgctgtcatttttttttttttttttttgcctgatggattgcctttagcattttttatagtgcaagtctgatggtgacgaattatttttgctttggtatgtctgaaaaaaaaagcctttatttcatcattattttgaaagctgttttcgctgggtataggattttagaattgcagtttttcttttattttagtacttcacttttacgtcattatctttttgcttatgttattcctgatgattaacctgctgtaatctttatctttgtttttctaatgtagggtttttttttttcagataccctttaagctgggtgtcccaaatagtttacttcaattagtatttagtatcctgctttaaaagcctatccagtattttcatatctgttttaatatttagctcttatttttcaatataggcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccagtcacctctaatgtcagttcagcccataaatatgggtaagttatgcactaaaatgatgataataggtctaaacatcagtcatatataaaggttaaaaattgcttacaaaaatatttgctagcttatctcactttgcttaacactgtaatgatggtagatgtagtactgggggtattaagagtggcttctagaatgatttaacaatggtatgtatatctctgccattgtcacttaaattctgttttgaaaactgttttctttcaatcctggatctatgtaatggatgtatattgattggatatcactttttcacatctcagataactatttttgaaaatagtagcatgtttcttgcctgaatttattccttcaataaatatttcttagaggctcatgtttgtcagagactgctccaggagctggaaaaagagtgggacattagacatagttcccacctcagagagcagggacaaacaatagtaggcagagacaatgataaaagagtaaatgagtaatttactgtacaaacatgattacaaaaaacttcaaataatagacaacactctgttttctttgtgcaaagatcccccaaatctctttttatcaatttaaatatacaattacaaatgtgaataatacaggaaaatgttagcgctatgtatttaatttattaatttcatttaattatgtataatttagcagtttttctccacttatatttcctgaaacaattatatgcaaactctttatgtctgattttgcatcattggttttgacatcactagagctgcttttccaagtatctgatacaattttccatacaactcaagctttacttctttctaagttactcgagatatagcactttttgaaactgtgtatgacatcatattttaacatgaagactttcaaataatttgtcctgtagggatatagttgtgatctccacaacataattacaatggcatacaagcaattcaatcgtgaagttataccatagagaaaaaagttacaaaatctttattcaatatcattttcttttctttgaaaactaattctacctgatgattttttagtagcatttagagtcaacattgagtgcattgtttttcaaaatgaagtaggtaagggaaagtgctgtggaattttaaagaacttgaaagctttcttaattttgtctttatgcagagataattttggggaaaagtatttccttctatttgaatatatattataatatccccaaattatatgttccatgaaaaaaataaaactggtgtgatggagtgtcagggactattatttctactatgtagatcaaagaagatctcctttaggacatagcatttgagctgaatgaagaagagatatccatgcaaaaatccagagcaaaaggtgctccaagcaggaagaacaatattcacaaaatccctaagatacaatgaacttggtaatttgaggaacaaaacagaagacctttgtgctaggagtgaaagagatatgagagtattaagggatgaggtcagagttacctggtccagagcatattgtaggccagggtggagaagtaaagaactgttttggtttggatctgtttgtgagatggtgctgactggactgtctagtggatggagttgtagagtgtgaaggacagaggggtatcaaggataacctttaaatttagacctgagcatctaggtgaacagagacaccagatactgagatacggaaactcagggaagattaggtgtgtgtacagaaatcaagagctctattttggacacattgtatttgagatgtctattggaaacctaagagacgttgaataagaggttggacatatgagtctaaagtttaggggagatatatatatttgggagttgttagcgtatcaaggtttatagtattgtatgagatcacctatttagagttcaggaagagaaagactgaggggttatcagtaagaatgaaggagtaaaagagtatgttgttgtagaagccaagtgaaaaaaatatttcaagaaggagggaataagcatctatggagtgctgctgaaaggccgagtaaggtgaacaggaaattgacattgggtttatttttgtatttctaatattaatgcatattaatattgtcaacctaaaatgtatgacagataccaactctataaagcaaaaagttgatttgggagtagtaggggattgcagttctagacatgcatgctatggaatgactatgacacatccacaggggattggagtaaaggggaagcttgaaaagacatataggagacctccatgtaagctgttttgaacaaagattattggttacaagagcttgctgcaggggtggcattagctcattggtggagacagccgtagttaggcaagtgtctctgtgcaagcggcttttatggaatactgtggttttgaggaattctttacgttgttccaatgtaggcatacatatacataaggggactccttcatggcctcccaactccattgtgttagggtttcacactagtaactccagtttgatactgataacttttacagtatgcagataggaaatgtacaatagcttgtaatattgtaattttacttttctttggtatatattgttttctctttggtcatggaaacacagtaaatttcacctgctgtttccagacttttgtgtttagctgtctctgctttaaagtaactgaaatttataatacgtctcataaagtaaaacctcattgattttgactaaaagaggaaaattgtgaccaaattcttgaaaatatagaatgtgaaaattatcttatgctctttatttattgaaaataaaattcaaatcagtgtttcaatttaatgataatttctatatatatgaataattcctgttaattgtaaaaaccttgctaatatagagatgaacaaacaagaaaatgcatcgattttctatcactttggcgatctttatattttaactatatcaggaatccaagtataaatgtgtgttaaactttcaaaatttaaacattaaacatttttaatattctgagaaacttcatccctacttctgatgacaagccagggactgctgatgctgcatttattgcatgggaatatttatgctgtcagttatttgagtaggtttgtctagattatagtgatctaaaattaatagacaagctgaattttgggtagttttgtgtatttccaaatagtgttctgcaaaatgcttttttcctttttaaccactaaaataattgaagtgggtgaggttcaggggagacttcagataagttttaggatgctgggtttaataaagttaagtgggattcttacaaggggaaatcacatttagcaaaataatctcatttactgattcatagtctttaccacttaaggggagggtaatgaatatacatggattgctatgataaggtacaaggacgagacccagtattcaagcttgtttcggttctataattagtccttggataaagtcaccttttaagtacttgaaaggcaagatatgatgaaaatttatcttgactttattttattcagctataattgtcatgaaaattacttgacttaaaagtattctcttttttttccttaagtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagtaagtatattttagtaagtaaaaggaaaagttgagaagtaaataaagaccctcttaagtcccatagcaattaccctctgcatactaaatatatacatttcttctaaagcagaatgaattataattcaacatttcatattatatatcatatatagatagatatacgtatgtatatatatggctataggaaatctagttacagaaacttgaattcataattacaattattttccaccaacagaccactgatttcatcttttttttaattgctcaatctatttgaatgtttttctgaatgtggcaacagaaagatttttgcttggctaatcattagtcgagcttctgaatcttctgctagcccgatctgtgcacattcctgtaaaatccagttttagcaaagaactctgctaggtcattttagcaggaacacccccaccctggatatctgatgaatatttgatcagatttctcatcctccaccattccccaaatgatgtttgatcaccatggcctgtcttcagcaagaattctgttaggtcagtttagccagaatccctcttaccatgatgtttttgcttagtaattttctatctactccctccttcttggctataaattccctgttgtccatgctgtgtttggacttagcccacataccccgacccaccacaagaccccattgcagtgctccatatacctattgtgatgattccaaataaagtcttccttacttcctttctctttttctttaacagttcgttccgtaagtatttattgaacacctgctacatgcctggaactgttctgcttgcatcaggatacactgagatagcaggacaggataagaggaatctgggggtgctggtagggaatggaaggttgcaataataaatggaggttggggagggtgacatttgagcaaggatgtgaaggagatggtaatgtagatatctgggtagttgggttctaaacagggagaacagcagtgcaaaggatggtgtggctgagggcagtgaaggtgacagcagtagtggttgaattcagaggccagcaggggaagagaatgtggagctcaatgaaaggcctcttgggccatgtgaatactttggcactttactttgtgaaactaagtttcatataatttagaagtaaaaatcagtctttttagaactggcaaaaaaatttaaaacattttattttcacaaagagaatgatgggaatcctcagtgtcacatatggagaaaacagagttaaggcttctgtgggtttcagctttcttatctgtaaactggagataatttgtgaacttgaggattttaaataggagttattaatatctgatgttgttttatgcattcctgatgcttttcataatttttagtctgtgacatgctccccttaccccaagagcagtcattagagccagagaatttattaactttggagtacatttttgggaagctgaattttgatctcctaggctcaagtgatcctcctgcctcttttttttttttttttttttaagagatgaggtatcactatgttgctcaggctggtcttgaactcctgggctcaagtggtctacccacttcggtctcccaaagtgttgggattacaggcatgagccaccatgcctgaccaggctcaggttcttaagacttttcatgctcttctgtacagggacacttgtagttctttgtctacccctgcacagcattttctaccaggtgtgtgttataggtgtcagtagtggcttaaagcttcccacagattttagctgcatttcttaaaattctaaaggtcatatattcatcatgattcaattaacagtatttgttaattatcattatgattttttcttggacccatgggctatttaaaattttattgactaatgtgcaaactttttttttggttattgatgtttgttttaattccgctgtggccagataactactgtgtaagatattaattctttgaaatttgatgagattagcttatcctcacttttagtaaaggttccacatcaacttgatgttctgatgttttaatataatatttaacaggctgacaagattgtctcagctacatccctgctagtagacagtatacttcctgggtcttcgtatgaggttcaggtgaggggcaagagactggatggcccaggaatctggagtgactggagtactcctcgtgtctttaccacacaaggtaggttatgtaatagccacttctactgggagggaaatatatttcctgaacttgcctttgtatagtataagcatcttacattttgaggccttaaaatgaaaggaggaacacagtatcaacttccttgtttaaactttgaacaggccaatttgtgaattaaaattctgtcagagcctctaggcttgtgtgtttctattgcagtatattgtaggatcacttttcctattaaaaagaaaaaattaatataacagctccaaattaacaaactcagaaagccatttgtattgataattccttaatttacattttaaaaccaagcatatttatttgacataaaattcaaatattaacattttactttatattatataataaatgaattatttttactccagatgcttgcttttgagagttttcagtgccaatgttcatattttaaaggttatttttagcatcggaacatctacagttcattcacagcttcttcatgcagctgatgcgcaaagttttgcatagaggctccagaggcttggaatggtcctagacctgttgcatgcaaagttgggactatagaaagacaatagtcctttggctggttgtccgatctgtcaaaagggcaaaatttttcttgttcagacttactgagattgattatggcctgtacagagataacaggtaccatgcaaatatcaatccatttaacaagtttacttgttgattgcttactattttaaaagcattgattcgtcaaaaggcaagtagcaatagtagtttaagacattgacttcggagtccaacagaagtttataggagttctggctccaccacttatttggaaagtttcttaacctttctatgccttaatttccttatctgtaaaatagggatgttttacatggatatgaaatatccatataaaattaaataatgaaatgaaataattaacattggtcatgtgaagaaaaccattattgttttcttattctgcaaattaaaaattgcatagtatgtcatatgcagataaaatgtgtatctatattattaaaattttgcaaattaaatattcaatatctcatatcaatttcaataaatttatccagtgtaaatttcacaaattgtcaggtttttattaacttagttttcttattttaagctaatattttagcatctaatcatgtaaaaatactatgactttaatcttatttctcagttaagccttactatatgtatttgatttcaaagtgaaatgctttgaattttcttgtcatctttaaaatgaaaaacttcagcttaatccatgaaaactcaattatattttttatttttaaataagaattattctgagacttttgaggcagttgagtaaggaggttgtggcgcatactgaaggtaggttaagataggttaatgtactaggtacttgtccacagtaagtaatgtacaagtgaagcttgagtgccacctcggctaggattatactcagtcacgctcataaatctaatggtctggctcctgtgcagtaattttatgctactaagttttttcctgtttctatttgattatggacatacaaaacacaaatgttttgtatgaattgtaaatatatagacattgacgtttaccatgctattacagaataaagaaaacttaataaaaaccaattaaagtatttttgtttctgtttttaagggtaatcccaagatatgtgtgaaaacaaattttcatagtctatcaacagaaaatggtttaccttaactttacaactgaaatgtactgacgtttttgcagtgcactgtggtggaaataatttcttcctatgtaaaccatcatttacttgtatctcgcatgtctttgaaaatgataggcaaatgaaatttacaacaacagaggactttaaaaatagtatagaatcatgtgtaggcattaaaaaaatcatgttttaggaaaatatcgcttccctttaccctcatccataggatattggcattaaataactcaaaatgatagtacaaaccagtatttcccattttctctgctttgtatattgctgcattatcattcatacgacattcctattttttaatttatatctcgtatctttacctacttacttgaaatttttatgtatccaaacaagacaatagcggcaatcatttttacttcaggatttggcttcatagtgatttgctttaagaacttgtcctagtttcactgattcccaaagcagggtctgttggaaaatatgtcattgttgaattaagctatattttgttttagtcactttcctgcctatcagttagcaagtgacaattactggctaaaacatattttatgatgaataagcctctgtgtttagaagatagtaaagacattcatggaagctcaactcactttagaatgagagcactcgggacactagataactgtacacaaacaggtaatttcagcattatccagtttttaaattacactcattttatttttggcagtgtaactctggaatgtgttgtgaatatttttcgatgtggtacaaattacttacagaatgttttgtcttcatctgatatcctttcttccctcattacagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattggtaagaaaacagaggttttgttcattttgttccacaacttgaattttcattatggaccctccttatattagagtcctgttaaagatgtaagaaaaaatttttttcattgaattttttggagtttttgctttatattaatattttaatatgtttcaaatagatgtcaatatcaatatctcatgtgaaactgatgggtacttaactaaaatgacttgcagatggtcaaccagtacaatccagtcacttgcggaaagcactttgcaattgaggtatcataggtacgtattatttttgctgttttgtttttctgtgggcacagtgagataaaaattttctttagaaatattacaacagtagtcttacagattatttgcttcctgaaagaggaaagtataatataatgaatcaggaaatttttgagggattatataaattggtgattcttgaaaaatattcacacctgagattaaaaaattgtaatttgtttttacttcaaattatcttttctgaaaatcaatcaattctgaaaaatttgtattttaactcttgaatgaaatgcaagaaaatgtagtttatatatattttaatttgacttagttgactagaggagaatgtgaaagattataaaagtttcgtatcatttggctaaagattaatgttttggaaaaaagaggtaaaaacagattataagagataatatgaatggtttttagaactgagtgagattacttaggaaataaatacttatggttaataaagggtaatgtgttctaatgagaagtaatttgtgcttgtttatttttactcttctatgttttaaaaagaattcaaggcatcgtcttatagtggtccctttctttctaaaatcattttatctaaaatgatacaacccttgattatataatagatttttatttttaaaaatatcccatagtagtagtcaagtaaatatatactgctgttaaacactgtgtcccaatttatatttttatttgtagtggagactttcaatttgtataacatgctcatttattcttaaaatataaattttcaactagaaaaataaatcccttctctcaaatactgtgatctgaagtctattcctaatgctgccagtctcttcttatgtagcgttaggaaaaaaatgtggcaattcgtacatttctcaaatagctgccttcatcctacctaatatgagtattttaaaatcagtagaattgttcatgatatgaaattttacttttataatctgtctttacattcttttcatggcattttcacattagaaaaggtgtttatggaaaactattatgttaagccccatgccttgtttctcttattaacatttacagaataactatgaaactacatttacttgggtgagtttcttaacttccctaagcctcaatttccttgtctgtaaaacagagagaataataggacttacagtgtttctgcgagagttaatgacatatttcatctaattataatcacatggtataatttctccttgtaaatattcaatatatggtttttgctgtcatgataatgatgccaacttttcgatttcaagtgtactagtactgtgcttctactttgttcttattttctacccccagatgacccctcactcctcattttcatttttgcccacgcaccaccatttattcacacacacacacacacacacattcatgattgtaattttgagaagacaagaaaaagaagtggtatagaaaatagaaaatgacagaagaatatagattttttagcttcttctaacttcctcactcccatctctttggaaagagtaattgctacttcagctatttaaatatagtattcagagcaaacattggcccaagaggttatttcaaagaagaggaaaaagactttatgtcaagtttgtccaacccatggcctggggcccccatgtggactaggatagctttgaatgcagcccaacacaaatttataaactgtctgaaaacattaggagattttttttgcaactggtttttttttttttttttgattcatcagctatcgttagtatattttatgtgtggcccaagacagttcttcttccagtgtggcctagggaagccaaaagattggacacccctgctttatgggttctgaggtggagtgttggctaggactcacttataaaattttttttaaattttcttttctgagaaaatgaggaatatacatggttatataattcacatacatatctgaaattggtattatattaacttatattaatttgaactagaaaattatattcaccactcatttgtggtgaaatttaattctttcttcaaagtgtgaggaatttgccttccttgccatctcaggaatgctccatgactactttcatctatattttaaatattctatcactaatacataatgtttgtttaattttcaaattattgtaggttctgtctctaactggatcattttcttctttttagagtatttatttcatttgcatccctgcttagtgtctaatgaaatatttaataagagttactgtcagtttctgtggaaagatatagaattgggaaaaattaaaaaatgcctttctaataagaatgtctttttttagatggagtgaaattgtctgtattttatttattttaatttaatttaatttaattttattttgtttttgagacagtctccctctgtcgcccaggctgcagtgcagtggtaccatctccgttcactgcaacctccgcctccccagttcaagcgattctcctgcctcagcctccctagtagccaggactacagatgtgcatttgtagagacagggtttccccatgttgcccaggctggtctggaactcctgggctcaagtgatcagcccgcctcagcctcccaaagtgctgggattacaggcatgagccaccgcaccgggccttctgcctgtcttttaaacttggggtccccagtccctgggccacggaccggtacctgtctgtggcctcttaggaacccggccacaaagcgggaggtgagagagcagcattaccacctgcgctccacctcctgtcagatcagcgcagcattagattcttagaggagcagaaccctattgtgaactgggcatgcgctcctcatgagaatctaatgcctggtgatctgaagtggaacagtttcatcccgaaatcctgaaccatctcccatcccccattagtggaaaaattgtcttccatgaaaccggtccctggtgccaaaaaggttggggactgctgttttaaacaacaaatcagaattctcagatatcttcttgttgcttttattaatgtatactaattgactatttttgtatcttttaaaggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtgggtatgtcaagctgcgttgtgtcttcatttgtgttagcagatttgtatgcagattgatgcagatttaatgttatattttgccattttctgatcacattagattttgaaaaaaaaattgttcctgtttacagtggtattgagaaaatcagccttaggaagttttacagttttgaattcatttcaaattatttatagcagactttttttagcaataggaatattttctgcacactattagatgaaatacatgggtcattatgaatgaattttagtagtgtttttctaaataaggcattattttatgtttttgttccaatgtagttatgaaaacatgtaatatttgtaatccaaacgtttaatttgaatattctgaggttctcaataatctgagtactcataactcaagcctttaatttgtgaggctatgtagggcacagaagcatttaaaatagctaaattgaagtggaggaaatagacaacaatgacatacattatattttaaacattcttttcaaaaaacttttgatttcaaagatattaagagagcccttggaaaatgtgatatattctttccggttcattgtgaaatctctgagaaatgattgtgcaacaggaatgcaaaaatatcttttggtgctgttacatatgtataactaaggaagcttttgtagatcttttctaaatgtttgttttcaagataagatgtctaaaaacaaaacaaaaatgggattttcagtgaattttcccctcaaataaaatattcctcagtaggaaacatgttagaataatgttccataaaaatattaatatatactattttgttgggggattatgtcaaaaatcaatatttgagtcattatttttcaattaattaatacacatttgaattaaaacctataaccaaaaaatacacgataagattgtcttaattataagatttctttttcaatgtaaagtcccaatgaattctctccccactgtttaattccattttaagtgatttttactgcagtgatacttaatatcccaggatagcaaggaaccctcctacactcccccaaacatgcacagataataacacactcacttataagatatgacaaatgaagcctggattcagtaacatatgttacttgaataacctatggtgttatccttttcaaaactaaaataacgagtttaggttgggcttatattgcctacttagtactagaaagtaactcaacgttgggatccaaataccatctccacttattactagcctttaaatccggactagccacacaggcactatgtgtctgttttgtcatccataaaatgtagacagctcctcataccttcccagcatgggtattgagggaatcacgtaaactattgaacttcaagcatatcctttctgcagactggatattcactgccagtctgcagaaaggatatgattcatatgattcagttaattgcaaacacagatttaacctcttacagtctcttgaatattgatacttcctttcctgacaagaaattatcaagaggtgaaatacagtatatatcatcttcctgggttggtggagaatgtctttttgttctatgaagaattgaataatcatgataaactttacatgacggaaaaagtttaggtatttttgttatcaacagtcaaaagtattattgttgattgcttaaaaatgattttaaaataccatatgaaagggagactatacctttacacagtgttggtttttggcaagtgagacttggagcaagagaataataaacacccatattgtgccaatccaggtattaagttttccctgtgaatcataacagtagcatgatttataagacatggggaaataaatcaagaaggtaaaccctggaactctatcgtcagttctctcttaatttttcttacacagagtgtctacatttggccttagttatggtttgggttatttaggtttctttttgttggtggtggtttgttggttggatggtttcatacattagcccttcagcttccctttttgctactgcagttgtttcctgcatattccagccaagggccatctctcactttagattgtccactggcaggggtgactgtcaaaataatgaccaagaggagggccattccagctgcaatcccagaggcctctgctgtaccaggcattgaccttttaggttctgagccgtgggcaggtgtggagggcatccaacctgagcagttctggaggagatattcctcaggagagcacctctttaccagttggtatggatgtacttaatatttttaacaactgttttgacataccaactgaatatatgtcctctaaatggaatcttctagtcttagtgcagataatcaagacatgactatgtaaatgtagtgtgtatcataaagttgatgcttggagtcataacagagttagggcttcagagacgcactgttatgcttgggctttcaggcttttagtttaaaatatgccacatttccatattgcctgttattgtcaggaagattggccctcaaagttaaaaattaagaacttgggggaaaacttatgtagtgaatctaagcctaaggtagtttttactttagctctgaaagcagcatcataaaaaggtgataggaaaacagggaagataacctttttctttgcatttctatgatttttacattacacctttaaacatgtcttgttatgtacatatacgtatctattttaaaaatcacttgctattcagaccatctttgcctctattactgcccattaaaagcctgttttcctcagattatagaaaaccaaggctttgctctgagagactatctctgaccttgacctagaaatatttaatgatacacagcagcataagagtttcacactcacacatatggaaattgatgcagtccatgggttttttttttttttgcctttaattaaagttcaatggagaacagtttgttattgatatttagcatgtgttcagcatggtatctttttttttttttttgagacggagtctggctctgtcgcccaggctggagtgcagtggcgcaatctcggctcactgcaagcttcacctcccgggttcatgccattctcctgcctcagcctcctgagtagctgggactacaggcgcccgccaccacgcgtggctaattttttgtattttttagtagagacggggtttcaccgtgttagccaggatcggcatgttatcttttgcttgcagagccaatggttcaatttctaatcaggtactactactagctttcagagtaacatgaataatgtattgacttttttcagtcaagtctatatttgcgaaaaagagataaatccctcttttaatatatcacataaagtaatagggaaacaaatgagataatgagtgagaaagttatgaagaagatattgcttgatgaatacagatgtatgaaaatataacacaatgtttttaggcattattactatttaaattaccatcacttaatactattgtaaaaatttctagtgaagccactgcctccatccagtgtgaaagcagaaattactataaacattggattattgaaaatatcttgggaaaagccagtctttccagagaataaccttcaattccagattcgctatggtttaagtggaaaagaagtacaatggaaggtaccttttacttagaacttcagctttcctcattaaatgctatttttataatatgtaagagtttaattgcattagattaattttattggcataaaagtacattctcctgtattgtgtagctattttcattaaatagatttatctaagtctaacttttttaaagaacaaagtttcctgaaatccatcattccctgaagtgtgttttatagaacgttggttgcatattatgttccttggaaaaagattaaatggctaaatcagtttaggaaaccctgtatcactgtatcttccttgtgtagtcacggtatacatattacatattcaaggtttggagaggtccttcattaaagaaaaatttgtgaccttatttcatctcatgttccccaaactaatttttccaaggaactgttgtttctctaacatctgttgatatcttttagtacatacatgtttagtggaatgcattttggaagaagctgcttttcaaacaaacagagtcattcccgtagtggcaagtgtgcctatcatggcattccacatcagctttgtgacggcagcctgcaaagacctagaaatatcagaaacccttattgtatcattagatcacaatgatatcaactaaaacaaatgtgacagtttagctgctattgaagaatactgaatatcagcgatttgctacagtaggtcctatctaaccaatacgtttaaattctttttaaattcttaaaacatctttgtgggtagaggattagtggacagggattagtaggagggtaagagagtgtttgggaaacaaggttgcaagtaaaccagttcaaaatcttgtcatcatcagcaagggagtgacaagataaataagaaaatccttgacttgaaggagtttacaatccaagcctaattgtgactatttctgaaggcagagaacacagaatcagttctcttaattttggaatagtgttaaggtttaaaataaaatgtacttcagggccctttagatacatatgtgttggtaatgatcaatctaatgctttgacttattttacagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaaggtctgcagagattttgtaaatgtgttttgaaagtgcataagtgtgtgcttcaaatatggctgaaaagtatttcttcaaaaacatatacacaacttgtcattttgcagttcctatgagaggacctgaattttggagaataattaatggagatactatgaaaaaggagaaaaatgtcactttactttggaaggtattcccaattttaatattaatcttaaattgtatttttatactcttaaaaatttacttcatggtccataatcctgttattaatcttcggaaagctcaacaatcctgtattttcattgcatttatgagatgtatttaaagagagctaagatgtacagtggctgaagcactggcatagtgttaggagactttcattctcttcttagcttcacatattatagttacgtcagtactatttgggcaaagttacttagactctttgggcctcagttttctcatctgtgtaaatgtaatattgaactagatgataggcagtgtttcttggagtctaaaaattgtattcatatttaatcctgaacaatgtaaatgtcaccttccccgcacaccccaagggcatctaacacatgacagagtattccatttatgtgatggcataaaaacagtggatagtcccatatatgatggctgtttagcctagtaattttcaaagcatcctctcccaaatgaactgatttctatttcaagtgaatagtttatttggtcagtaaatgccaaatttaagattgacttgggaatacaacacatgaagtcaaagagtatttctgtcactccaaatgtgaattgtaagtttaatacccaaggttgaatgagcacatgtttgaaaatggtttcctgatgtaagaccaaagcctctgtaaaagttgtggtatataagaatttatgttcatttggtttctaaatccagttactctataatttcatttggtgaataatcaatgcaatttctaaagtcttccatttcaatatttcttaaaataattttttattcttttatttcatttcttttatcattgctctccttaaaaaatttagtttcttttgttattgctctcttttctttttctagcaaaccattccttcaacacattttaatatttccaacttaaagttagcattagaactgacagacatttatgagccatttattgtattctgaacacttcatacagatctccacctcccggggaattcaggacctgtattctgagagattgagtgggcggttgaacccaccgcggaagggggcactgctgaataagaaacaagagtcttgcccgacagattatttttctcatatttttggttttatctccatgggcactgttccagatacctgcaaacttctacagtgaaggacaggcagtgatgttcccatgtttgtggtagggccagctatgagcagaatttaagtagcttttctttttctttgatttgtcctctcagagctgtagtcaacagccctttggcctaggctacagctaccctctcccattgcaatatactctagaacaaaacagttgtctttctccagacagttcttatgttttcctcatatcatggattccacatttcctcagcaatgctgccaatagaagtttctgtaatgatgaaaatggtttatatctgcattgtccaatatggtagcaaccagccacatgtggttattaagcacttgaaatgtgcctagtgtgactcagcaactgaattttaaattgtatttaattttgattaatttaaatttaaatggctgcaagtggccagtggctatctttttggacaacaaagctctatgggttctttaggggtgatttgtgggagggagacaggacccttgctaatctaccatctttgcagaaccttgaatgccttttattagtcaatttgcctttcattaattttgttttgtgctgttttgttgtgttttcctaaactgagataatagttcaatgattacggttctccaagcctatgcctcttaaaccgggataagatttgcttaaggagtaagccacaaggccacaggataagtatggcactttttaaaaaatatcatttctctggcatttttaaaataataaactttacgttaaggcagttttagagttacaaaaagacggcaaagatagtacagagaattcctatgtattcccacaccaagttttctctagtattaacatcttaggctagtatgatacatttgttacaatgaattaaacaatattgatatgtcatcattaactcatctgtaatttatttcaaatccaaatttccttagcttttacccaatgttctttttctggttcaggattccatccaggatagcagatttcatttagtagtcatacctccttatgcttctcttggttgcaaaagtttcttagatcttctttgtttttatgaacttgacacaattgagaagtactggtcgggtattttgtagaatctccatcaaatgggttttgtctaatgttttctcatgattaatttagggttatgtgtcatacctccttatgcttctcttggttgcaaaagtttcttagatcttctttgtttttatgaacttgacacaattgagaagtactggttgggtattttgtagaatctccatcaaatgggttttgtctaatgttttctcatgattaatttagggttatgggtttgggggaggaagatcacagatgtaaaatgccattccatcacatcatattaaggatacattctaccaatgtgacttaccatagttgatgttaaccttgctcgtctggctgaggtagtgttgtctggctgaggtagtgttgtctggcttcccactggaaagttactcttttttctcctttctccattttagttttaaaaatgaagtccccatgcttaaggagtaggagtcatgttccacctacttgaaggtagaggacctacatatattatttagtgttcttctgcatgggagatttgtctgttctcccacattaactattttatttattcaatcatttatttatattagtatggacaatgaacatttattttagacttggtttgtaatccaatactactttattttgttgctgaaaatattcctgcttcagtcattgggagctcttttaattgactcatgttcctttgacatgcccccgtcattgtggggttttttattttaatttttgagtactggtaagttcgactttattaaaattaaaaacttctgatctgggaaagactgtcaagaggatgaaaagttaaggcacagactgggtgaaaatatttgcaaaaacacacatctgataaaggacttataaccaaattacacaaagaaatctttaagattcaacaggggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaaaaaaaaccaagtatctgaacaaaaacctagccaaagtagatatacagatgacaaatatgaatattaaaagatgttcaacatcattcatcactaaagagttgcaaattaaaacaagataccactccacatctattagaatggctaaaatccaaaaaaaaaacctgacaatacaaattgctggtgaggatgcagggcagcaagaacttttattcattgctgtggaaatgcaaaatggtacagccactttggaagccagtttggtaatttcttacaaatttaaacatagccttaccaaccacatgatgcaacattgcatcctaggtatttactcagctgatttgaaaacttaagtctacatagaaacttgcacatgaatgtttaagcagctttagttatattcaccccaaactagaggcaactaagatatccttcaaaaatgaaacgattctgtatacttctgaaatggtgggtatatagcactatgcatttgccaaaactcctcgaacttcatagcacaaagagtgaatcttaatgcatgtagattaaaaagaaaatcatttaggaggttgaaggatcccaggattgactgtaaactgtgacaaaggaatctacctgtattacaagtgtatgaagcaacttcactgaaggtggtgggagaaaaggccactttggaacttgagtggagttgttggaaatgtgtggaatcttaagactaaaggcaaaagaaactgtacataagcactgtactctagttgatacagttctcacagggctatgggctaacaattatggtactgctctacatgtactctggaaggggacaagcaagtaaatggatggtggatggtgggacccagatttctcactgttggattgggaggttacacacaagcacaggatgatccatgtggcaatgaattagagttggggatataggtatgaacttatatctagcttaatatagatatagctagattctggtttaggatacatgtacattttcttgatttgtaaggtaagagggcctaaaagtaatgacatccagtagtaagacatgtgcccagacttgtttctaattaccatcgttcaataatagaaacaagggctattggaagaaatggctaattttagggttggggcagaaaatatacgagattagcctggaggatcttgtagtaccagaaagtaaggaagcttaacattctcttacttgatggttaccaaaaaagtattcattaaaactgacatgtttttttttcaaataaaatgcaacatttgcatgactttgaaacatttctttcttgcggtggctgctaaaatcttactttcaacctatccagatgattccaagttttgcagggatacatgtatatgtgtttatttttctctgccatttctaacttagaggcatctcaccggcaagaaattgagatgtactgttctagtctatgatatacagtccagccttctctgtctttataagggattgccagcatttaatcttacctgccataggtgaagttgattggggaaatggggtacactgttaacctctgtggaatataagaatagaattgaactagacacttattttacattcggatctttaatgacctgatattattatttttaattatatgacagaaattctggggtgccatagacactgttttgatggcctctgttactcattaacctttgcagacattcttacattctagataatcttccaagagtatcagaggaaaggaaaatgaatgacaaatcttactatgatcaatatatgatgattaacaccttcacagctcttgttgttgcttttcattttctgagggttattccttgtttgctttttagatgaggaaactctctactccttatgtctttcatttctctaaaattagagtgaaacttcttggtagaaaagtgtcttgatcatatccctactttattatcttcaagtgatttattctctgggccttaagaaaaaaacctcaaaaaggggaaaataagtttgctatgctccataacgatccagacaccttcatggagactgtggcagaggcaaactctatcccacccatctccccagcctctcagccttgtaatagtacctgccctgatctggcccctgcctcctaataagaaatgtagaatgagagttatgtgagctcagttagtataaaaagcactgcagcccttaaactaatcaatttctatatttactacagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaaggtaagaagaggtacagagtggtaatccattgcctcttttaatatttaacttttgcaaactctcctattttaaattatctttcaagcagcctgcaattctctgcatctgaaagtctctctttcacctttcatttcctttgtctggaaaaataacaaagtacattgtacaatgatcacataatacagtccttgagctttcatttgggagaacattgttgtaatggtgttataatatatgagaatgttttagtgaatctaatacttaaatcttttggaccaatggagatctttaggtcaataattctctctccctatgtacatatacatgtatatatttatattcatacatacacacatataaatatgtaaaaataagtatatatcatattaaatatatatttaacactatgtaaaatagtaatagcatgacatgttatatggatgcaggttaattgctgagacttaaaattactatggacttcattgaatgtgagtagcaaaccttcttgcattaattttgatatatctgattaatcggagaattgagacccactttcaataggaatttctagtctagattacatattcaaagtgtaaatttttaatggaaaatacaaattttctgtgtctctaccaatctataaaggcctttccaactgttacctcctttatgaaatctttgcttattgctttaattgaatatgccctatctcttctttaaatctcagagtgcttcctgtctttcttattttatgtcctgtttacattatgattacctttgtatttatagtgttaagcatcgagttccatagcacccagctcagtgttttatgcttaacatttcctaagtatatatattctagaaatatctgtagaatgcgtcagtggggtaggtagtgggaattgtaatgtgagaaaaactataatggttggagtgtccagagcctaataggtaagacaggtattaatgaaataatcatacaagtgaatgtctatttgcaaactgagagataagggcctgcaggaaaggaatataattttatgaaaggaatgaaaaaaaggaacctgacctggcattgagattcagagaagccaccttgaggaagtggtactgaactgaaatctgaaatgtgagtaggaattaaacttccccaaaagatgtaggggagggcaggaaaagcattggctcctaacaagagcagccagatcaaaagtctatggcacaggatagaaaatgaagaaagaccagggtggctttggtgtgggaaatcatggaaggcagagaggtgcgttgagacttggccctcagggccttgcaggcatgataggaattttaccctcaaatgtagaaatccgctggaggcttttaagtgggatgctgtgcagatggtgttaaaatgaacagatttgtgctttgagagtatcactccatcagtgggagaggatggttaataggcttgtgcagtattccatatgagaatgcctttttgaatatatcaaaaaattgctttttaaggttttagggagtatcatgtttctcttcaatgtcatctattcccatatctctctgtttaaatgactctcatgatgcaaaagtaattgtcatgtatcatatttatttgtgtaaattgtctgtcttctcttccttattccctttagtaggttataagttcctcaagagtattagtagatttttattaatttttaatttaaaaattaatttccttcttttcccctcagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatggtaagtttactatactttagtaagttgctctcatggattaatatgacactacagattattaattctattaatatagccagttaatgaaaacttcaaaaatatagaggatactaccatcctaatacatataatcctataacctttatcaaaacatttaattctcttcctcttctcttctcttctcttttcttttcttttcggcagggtctctctgtgttgcccaggctaaagtgcagtggaacaaacatggctcactgcagcctcaaccttctgggctcaagctatctttccacctcagcttcctgagtagctgagactatagacacacaccatcacacccagctaattaaaattttttttttttggtagagacaaggtctcactatgttgctcaggctggtcttgaactcctaagctcaagtgatcctcctgccttggcctcccaaagtgttgggattacaggcatgggccaccacacccagcctaattctgtttcctttgacattttctcattttaacattttatacaggggttatcatatcatatcatatcatatatcctatcctatcatatcatatcaattttctcctcatttctttctaccattatttttaatgatatagcattttattccaaagtccacttaaactgtttgagattctttatgttgcttccagctttatcttttcttaaatcattttttaacagcttctgatatcttctgccaaattgtttcctcaaactgtgtaccaacttataatgccactaacaatgagtgggaatgctagcctgaaggtctgaggagctaggactgggtgacctagaccagggtattctcccaaagttagaccagttattccaggaggtgagtcaagcacaaagtataagtgcacaagacagcatttctaagtctgagtaaggattgaggaaagttaactagggaagctaaggattgctatgatcttattatacaatatcattctaaggactcataccattattttattccagggacctagaatttagcatcagggtaaatttatttacaaattgttgaactgaatttagttcatcaccactgatgcgcaggtagtttctctctgtgcttttctttaaaccatgaggatataaaatttaggcttcacagagatctctcttcttctggatatattcttctagaagaatattcatatattattagcatttgtgaaaatcatgatggatccatctggagctttgctatagggttggtcattttccatggatcaaaatcccagatcttgcaaggggtctcgtggtctccaccaccattttgtttgcataggatttcacaagactttagtctcccagctaccttgaatggaatggggaaactaagtaagctgaattcctattaaaaaaaggagtattgcccactttgggggtaagggagaggtagtagaacatattgctctggaaaaggaaatgaaggaaagaaaaagctcatacaccctgcacttgaacaaattggctatcactggaacatgcctttgaaaaattgcaatcttctgtctctggctaagatttttagaaaaatatttggaaaactattgtcatgactagataattagaagtgcttaagtttgttttgaaactcccttgataatttaatccacaaataataagtaatttctatgtttggaaatatatgatagtcactttaattcttttttaaaatgtatgttccactcattactattaattttgtataaatgagccttttacgtatttttctcctcagatcattttatccccattgagaagtaccagttcagtctttacccaatatttatggaaggagtgggaaaaccaaagataattaatagtttcactcaaggtaaaaattataattttagtttccttttacaccaatgtgtgtgcctaatttgtttgcagtaatattgccatctgattattctttttctgatagaatcatggaagagtccaaagtcttctgtagatttttcatggtgaggttccaaaggaaatatttttttcctctaaaaataaaactggagctatagaaatagagtcactgggcctcttatatttctgattcatcttactgtacttggaataccaacattttgattttgttattactttttaaattgtcttcaaatctaagcaacctagcaatgatatttcaagagataaacatttcatttgttgttagaataaaaatcattaaaaaaattcatacatgtattatccaacagatattaattgagcattgttctaagcactgtggattgaatagtgaacataagtttctgcccttatggatcttaaataccagtgctctaattgagagtgatgggcaaaaaataattatataatgtcagatagaaataagtgccatgaaggaaaacaaaagcaagataaagggatggcattaaatgtggcactttagttgatagccagaaatggtctttctatggaggtggatgatattcgagtaaaaccttgcaagtacagtaagaccctacttgatatagtcaatagattcttggaaactgcaactttatgcaacatgaactacaggaggtccttgaataacatcattttgttcaaggtagtttcattataatgttgatgagaaaaaaaaggttttgttatacattgccatttcacttaacattgcagtttccaagagcctatcaatgatgttcagtgaagacataactgtacaaatagcaaaagcattccaggcaaagggacagtgtgtgaagagcccctaaagagtggggatgcttggtggttcaagaaacagcaaggaaatcagtgtgtgtggagtgaacaagatagagattggcaggtgtggaaggttgggtcctccaggagtagatactgagacagtcatcataacaagtttgacactttggcccattataatgtaaaaatgatcaggtagagaggaatggcaaataaataaatttgaaaaaatattttgctaatttacagtagatatgatgctgaacaaaataataagtattttattaatgtgatcacaacatatttttatcttcattttttatttttatatttttgaaggtaataagagatttgtgatgaattcagaaaatgtctactataatttttgatacagaaagaaattaatatttcctcaagtttctgagttgtgtaaattgtatttctttttcagatgatattgaaaaacaccagagtgatgcaggtttatatgtaattgtgccagtaattatttcctcttccatcttattgcttggaacattattaatatcacaccaaaggtattgtacttgaggttaagaatctttacggcaaaagtccttacgcgtattcaaaccctgatttaaaaccttctaaattaggaatattaaagtcttctaagtgcttttatatgtagtctgtatacaattaagatagcataaaaaggaaaggcctgttgtgaggaaatggcattccattttgctaggactgtaagagttaaagaatgaggaaagaaacacgaaacacagcttaacagttaaagacaggttttctttagataaaacctgaggggcttctggccaattttgttcaggagcccctttctcttacagactaagagtatgtattggttttagggtgagggggcttatcacaagcttggaatgtttatgtgtgagggagaagtttatggcggggttggaatgtctctgggaggaggggaggttatcttggggctgacatctttccagctggatggggagggttatcttggggctggcatgtgcctggtcagggaggatggaatgtttctggttggagatgttatttgtggtttatggtaatgctgaccttagccattaggctgatgccctttggatttaggtggtttttgattaaggggaattttaatatgaggtgcttgtccatgatggtgatgctcctgctctgtcaaggacaacataacttcaaggaagaatttagttttttaaaaaaaatgtacatacattcaggaaacaacaagcttataacaggaaatcctaagcagtatgttcttggaggtggcaaaaatggctttcagagttctgcagtttgggttaaggacgttttgtggtgaagtgggtggtaaaagtagccttttagtggtgacctggagcagtcagttcatttatgatcagcaggcactctgctttttagagatcagcactgtgtggctccagtctgcttggcttgtcaggcaaatgcctgagttccgtggatggtggcatgggtgccatgatactctctgtgctgagaagtccagtgtggttattttacacatgccaaatctctgtagaaaccatcgtcttcaggcaaaaaagagagagaggagattttagaatctgaatttatcttgtagttaagtgagttgatggggccacatcaaatggaattttttctggtacccactttgtgaccatttttaatatttcaatttctttgagagaaatctatccagtgtttagcatggtgcttggcacacagctttcaataagtattggctatttctattattacagtgattttcagcttgggtctagataaaagtttggtagaaatcttcatgggctagcatgtgaaaatgcatctgaccctacggaggcatagttgatctggtggactaatttctagcttgtctgttcactaactgttcacattttcaatatggatgtttttctctaattttgatgccctgtttatcctttgtagaatgaaaaagctattttgggaagatgttccgaaccccaagaattgttcctgggcacaaggacttaattttcagaaggttgctttttcaattttttttaacccagaatatatacgattgcaatctagacgccatatgacttatagagcattaagcatttttaagatttaaaaggtcatattttattcaattcatcttaatatatctgttattatatactttcaagaatagcaggatgcagggatttgaaatcaggaagaaacaaatttcagcgcatagtttatcgtatgagagttcacaatatacatatgttgcttctgtgtcacagtacataataaaataaatattagaaagttaagggtcaatctgatggagaacagatatttggatacactttttttggtataaactgtatttaggcaaaaggctggaatcaatatttttaatgtctataattatctccataattatttaaataaattagaaaattatataatcctcaaacattacaatctgaaaaatgcagtgatcataataaaacttatatttatgcagaagttccattcaagtacaagtactttatgagagttagtcaactataataaaataatttgtatttacttctatagtaggatttttcagaaagctctaaatttagtgactgttttattaattctcataatgtcccttgaagcaaagctagctttccactcataaaactggaaaaatagaattcagtcaagtcaaaatatacagatttttaaacaatacttatttggaggttattatccaggtttggtgattgcatctttatcattagtcacttgttaaaagttttcaatggtttccttttgaatacaagatataaactaaagccccctgaagctattaatagtactcaaggacctctttctacaatctgttatcaacctacctatacgactttttctatccctgggccttgatgatacctttactgttcccatccaccttcacagagccttccttgtacatgaagatcttgctctaggcccttctttcctcaagccttcctttaaccagtgtaattcaaaagaatttctaccccctttaagttcctagatcattgtactgtttttttaattgtggatagtgctctgaattcaaagactgtattttatccatcacaaatatttgtagtactcctcctgctgttctttatgtgcaaagcactgagatacatattcttacatttattaagatttttacttacattctcaatgtttcagtttcctcttctgtgaaataggctgcttaccttattaggttgtttgcgggactaaagaagatggtacttgtgacatagtaaggtctcaacaaatattaattattattgtacatatttatgtattttatattactattattattctttcagttaccctatgggacaagtgttattctctctattttgcaaaagagaaagctgaagctcatagtggttcggtaacttgttttagaggcaagattagcttaccagtttgtctggctttggagcctgttctaatagcagctgttctctatagcagtggcttctttttctttctttcttcttcgccatgacccacagtgaaaaaaacttaggttggtgcaaaagtaattgcagttttggcatttttaatgtataaatacgttttaccttccaacctagtacaccatagatacagatatgcaagaccgaaatgaaagatacgcaaagcagctttacttcttgcttgaaatagaatgttttaaaattctattttatttgttaaaaatgctggttgcaagacactaaattgatttcacaacattcgaatggcctatgatttgcagttagaaaaacactgttctacagcttatcaatgaataagtaaacaactaatattgtagacataatgaacaaagaaaaagattgaattgtaatttttcagcaggagaaagaatgccctgtcttcagaagcagcagtagtgttgttttatatacgaacaattctttttatagaaacttcgctttgcctgagtctaatcagccacactcctatatactcctcacctgtgctgttgctcactaagccagagtcttctttcattaaaacagtgttgccgagtttttcaagtaaatattttttctctcatttatcttttactaagaatttatacagtgacattttgtgtagttgtgatgatatttcagagagagatatatatatgtcgttcattcatttgttcaacaagcacatggtgagtatttatatgtaaggcttggctgttgctagggtctgggagaacagatttttcttaccatatgagaaataagacagtgaggtcagagaagagtggctgggttgaaagtagaataggaagagcttgtctccttttgcctctctaaaatagttcttttctattcatttcatccatatattcaatatgattgaatacttaccctataccagtcactatagtatgccctggcattataaggataagaaaaacactatgtgctcctgagtatacagtttaatggggatgataatcattaatacatttatcatggaaatagcattactttttttttgtacaaatttatggggcacatgagaaattttgttacatgtatataacatataatgatccaatcacaaccttatagttgtaaactacatgttgtgaaagaaggggttccattgtgctgagcgcttataatgtgggaacctggcttagtgtatccgtgggggtgagtggataaagttaagcaaattacatttgggccaagatctggtagatgaacaatcattaactaggttttgaggcagagatgtggtgtccagctaagtacctgcaaacactaagtcatgtggaaggcagtacctagcatattcacaaactggaaataggaagactataagactttttcttaaatatgagggttttatgtcaaaaaacctatatacttatctaagtaaaattgccaaattttcagtatataggtatatattaattcagggaatgatcatcttactttttaatgtcacttaaaaagaggctgaaacactctctcttcagcatttaagctctgaaatcttacctatggaccaccatgaagtggtttctcagtgttcaggagggccatgaaatgatcaggcccacatcagcaaaatgcagtttaaacctgcagcaaattatttttcccttttccagaaaatgcctggcacaaaggaactactgggtggaggttggttgacttaggaaatgcttgtagactacgtcctacctcgctgccgcacctgctctccctgaggtgtgcacaatgctgccacaggtcatctgacagaccttatatacaagtagattgaaatattgccacattttttcaagttctggtaaattaaagaaatgtgaagaatttttataatacagtgggtgtgaatgttcttatttgtaggactgattttttaaaaatctctggaaatatttgactttctaatcttataaattattttttaagcacagctaacccacaagatgcttagtttattactagggctgaccaggcgcataaataacactattaggaataaattaggttttggaatataatagaacatttaaagagtaaaggagaatataacttcaaagattttattaatgataaaaatcttctaaaattcattaacttttttctctttagcctgttgttttaatctcctaaacaattaaaatgtacccttttctttttgagacagggtctcgctctgtcacccaggctggagcgcagcggtgagatctcagctcactgcagcctcgacgtccttgggctcaactgatcctcccacctcatcccctttagtagctgggaccataggcgcgtgccaccacgcccggctaatttttgtagatatggggttttgtcatgttgcccaggctggtctcgaactcccaggctcaagtgatccacccacctcagcctcccaaaatgctggacttaacagatgtgagccaccacaccctgcctaaaatatgctttttaaaggaaaaataatatagtgtaactcactttatattactaaacaggaaaaggcaaatttaccatccaccctatgtttcatattcatgttatttaaattatttcatagggctaatagccttatattttctgatgataaaactgaggcccagagtggttcagtagcttgtcttgctcacccagcctgtccatgtaacatctgtggttcaaatccagatctatctgactcaaattgatacccgtgccatcagttccatattaacaatgtatttcttaatatgcttaatgccactaaattatacacttaaaaatagttcaaatggtaaatattgttacgtatattttaacatcataaaaatgggcaaatgatgtgaataggcatttctccaaagaagatacacaaatagccaagaagcacaaatgaaaatatcctcagtgtcattagataatagggaaacacaaataaaaaccacaagatgcccagtaggatggctataataagagacagatagtaagtgttggtgagaatagagagaaattagaattatcatatactgacagtgggaatggaatagcaactctttcggtaaatagtctgacaattcttcaaaaggttaaacatagaattattatatgatccagtaattccattcctaggtatgtactcaatagaaatgaaatagcaaatccacatgggaagttttataagaatactcatagcagtattattcataatagccaaaatgtgaaagtaacccaaatgatgaataaataagcaaacaaacaaaaaactcacactatattgcaaagaaagcagaccagaggagcctattgtttttaaaaataattcaaatacaaatatagtattttttaaaggaagtaataatttctatatcaagtgtttcctttaatttgttctccaaattcagatattttgaatattgattattatgaaagtactcttaacctgaaatttctagacatctaacatgattttcaaaatcttccctaaaattaatctattccacttttgaagctgtcattttccttccccttggtttatattaaatctaaatcctgaacctataattatgttaatcaaatgtgtttttaaaaatccaatattttgaatgtatttctaaaagaaaaatgaaaagaaaacatttatttaaaaccactatatgccagacattgctaacaataggataataccatatgtgattaaaaataattttgccaatataatttcctgccagatcttttttcttttgtatgttccacttccttttctcttttaaaattagtttttctggataatataaagatgaaaatataggacaatatgaaaacagctctatattaacacaatattttaaaactttctgcattttcttcatttttaaaataaataaaaactacaggtaaagtttgtcctgcttgttccactatttccggtccctcctcttcctggaggaacccatgatttcaagaatgctgtagcctgtgtttgtctagtttgtgcatttatactttcctactttcacatgtgtgtatccatgaccaatgaagagtaatcctttgaagtactgaaaatgttaatgtacctttcatattattccaaaaatatctctgaacattgtgttttgagctctctccaagttgatgtagttaatttagttcacacatttggactggtctgtagtattccattatacaaacatagcacaattcatttattcctctactggtggatgtttaaggtgtttgaacacttttttatatttattacaaaaagtgctgcaggaagtatggttgtatatgtctctttgttctctcatgtatatgatatttctcaatatttaaaattttttgaaaaaatatatgtgaatgacttaataatgaaatgttacagttaaatatttgagtttggaagaccacttcatgaaaaggacagtccccttttccacccctccgtacccttagtcttgctctccaaatgcctctttagttaactgtctgacttttggtttttctggtatgtcacctttttatttctaaaaaccatatgcttatgccactatgaaatgtagacggtatctattgatttctggctacaacgaggatttactcccacacattattccctccttgtgtttctacccatattgtcttgtcacttttttcaattccttaagtaatcatttctccaacctcagaaaaatctacttaaacttccatttcttgttcttttaaacagaagactatttcttggagctcccctgctatttttttttttaaataaaaacattagcactcttacgcttccctccatttctccctctactttccaatctctaaatctaagtttatgtttttccttaagtcagggttgatatgatgttctgtgttgtaatttgtctgtggtttatttttaaaaatagaaaaactaataaactgaatttgcattgttatgattatgtaaatattgtgacttactgaaccaagtatttaataatatgtgattacacttctcagtggttccgatgtcaaaggggaattttttaaaaaatatattagatatattccacctgttgatcaaaattgtgccgaattttagttagcttcatttttagtttttatcttttttcttttccttaagtttctaattgtcccttccttcctcttcctccctccattctttcatccattcatccctctctccctccctctctttctttcttttcatgctgtctttctttctccttccccttctcttccctcccctcccattatataatctatgctgttatgttacctattttatccactaccccatctttactggaggtgttgttctagtggactctccaggaactcctctatcctcctacttcaatcaggactaggctttctctaaaattactataagccatcactctaaactttcccttaactggtttctggttagtactgtttcctggattcctttccttcatctttcttaactacacccttaagtaacctcctaagaagtatgcgataagtctccatctctccatgcctgaactgccttttattctgccctcctcgattgttagtttggtggagtatcaattcttagaaatagcctttccaagagaacattgagataattcctgccttaacatatagtatccagtgttgcttctgagcagtcagatactattgtgatttttactcctcactgtttacttataatttcctttttaaacagatgcttgaaggcagcatgttcgttaagagtcatcaccactccctaatctcaagtacccagggacacaaacactgcggaaggccacagggtcctctgcataggaaaaccagagacctttgttcacttgtttatctgctgaccctccctccactattgtcctatgaccctgccaaatccccctctgtgagaaacacccaagaatgatcaataaaaaaaaaaaagaaagaaaaaaaaattctcctcatttttgttgttttgaattttcagtgatgaatctggagtggttctttttttatttaatgtggttattttttgaagagactttcaattccatgtctcctgtcaattctaagaaattatattatttctttgataatttcctctcctcttgtttctttgtttctctttctagaatctgtatgttggatgatggaccctctgcgtagatcttccacatctcttaccttttatctcatattttcggtttctttgttttgtgtgtgtgtgtgtgtgtgttatattctgagaccttgccataccctcttcttccagtgcttctgttggatttttatatactattatttttgtaaatttccaagtattctttctcagagtattctgttctggttttatgcatattttcttaaatgttgctagaaataccaattcgaggatttttgttcttttattttaaaaattcttttttcttctattccctgaattctgtgttccttctaggtcgtgtgttcctgttgtttatcttggcctctcttttattatctcagactttcctcctaatatctggtaatcctttgttttcctttcatgtttaggaatgaaacagtagacaggctgactgggagcccagtgtatataggcagggattgttgccctgggtgagtaggcagggttctggccagatgaggaaagatgtgctctcagctagcaatattccatggctgctgtcttcctccccagacagttccttagttgcttttgagaacaaaccctcagtctggttgtgaagggtagttcttacatggaggctcttccatgttcagcagaggagtagaagagccctattccatatacagaacttccattaggccccagtttccagccacagttctcttgtcttcatgtgtttttacgtgccatttcttcacgcactgtctccgctgtatacggcagggctaattttctttctcctgagctgcagctggatatattctggtcttcagctttctttgctcaccttctttgatctatactcttccaattgttttctatcttttagcaatgaatgaaaattacccacttctcattagccctctcagatcatcttctttgtggtgggtctgtatttgactcatttacatactgccattccaacagaatctctatagagacaagagagaaacctgttcagtcagccatcttgaatcagaataccatttctgtttataccttaaaaatcagaatcttaaacatatattgaatttttgttgtaagaaaatgtgttatgataactcattagccttgcttttcttccaattcaaattttagagtgtaaaagaactattacctttcttactttgttttgcacctttttaccttagcatttctgcctaatttgttaaatttcttctaaatccaaatcacctgggtttttcccttaaagatattttaagcctctttaattcattttcaatttgttccactcctttttattctttattttacaatatttttctcattctctgttttttgtttgtttttatccagccatgctcctgtgtctacatttatgccagctttcacaagagtttactccatttaacaacttcctttagcggggctaaagctagaaacaaatagatttttccttgggatctaaaaactatcttagattccccagtcagccctaggcctccaaataaagcagctcaataacccgtggcctcccagaacaccatcctcacagatctgaatcagaagcatccctaaagttgctagatggccttccaaatgtgtggaagagctggtgcattttcgagttagaagttctgtttagaagtagccatctcccctatgcccagaaatgcacattactgggcctagaagtgtgtatttcactcccctaaaaatgtaacctcagttttgtttattttcttgttccttatagccctcaggttatgaggaaccaggagagagtataaattaatcagctgaactttgtcacagcgagtagtaaaagggaaacaaagaacatgttcttctgcctatttgtgtttgggacaacctttcatcttctgttgtgttatagaaagattgttggactagaaaaaaagaactaagtcagggtcctccctctactctaattagccatgtaacctttagcaaataatcttggcagcctcaattgctttgtcagaaaaaagggagacacttggaccatataatttctgagatcttatttctagattttaaaaacccatggtaatgaatggttctgtgattctattctttaccatttttagcacttctttctctttattttttttaaatttttcttttcactgctctcctcttttattttttcttgttccaaactatcctatattgctgttggttctccctctttaaatttttccagctcgttgttcttctctccttttacctattctgttatttccctatagtttttcccttcctggggtaattaaagctgtccttagagtgtgatattaaaacattcattaagaaaatgggagaagccaccttagttcaaaattttgccctttcccaaaaggatgcattattgtaacctaacacaaaaatttatagtccagaacccatgcttgacaatgttttttgaaatcttttatctttttctttgtgagtgattttttattttgctttcttattttgttttattttatctaaacagagaacggacattctttgaagtctaatcatgatcactacagatgaacccaatgtgccaacttcccaacagtctatagagtattagaagatttttacattttgaagaaggggagcaaatctaaaaaaaattcagttgaacttctgagagttaacatatggtggattatgttgatttagaacttaaaatagatgtgtaaatttgggttcaaaatgtagatttgagtccagtttggatgtgtgattaattttcaaatcatctaaagtttaaaagtagtattcatgatttctggcttttgatttgtcatattcctggtcataaaacattaagaaaattatggctgttgctgtcattacatatctattaaatgtcatcaaatatgtagtagacaatgctgtaattaggtgaactctaaaactgcaacatctgacaaatagctttaaaaatacaatgattataagtatggaatcagtgaaaatatttagtttgtatttttatgtccaaacttttccattttagattcctttatagacacgtcagcctaaaaatcagcctattcgggtgttcttttgaatatctcctggcatttttgtatctaactttgttcaatctgggaatttcagttttcaatatccttgaaaatggcttaagtgataacttccgtttcagttaaaaggaagcccgaagttgtgtttgtgctgcccacaggacagtgggagttacagttcatatcaggatgaccctacatacccaggtcagattgacgggaccagaagggaacatcgacttctaatccagctttcttgtttaattatgacctaaatctaatttacttccactgaaccatccaagacctctggcaggcagggaaatgggcagtgatgcaaaaaagggagactctttggagcttttatgaatagttcatggtgaggacagaacttttctactttcagacagactgcttgctagttttatgaattcagcacacgaattatgctgcgttgctcacattcaaaccaaaccaacgactatgtttaatgaactcagtattcaaatttattatatatgcgtatatatgtatatatggatcccttatatttagatttaactcgtagttttatttgaaagtagaaaagaactctacaaaaacgggaagaatgtgtctttcttcccttcttgacttctaataggtgtcattgaaatgtaaaatctaagtatgaaattatgaaaggacattctttaattactgcccactcaacacatatttaatatgtgcccagattattctaaaatcttaaaaaaagatgcatatagtgaaattttttaaatggatatacttttaataaagttttataactcactgacaaaacatatttcaatagtatatgagtatgagatttcttatcaattatgagtgaaatattctatctgaatgcattggaaggcatttacagtatttgctttcaacagttactgagtatgacattttagcatgaaatatatcaaacacatcatttgaaggacatatgtaatcttgactatggttatggtttttttgtatgtattccttgttttcatattgatagcatctaattcttttgacaatcttaatatgtaggttcatttaaattttaagacagttcagtgcatatatagtagaagccttaagaaaaaagaaaatgagcaagcaaatatttgaagaaatgtataaaaccatagatttctttcagaaaaaaaaaacaggcataggaacagttttctcttcatatattatgattatgaataataggaaagttgtattaattcagtatttgtcattatgcagtattttaatacctacataagtctattccattattatattttgcgcttggcatatttattcctttatgcttttaatcactaacatattttacttaagagtataaaactatgctaaataaattgtattgtatatggaatatgcttgccattatgaagaacagctgggtataccattatttcaagtaataaatctgaattctattagtttaaaaattgtaaaattcaagttaaatgacgtgtatgatatataagctgaacacattttctatagcccttaatttagttgtgttaatttttcaaggtgatgtatcaacagctttttttattttgcatttgttttttcaatgtgtttacattgtatgaattgagctttttgcccacagattcttgatttgtagttgtttggcaggatttttctttgtgatataatcacttctataaaaaatatgatgtaca

SEQ ID NO: 97 - DNA, 63933 bp, Homo sapiens
ttggagacacaaaaagtcagagagactttatttaaatagagttaatttgaagtaaaccagagagttttgtgtgcagaagcattttgcttaacttagggccatcaccacattatgaactcgtgtgtgtgtgtgtgtgtgtgcacgcgcgcgtgcacaggctagtgtccttctgtgggtgtgtctgcgtgaggacccatccatgcatgtttgatctttatggcctccccctgtgcacctgcgcctatggataaggtatagtcttgtcttgattcccagtattcattctccttgaagaatcctgacagccttcagtcaccttcccttttccagtctcccaaaagcaatggcgccttaaatgtgcggtaaggatgaggtgagtcttgaggtagcctaggccacagctgccccttcaaggcaaggcctcagctgagttcaggaaataggagaacctggccccggagcaaccccagaagcgcaggaccacgaacgtcccgacccccagcagcaagaggccgcccagggccccaaagaagatgccgaagaacgcgtcgagtttcatgctcaggtgctcacagtgctcgccccaggccgtgtagatggagaaggacacacagctggtgaccaagagagacagacaggcggtcagaggcgggagctcagcctcccagcccctcctcttctgctggggaagaagaggttctgtaggagaggctgggctcgccccactctccggagagactgagtcagccctgaggccgtgctgaagtgagaccactgggcaaaggaggcaggtgtgggctttaaaaacatgggcctgggccggcgcgggggctcacgcctgtaatcccagcacattgagaggctgaggcgggcgcatcacttgaggtcaggggttcgagaccagactggccaacacggtgaaaccccatctctactaaaaatacaaaattagccaggcgtggtggtgcgcacctgtaatcccagctactcaggaggctgaggcagaatcgcttgaacctgggaggtggaggttgcagtgagccgagattgcaacactgcactccagcctgggggacagagcaagactccgtctcaaaaaacaaaaacaaaaacctggtgtgaattcagctgcacgtgcagtcagctgcacctgggcggcagggatgccggccacaggtgggcatgcgcagtcacacccccgccccagcccggccccgccccgccccgcccacccggagagccgggccccgccccacccgcgctccgcccgccccctccttcggcgggatctggaactgcagctggcggagggcccggagcccaggtctgcgtggggccgcggcttcctgcgctgttaaccagcggagccccggggactgctgatgagggcaggggcaaaggcgcctcgcttgactgaggggcaggactggcctagacacaggactgcaggttcttttcccacaaggagacagcagggaagcagcagccagatcaggtgggagggtttgactttgggccctggcgcggtggctcacgcctgtaatctcagcactttgggaggccaaggtggacggatcacctgaggtcaggagttcgagaccagcctgaccaacatggcgaaaccccgtctctactaaaaatgcaaaaatcagctgggcgtggtggtgcatgcctgtagtcccaactactcgggaggctgaggcaggagaatcgcttgaacgcgggagaaggacgttgcagtgagccgagaacgcaccactgcactccagcctgggcgacaaatgacactccatctcaaaacataaaaatataaaaaatgtttggctttggaaaccatgccctgctgcttaacctactgcgtcctggggcaggttccttgtcatctctaagctgcagttttctcatcttcgaaatagttctaagcccccctatggctcttttgggtttcagagtttgtaatatagcgcctttattctccacacagagcaggcactcacaactctccttttccactgtcctctcttccctggtctctgatctctcgagccatcctaattcctggaccccttgcagtgtcttgcccagcttgggttccccagcactgtcctccacctcctggccacagccctatgcacctgcagcggggcccactgggcaggtgctggcactggcctccatggtcacagtagcccctactgcacggggacacgcaggtgaagccgctctgggggctgtagaccaggtcgtagcccttgtagccatcgcatctgaagtaagccttcagcgtgctcacgttcactgtcgggaaggacacagattaacacagaaagcaaccgatgaacactaaatcagtaccttttcagccacgaattccttttcgggtgtttatcctgagaaataattggagaagtgcacagatacatatgcccctggacgttcagatcagcatggtggataatagtaacgtttcagaagtagggtctggttaaataaactactgcacatccttaccaagggatggtgcttcctatggaaaaagtttcctagggaaaaaggttcctagggaaaaaggttcctgtggaaaaaggttcctatggaaaatgctttcctgaagagcacatgctttgaaggtggccagacttgggtggaaactgaaactctgctagtgactagatgtgtaattcagggaacattccttcactctttcagcttcagtttccttatctttaaaaggaaatgatcataatagcacttatgctgctgtgagatttaaatgagataatgtgtccacagtactcagtacagtgccggacacacagtaagcactcaaacaatggtaatgattattataatgtattttaaaatatgacactatattcaaacataccatcataatatgtcaaatgggaatgtggacagaatatatgagacaacctgttcacaactgtttaatgaggaggttttccaacattaggaatgatttgatccttcagtaaaaaatggatgtctgaaggttcctaggcataaaagaaagttcagaaggatatgtaggaaatactgttgtctctctggggattgggattacagggtttttttcctcttttctttttgttaagtttgtgtttcctaaagtttctgcaataaacatacgatgcttgtataataaaaattataggttttccttaattgcatagtcagggcttgcctccctgcgcctcctaccccaactccccaacatacagtagttctgagggatttcaccccctgctccgggagagagcgggcttagcctggattctgggagaagctcttgcttggtcccagacccaagtaaaacagcagttcctgttgtgtttggggcggcccctgccctgttctctgccctatacagaaaataggacgtgttattcctttgtttctctgacaagcttgccaacttattcctgttccaggaaaaccgggggctgtcagcactgaaagggggctcagaaatcccatctcattttcagatgggggtgctgaggcctggcctggggaaggtgcttggggagtgttgaggcctggcctcggggaggtgctggggggtgttgaggcctggcctggggaaggtgctggggggtgttgaggcctggcctggcctggggaaggtgctggggggtgttgaggcctggcctggcctggggaaggtgcttgcacagggtgacaccatttcagggagtagttgcctctgtccctggccagtctccagtctccagcttcatatcctcccgctggagagcagagacgatgggggtgtccctgtgtatgcttaagtgcaatggcattttaagaaaactattagcaattttatgaaactaaattgctgctgttttattagcagccacagtcagcaaggccctggctgggtgcttgctccgtgaagctgtatacgtgtgactgcctcagcagtgctggctgctcctgctctcgaatctaaaaagcagctggacaaaatgttcacgttttcgctcaaaaccaaacaaacagaaaaactcaattagcttgtttgtgtgggctgaagcacctctgtttgcccgccccccgcagtgacccccatagtgtccccggaatggacggactcacgggctgtcacatcgcgcacgtcttccccggagatgggctggaagaccacgtcgttcctgggctcctcactcctccgtggaacgtggtataagaacgcctccaccaccgcggccagcagctggttgttcaggaagtcaatgaccgggccccgagggcggtactggaactccgagatgaccatccagtgttggatggggcttcccgaggccggtgctgcagaatcgctgtgtgggagggcaacggtgagggggggtggggggctgggggtgggggatgaggaagagatctgggggcttagggggacacagtcccacttacattcgttccacttggctgttgcggagaaaggcccgcatgtccagggtccccagtctgtatgccacctaggttagaggatggcagatgggggtgggggtgaggccccatccgggggggagacgccctcccaccttgatgggtgtattcatccctgtttcctcctggaacgggagccccaggaccccagcaccttcctcacctgtctctgcacccttgcactctagcctagctcagtgagtgtcatgggtccttgcttaataatgtttgttgagagtgaagggttttccattctgtccccccctcagcctcatatgacgagcagagaatctgacatgaatggcccctaccttgcctctgacacatgactcatgacctcctccccagtatattgaacatgggttgtttagacctaggagatggtcggggctgggggtgtcaaggtgacttaggtggagtctaaactcaaagagtgcattgtctggcgcaggtgacaaatgtcaacagattttaccgtgtggagtgtggagtggggagtgctaggcttgcagtagtgataatagcagtcatcatgtttgaatacttgtgtgtcaggcactggactaaatgcttgacacgcgttatcatttaaacggtgatacggcctgttgactcaggtgctatgattgtccctgtgtttacagatgacctgttatatgatgtgtctagttagcacacctgctctagtgaggggcagagcagggattctgattctgggtgtgcaggattctacagccccaaccactcagcagttgtgccactttgcctgtgactgaggtatggcatggcagccaagaagagggagccgcccgttccctctgggaagtcagggaagactcccgggaggtgaaatgtcctttagtttctttcagatcataaccaagatgcttagaggtctcggctggggtgacttggcaccctggcctctgcttatgatgagtcgaggtttctgtcttgggccttcctcacttcctaatgccctgcacctcccatggggcaagaggctccggcctcctctggcagttgaatccagatggatgacaagatgaaggccgcacagcgatggttccgccctggcctgaacccgccaagcgccccctcccacccagagcgcggcctgcagcactgaccgaggcgttgacttctgccatggaggcattttcctcttcactgagcaagagctggatgactcttaagggaagttctggagatgggagaagcaaatgtatcatcaccccacggtttacccagacttacccaaaaagtctgtcgggccagcccaagttgactgctccattccagtgacagaaggtcactgaagaaaccgggagaagtggccctcaccctacattccacagtgacagaaggtcgctgaagaaaccgggagaagtggccctcaccctacattccacagtgacagaaggtcgctgagcaaaccgggagaagtggccctcaccctacattccacagtgacagaaggttgctgaagaaaccgggagaagtggccctcacgctagggctcactccactatgctccgggcctccccagcgctcatctcactgagccagctgtgaggtctctgcctccgtccttcctccataggccacacaggcccgtggtccttgccgtgacagcttgcctcgccagctcccatagcccgcaccttacaccatcccagagaaatctggagctctgtcctgtgaccccagagcttcctcatcttccccaaaggtgggcggagtgcgggggtgagagggtggggcccaggaagagtgcgggggtgagagggcggggtctctggcggtacctaggttgacagttggactgaagttgttcccagccaggaagcagcggctgtcagtgaaggctggggggcaggtgcacatgggctgacagcccagagtctgggagatgtagcagtggccttgattgtagcagtaattcacagggcaggactggttctgacacaggaaagagctccccagagctgcagagtgagtagggaggtcagcagcagcgcgcagggcagcagagggacggcccagcccgtggaaacccgctccgggacaggcttgctttcccccagtgttccacttcgggccactcggaaccccaaaccatccttccccccttttccaggcgtttctctgcagggcaacccctttccccggccagacaggtattcttccacttttgtggagggactggagtgtttctcagaccctctgcttcagaaaggaccccgaaggctggcagaggaggggcccccagctggctttcctcacgccctcccctctcacgtccatctccttttctgcctttataaaagctgcggttctacccactctggcctcggctctgaaggcacagtgatctgtagattttatttgggtgccttagggggcttggtaaaggcctcgctgtgatctccctcatcagactctggtgactcagagcgggaggaacagatggctgggaggactcaaagggaaaatcaggcacctttgctgccggatccccacgccagcccctccaaacgtcctgactcgtgagatgcagagatcctgagcctcgtgtctctgaagatccccagggatcccgaggacccagcttgcccggttctctggcggctgctgaagtctcctccccaaaccatcttcagtctttcgcccggggctccccccatcaatgcctcagggatgcccagccccgtcccctcccctatgcctgtacaacctcttctccttcagccccacaccatccaccaccccctttccaggcctgcctagatttcccatacctgcctagatgatttcccacacctgcctagatttcccacacctgcctagattgagcattctaaagatctgctggaaaaaggagagaaatggtttgcctttggctgtctacacccttgagctatcagctgctcccagaagcgcctgctccaggccctgttcccggctcacccgcacagtgccgcccatccccagtcaggtttggagggcaggcctcgcagcccttcccaggaacgcagtggacactcgggaagcacggctcctcacaggcatcctcggagccctcgcagtagcggccgaaggtgcccccgtcacacttgcagccagccacctggaggagggttgccgatcacgggcggccaggagaccaaactgggaagggcttctgggtgtttctgactgacccctttggcctgagaacccgtggaccctgagtcatgtctcagccccaccagcacctgctgagcaccttcttgaccaggccgtggggcggcaaggccctgcctaaagccacacggtagtcctgcccagctggcctccctgggtcattgtttaccctgaccccctgcctggccctgcaccaggatctcagcctcttccctctcacactctagctctttgcctgaaatcctttctagagtaagatgggggatgcatgaatgattgaagcatgaatgaatgaatgaatgtatccatgtatagatgtatgtatccatgtatgtatgtatccatgtatgtatgtgtgtatccatgcatgtatgcatgtatgtatccatgtgtgtatccatgtgtgtatgtatcatgtatgtatccatgtagatatgtatcaatgtatgtatccatgtatgtatccatgtatgtatgtgtgtgtcatgcatgtatgcatgtatccatgtatgtatccatatgtgtgtatccatgtgtgtatgtatccatgtgtgtatgtatccatgtatgtcctattgcttgaaaactggattccttatttattttgagacagggtcccactcggttgcccaggctggagtgcaatgtcttgatcttggctcactgcaaactccacctcccaggttcaagccatcctcccacctcagcctcccgaggagctggggctacaggcatgcaccaccacgcccactaatttttgtatttttcttctgcttttttttttaatgagacagtctcgttctgtttcccacgctgcagtgcagtgtctcgatctcggctcactgcaatgtccccctcccaagttaaagcaattcttgtgcctcagcctcccaaatacttgagattacaggcatatgccaccacgcccagctaattttttgatttttagtagagacagggtcttgccatattgcccaggctggtctcaaagtcctgagctcaagcaatccgcctgcctcaggctcctatgtggcctgcaaactggatttcatataagctgaaattgacctcccttgctgactcccaaaccaagaagacagagcctccctgctgagcactgtgagaaaacacagcagccagtacagcagctcagcaaaggctgcggcgccgagacctcaccaagctccctgcgctcccctttctaactcccttactgaagcgactcggggaatctccctaaaatggaatcctctaacacttgctactcccaagagtggatatttggggatctgtggaatagtatattgatttcaatctctttttcccattgtgtattttatgcttttctaccccctaccccaccaaccgtccctacctctatccctttcgagtacccattctctgctcatgcttcagaaggatgtgtgtgtgtgtctgtgtgtgcgtgtgcatgcgtgtgtgtgtaagtggtgaaggaggtagttttgtgttgccagataaacactttcctttctggctcttcctttacaaccaaaaataaaaataaaaaagcagataggacaagagtcgtggaattaggccaagtatcttggctagaaacatggagaagtagtttctccaaactggaaaagatgtttcttttagctggaaggagatagtaaaagagaaagcaaaggggcttggaggtgtcaagatagagggacccgcagctctcttcccagcaccgtgatgatgacatcctagggagaaatgactgtggggtgcttctaggcagacaggactgtaagcggcctcagaaaaggtgtcctgtgtctgagcaaggcacagaagcagcagagcctctccctgggtctgaaggggaagtggggcggagctgtgatggaaacctgtgtggactcacgcccagggacccacaaccaccttccaccccacaccgcagggccctctgctgggcttcgccgcagagctgtggggcgctgtgagaaagacggaggtggaagtttcctgccaacctggcagaaggggaggtgggagataaaaatccagttgaactataagcaataaagtaaggttctttcctctttccttccttccttcctttttctttctttcgtccttctttttctccaatatagtttctttctttctttctttttctcctttccctttctttcctttcctttctttcctttcctttctttccctccttctttctttcttttcttttcttttcttttcttttctttctttttgacatagagtctcactctgttgcccaggctggagtacaatggcgcaatcttggctcactgtaacctccacctcccgggtgcaagcgattttcctgccgcagcctcccgagtagctgggactacaggcgcctgccaccacgcccagctaatttttgtatttttagtagagatggggtttcaccatgttggtcaggatggtctcgatctcctgaccttgtgatccgcttgcctcagcctccaaaagtgctgagattaaaggcgtgagccactgcacccggccagaaagttctctttcttcccatgtgagtttgtggcctgagactggaatctgctctactcacctaccactgctccacccatctcccaacacagacacacccaggacaggcagaatcacagcatccattccactcccatttcctctcccctcggcacagaaactcctcccccacctcccaacactcacctccagggaggagttgcccaccctgctggtctgattgtacaaacactggctctctgcattgcaatggcagaccacagtcctgggctggagtgcagatgccaagccaatcttggcacttcttgctagaatctccagagtgaatggctccagcgacttgggtgtccacagcaacgtcccattctctgccccggggaagatgagaatgttgagagctgggagactcctcggctctgtggtctgattgctgatacggggcttcccccacccctctcaggccaccctccccctccccagacaaatctcattggtcatttcctttgagcaaggctggtatcgggggtgatcctggtcacgctcccagctggaaggacgtggcaccagtccaacatactgattgtagcggggaacgccacagaggggaaagcagtttcctcctgaagaaaccccaaagggcagccctggctgggctcacaccaggatgggacatcctgggggatggaggatcaaggccaggatcctccagacacctccccaggctgcgctgccggccaaactggcttcactctcacggcagccccatcctttgccctgatttctcacccaccccccacttcctggacctttcccagacacccccttcagacaccagactgtagtgaaacactactacatatcttcagatcaaactgatatttttcaagaaaataggaaagtctccttaaaacagcagattgaaaggaagtgacagagaatagacgaacgtaatttccagaccatcgtccttcaggggtggggcccgtggagaagaaaacctctcagtgccattgtctcgcacctgggaggacgcacatggggcaaaagggatgcaggcaaagcagtcccttctgagacacagagagaaagaacatcaggcagagaggcaaagagaacgcaaaatatgccccccggggctttggtttagccaagaacagtcaccctcagaattagtgctggcaacagacagaaagtggcatccctttgatgcccttggaccctttgaattagtgctggcaacagacgaaagcagcgtcccttgtgcttggagcctttggccctgatcatggatgtagggctcggggtctctaacacctttacggagagggagcgatggcactctactgggtcctagcccaggaaaccagacaaggagagacacggctaggtaaacatggttgccagacaaaaagagcaagaaaggtaccaaacgaaagtatttttcatatttctttaaatcttgtcctacattagagccttcctttaatagatataaaaatgttgtaaattggtcattttaaatgttgcacttgattattctaataatttggtgaatgcataatgactaaagatgactatatatgatcagattgagattaaatgatcttcaaatcttttttttgagacagagtctcgctctgtcaccaggctggagtgcagtgacgcgatctcagctcactgcaacatctgcctcctgggttcaagcgattctcctgcctcagtctcctgagtagctgggattacaggcatgcaccaccatgcctggcttttttttttttttttgtatttttagtacagacggggtttcaccatgttggccagactggtctcgaactcctgacctcagatgatccgcccacctcggcctcccaaagcgctgggatgacaggcatgagccaccgcgcccagccttgaatcagttctatgtgcccagagtcactctagctatctggccaaaccgccgtaagcccgtcactactacttactggggggcacctatttgagttatagatatcgctcctcggaaatgccggtcctggatattcaaatgaaagagtgacagcaagtgttgctgggtgtagcaatgcagaatttcccaaatttgactctgacctcatcccctacccacctccccactctccccagccagccaaatagtcctaccaaagagctccaagtcggtgcagctgtctctgagcgtgaagttggcatcctcagcattgctggtgtactgaatcagcgtggtctgccccttgtaggcttcaatcacacgaccaccattgatggagggcgggtactgatctgaaacacaaagagggaatgggggttccgaggcaggacagtctcctgctttatcagcctcctctctttctcaactctaatatgtgtgaggcattcccaggactgtgacccacctctggaagaaggaattattctgtgtacctgctctcgactgacgcacagcaggctgggactgtactgcccacctagccaaatctttagcctctttctctccccccacctcctcaaaaagagctcctttcagattctttcctgaacacagtgctatgctgggtatgacaaaaagtgaattagagagcagatttgtttggaccattacaaagggttgtacccttagaccaaagggttgtacctttggcaaagggctgaaaacctgaagggtgctgggtgtctcatgtctgtaatcccagcactttgggaggccgaggccggtggataacctgaggtcaggagttcgcgaccagcctgaccaacatggtgaaaccctgtctctactaaaaatacaaaattagtcaggcatggtggcgggtgcctgtaatctcagctattcaggaggctgaaacagaagaatcgcttgaacccgggaagcagaggttgcgacgagccgagatcacgtcactgcactccagcctgggcaacaagagcgaaactccgtcaacacacacacacacacgcacaaaacctggagggtcacatctaaagggacattgcatttgtccagaaatagagagggagtgaaacctcttcacgggtctgtttctcggagccctgccatttccatttcatagttgcttcacacattcattcagtcagtcatttaacaaacatttattgagctaagtggctggcactgttctgggtggtgaggatacagtcatgaatgaataattaaaaagatacctgtgaaaattataaaatatgttgagtaattataaatgctaaggagaaaaaaataaagcagggaaggcaaacatgaagtgtgggtgaatgtgacattttagacagggcggccaagagaggcctcaccaaggaggggacattggaatgaagacgtaaagaaggtgaggggcaagcgtgtggctgtccagggaaggaagggtattccaggcaagagaacagcacgtgtgaagcctgggagctgagcgcacctagcgtgtttgaagaacacagaggagcctgcggggctggagtgcagggagctgggaaggggtccagcgctaggatggagtggagggggctgggaaggcatccagcgctaggatggatggagggggctgggaaggggtccagcgctaggatggagtggagggggctgggaaggcgtccagcgctagtatggagtgaagggggctgggaaggcatccagcgctaggatggacggagggggctgggaaggcgtccagcactaggagaagagctctgagaagctgaactgggccgaaggccactgcaaggatggagagagccagggaagtctctgaagggtttgagcagaggaatgccaggagtggaagaatctgctcagtgaatgcagatgcacagggaaaagcagggtcaggcaagggcagctcctcatctgctcccgactctgaaaaggcctccccaggcctcgggccacttactgagggtggcgttcgcctgctcgtagtttttactgacttccctcgtgtgaagtccgatgcttgcgttgcgcagggccagggtgtcatagatgcatgagctatctccgtcacagttggagatcaaatgttcagcccaggagctgtttttttgcagttgtgagtagaaaacaggggtgaagttggaaggcagctggtcattcctcttgccaaggaggcctgtcccgttgatctgccctgtaacacacagagcgcggtggtaccaggcatggcactcagccttattccatctgtgtccacctctacccctcactttagatggcttggagcggggcggtgggagtgcagggccagagcggtttccagcttctgagtctagaaacacctgctgcagtgagagaggacactccacgtcccccattctctcctccaggtagagagaggcaggtgggctggtggtggtggggacagccctgggggggcacagattcctcagaccttagggaggatggaggtctgcttcctacagggccgagggggacgacataaacataccggctcccctcacctgcccctctgccccaggaccctgcccagactcacaggtcattccaaagtggaaaagcatctcctcagggctccctgggggaatggtggagccattgggcatcctgaagtcgtcctctggattgttattccagacccctgagggacagagtgggaggttggccaccctgggcacgcggctgtccccttcctggggagcatccggcggacgcagtggggagaggccagggcctggcagcctctgctcttgcacctgctgtcaggcctccaggggagccgggaggacgggccctcacaccctgcccgtctgccttcgggaggggcgggaggaaacgcgggcagcggtggaggagggcgggaggatgtgggaggcaagaggaaagggagaaaggatggctgtgccccccgcctccccgcagccccccctgatgctcccttagagcgggcggaggacaggaagggagcctcgggggaggctggagaagcccctcggctcccggcccgctctgtgccccaagggttctgctccaaggaggcggagaaagggaggccgagcagggctgcccgggccgccggcgtgggggtccgagctccggctggctccgcggagcctcagaggcaggtccgagccgccctcacccaggagcccctccgtgcggttctggtactcgggcgggaggctggcggaggcgtggaggatgttggagagcgcgatcaccgagacggtggcccagccgtcgaagctggccgagacctcagagccgttgcggctcaggaggactccggtggcgttgaacgtctcctggcctggagcatcgggaggcagcggagaggaagccaggtcggcaccacggcccgcaccaaacccgcgccctgccgggcccgcaccacccccaccccgcccctggggctgaagccgggaggggtctgcactggaggcggagaagaggccggcgagctgcacgccccgctcgggggtagaggctgcgctctcttggccctgcaccgccacgcaccgggccctgcaccgccacgcaccgggcccggcaccacaacgcactcggccctgcaccgccacgcaccgggccctgcaccgcaacgcacccggccctgcaccgcaacgcaccgggccctgcaccgccacgcacccggccctgcaccgccacgcacccggccctgcaccgccacgcaccgggccctgcaccgccacgcaccgggccctgcaccacaacgcacccggccctgcaccgcaaagcactcggcgcggcaccgccacgcgcccggccctgcaccacaacgcacccggccctgcaccgccacgcgcccggccctgcaccgcaacgcggcttcccgcccacctcgctgctcccggtgcggggagggggcggccggcgctccccaacctacctccgccgtcttcatggtcaggctgaaatgtcacagtctggttatccagcaggacacggattgcgtcgtgaggctcaaggagccattggacctggaaggagatgggagggggcctgagcccgacccgcaggtggagccgacgcccaggaaagcagctgggagagcccctggggctggaagctgcgccctgggccgggaggaaggcgctggaggccgcggcctgaggtgatgccagccgccgtctaccgtgtgctcggcagggccaggcatggttttcggattatgccctttagctcttacaacagcccgtgaggcaggtaatgtcatccccattcttactaggagaaaaccaaattaagtagtttcttcgaagccaagcagctgggaaaccgtggggccagagccctaatccaccatccccaggatttactccgggacagctgcgtggatgggctgtgtcctccctccctcctgcccggcttcccctccttcgctctcttccttctcctcggcctcagtatgtggctgaaggtccctgtgggtggaatgcagggaggttcccggcacccctcactcaccgtgacggggcccaggctgctggagcggtactgagccgcaaaggcgatgaagttggtggcctgggctgagccagtctgggcggtgcggccctgaagcaggaaggaggagttcccgtcttgggccccgaccagcaggaagtcccccagcccattgaaggtgtaactgacaccatccaaggtggtgatgtgggggtccccgaacatccaggctggaaggaaaaaagagatgctgcctcagcatgacaaatcatgtgtagggctgaggttcctcactgcagtcaggtgcggcacttgtccaggaggactcagggtgaggttcctcactgcagtcgactggggcacttgtccgggcggactcagctggggagatgttcacagagcacagaatcctcccctcaagcctccttgcattttcgtgccccgctattctcactccttccccaactcaggtacaaagcccctccactgaccatccacccatcactggcgtcatctccatcttcccttgtggccacagctctgcccctactccttatccagatgccacctcccggaagcccagaagctccccctccccagaggctcttcctgggcctgggccctgtcgctcaccgggctgtgggggcctgtatgtagcacagcccacgtggggccgcctctgctggtacagggcacagaggtagggcttgtcattccagcggcagcaccagctctgtggctccagttcctgggctgcggagaacagcagtgagtcggggaggttgaggacctggagaagcttggcagggcagggtggtgttggttgagagcttggcagggcagggcggtgttggtggagagcttggcagggcagggcggtgttggtggagagcttggcagggcagggcggtgttggtggagagcttggtagggcagggcggtgttggtggcaagagcatggctttggaatccagcatggcccttctcatgaccttgggcagtgaatagggtgctgtctcttttgcaggcattggggccactgtgcagcagggcgcatggtaggagctaagcaaatttcctgtcttgagggtggagagccaagtactgctgctctcaacgtgctgggagtggggagggcacggctgacggtctgggaactgtggaaactgccatgggacgggggagagaacgggaggacacagaccacgtgaccccacacccctgcgctctccagctcccttggagcgtctctgtgggagctgactctcagtcttcccccaaacatcctgctcatctgggtctacagggacggggtcagcctaggcgctctcttcttgcctggagaaatggccccactctggcctggggatgtggagccaggtatagagatgaggaaagaggctctcagctcatacatccccgaatgtccgctggtggggatgttggaagcttcctaacgttacccgatcaggaagtggaggcccagagaggggaagggtctgggaaggaatgaggacgagaggcttcatgctgagggtcccctacttggccgggaaggtggggttgagatcacggactcacgcacccaactgccaaggacgctgcacgtgccagccttcacgaaactctccccagggcccgtagctgcagcacacgcctcctcgccaagaggtgaagctgcacagctgcctactgccgaggccccagcgacctgaaacaagtccagtcccactcaggcccaggctggggctgccaggggcggggtgggaacaagcaggggctgtttctggggagaggctgagggcgtgagcagagagggtggtgggtgggcttgtggggggcgggaaggaggtgtcacctatgctgacgggttggaatcgtaagtcccgtcgtccctgctgccaggaacaagggcaggagacctggttccagccccagctgggccaccgaggctggctcttcagccactgcaggcactcgagacggtagttgggcctttcttcccggtgtagcctgtagaactgcagcccttggaggcctgaggtcggggatgggggggaaagggcttatccagggctggggctgcaggccctgtctcagctttagggtcaaccaaaactcacaaatgcaccccctcctgccacttctcacctctttggacccaagtcagatgggcaacaattcctcccccaaagcccctcgcttgacttagcgtctgcttctgacgaccaaacgtggttgccacagaacaaatagaactggatttacacttcacagttcacgtggctggtttctaaggctaaaatgtccttcaacctatcacattttggaaactattatttctttcccattggggcctctggactgagtcatggagaaggcgccattgtttgcctcttgacgcttgtctttctacccgcatgaaagctctttgagagaaaacacagttggtctttttcctttgtttctggctgttagcacggtgtccagcacacggcaggtgcccagtaaatgatgacaatgaacgtgagacccccgggcctcttcttggtggattctctctttttgagatggagtctcactctgtcacccaggctggagtgcagtggcgcgatctcggctcgctgcaacctccacctcccaggttcaaacaattctcctgcctcaacctattgagtagctggaattacaggtgtgcaccacaacgtctggctaatttttgtatttttagtagagacagaatttcaccatgttggccaggctggtctcgaactcctgatctcaagtgatccgcccacctcagcctcccaaaatgctgggattacaggtgtgagccatggcgcccagccggtagattttcttaaaggatctcacctgggttctcattcctgctctggacaggacacttggagtattgtctgaactgcccattcaaatcccacctcccacaagaccctgtcctcacttccaggatctgggccccccgagagccctcttgggctggttcatctgagggaggagatgtagccccctctgagactgtgctgtgtccaggggtgcaggaggtgccagctgctccctgggtggtgccacatcccacctagacctgtaggaggttgaactgtgtgggggaggcccttcaggatggccgtgatgttagggaggtgccctctaggactgcgatggtgtatgggctggaggacacgcgagggcttgagaccagctcaggtgtgataaggtggcacttttacctgagttggaattcaggaatctatcagggcgatacctctcccacactggctgggacatcagtgggctgttttcgaaatagccatctccactgcaggaaaggagagactctcaggcctctgccgtgcacaggctcttgcctcgcggttgcaaggcgtccattcatcccgctagccggtcagcagctggtcaaccagctaggcgggcagtgggtcagtgggtcagccagcccccatcgtcaagccccagcactgagcaggagaggggacaagatggctgggcagaggtaggaggctctaaccgattccacatctgatcgctagctgcaagaaactggcaggtccgcttggtcatgagacaggggcgtgaaaacaacagagttcaggcctcatttctgtttgtttcccttcaacaagcagagggtttggagcgggacagactctagggacagtgtattgtgatggttaagacccagtttctggagttaggcagtgatggattcaactgctgatccccccacttactagcttggtgaccacagacaagttactgaccctctctgattcttagttttcacatctgtataaaagggattacagtggcatctacctcactgtattgtgaggattaaatgcagtaacatctgcaaatccctcagaactgagtgaggccttgatacaacagatgctgccactgctgctaccaccaccaccaccatcgccagcactaccaccaccaccaccatcatcgtcaccaccaacactaccatcaccatcaccatcaccaccaccaccaccaacactaccaccaccatcaccatcaccaccaccatcaccatcaccaccaccatcaccatcaccaccaccatcgccaccaccatcatcaccatcaccattaccattgccaccaccatcaccaccaccatcaccaccaccaccatcatcaccattgccaccaccatcaccaccatcaccaccaccatcgccaccaccaccaccaccaccatcaccatcaccaccatcactgccacccccaacactaccaccatcgccaccaccaccatcaccaccaccaccaccatcaccaccatcattgccaccaccatcatcaccaccatcaccaccaccaccaccatcaccaccaccaccatcgccaccatcacccccaacaccaccaccatcaccaccatcaccaccaccatcaccaccatcaccatcgccactgccacctccaccgccactaccaccaccaccaccaccaccaccaccactatcgccatcaccgtccccaggtgtggggtccgagcatggcccgggaaggaggaaagcctggagcagccgcctgcagccccaccctgggtgcctgctgcagagtggggactcttgggcttttcctcctccctgacacaagcaggatgatgcacccctgcgtgacaccttccttgggtgtacctggaccgtgtgaaattcctagagttgggtaattcccctcctttctccttcatagcacaccaagaaactagtgaaagcagtgtaatcaaaggggtaacctgaacacactcaatgtaagagaagacatttgcagcaattatcaagaacaaaagacatgtggccttcgtactgattgccacaccccagcatatgggaacagagatggcgcactgctacatcggagacagcctcccacacacgggaatccacatttcaaccgcccacagccccgtgcctcctctctcccttcaccaccggctccatataagcttttgggtgccccctggataagtgggtaattctcaggaagtcaggaaggcagattctagcctcagatgtctgggttcaaatctccatgttgccacttcccagctctgggactttaggcaaattgctagtctatttgtatctcagtttcctgatctgtagaatggggatgataaatagtatctgcctcgtggggtggctgtgatcatgacatgcagtaatgtacacgaagtgttagtgtcatcagtcttggctgttattatcacgatatttgagaaggtaagagaggccagctaatgtcagtggaaatcagggaagccaaagctctgggaatgattacaactcacggggactgggatgggaaagggcatggcggacaaatgggtgatcttgtcgtgggaagcagccagatgcctggccccagcgggagctggagtcagcgtgagtcagaagcaccagccaggagggttcccgccttgccccaggatgggagtgtgtgtgcagcgaaagccgactctacacccctccctgccaactgctcagtgctgacagcccctcccatcctacctagagaagcccatgagcaccgggttgcctgagcgctgggccacgtcccactgcatcccaccgctctggtagagaaacagggcataggacctgctcccgtccgtggagaggatggcttggtaggtgttgctctgggggtgggtggaagaaaacacagggatgcccgtgagagatccggggtctcctctcttatgtccccccgcccgtcccacagccctgctctgacacgcacagcacctgttcctggtctgcccacagcaaagacatgggcccaaaatgctggcaagttttgggtcagtgagggcagctttcaccctgggtgcgaacgcacttaccacggtggatttgccttttggtgactttcttccaggaggggagataaagggttctgggttacaattcagttagatgagtgtttgttagagaaagctaccagaacctgagatcagccaagataccagagagctagagaggaggcttcattagctcccgcgcggatatttaaggacattgcccaaattgtctcctccatctaaacagcatggatgacactggggttcactgaaggcgcacacgttgtccacagtaggtgaccagtgaacttttgtcgagtgaatgaagaaatgagtgactttagaccaggcataaggaagaacttggtgactacaagagcggggtcctcggagggaggacagaggagatggtgtggcgcaccctgtgcccgttggatgagcctgtgcttcagagccagaggctggagtcagaagaagctccactcaggcctggctttgccatttgccagtggcgtgactctgaacgagttacttaacctctctaaccattgtcttcctcatctgtaaaatggggagcataataccagactgagccacgtgaaattgtgaatagccagacatttttgacttacaaaaatgccacttgctatgtttcagcctaataatacccggtttgctgggctgctgtgaggtcaagtaggcaaagggccgagacaggccgggcccacggtgagtgctcagccaacagtggtggcagtgggggggtggcggtgggggggcttgctataattagcaatctttcctagagccagagaggattttggaagagtggcccctgcctaggattctaggatgtctgactcccagatagctcctgggagctgcccaggggtctactcaccccgagggtccactgggcaggataggcgtgggcattgacccacgtgacctttagggcccacctggccttgtagcccccgttgtttgtcatctttctaatccaagactcggcctgctggactagcaggctgtgttcaccatagaacgtctcgtattcctaggaaaggagggcagatgaaaacaagccaacgagggtcccactcctacacatgggccccccactttctgcctgaggaccctgcccacttcagcccacccaatggcctgccctcccctgtcccaggcctgcatttttgccgtgagcttttctgaggtgaagttcaattcaaacttgggctgcaggaaggcctgcagtgtgcagaatgcagggtcgtggcccagacgtccaagacctctggacttgaactcaagcatcttagctcaaactggcccagagagcagagccactcgggcccacttttacctccccatgcctaatctgcagcttcttgagaacaggcgtgagtctcttcctcttggagcctccacactgccctgtccgtggcaggggcacggtccacacttcctgcagtagctttcatcacatttcctctgattggagttattcacccagtccaggagcacaggacgggccctcttgactcactcttgttaggatagaccccctacagcctgattttacaatcaaaggctgaattgtcagcccccatcccccgtcacctgtaggtcttctcgtggccgggttggggtattcctggtcagtctcgcggccgggttggggtattcctggtcagtctcgtggttgggttggggtattcctggtcagtctcgtggttgggttggggtattcctggtcagtctcgtggccgggttggggtattcctggtcagtctcgtggccgggttggggtattcctggtcagtctcgcggccgggttggggtattcctggtcagtctcgtggttgggttggggtattcctggtcagtctcgtggttgggttggtgtattcctggtcagtctcgtggttgggttggggtattcctggtcagtctcgtggttgggttggggtattcctggtcagtctcgtggttgggttggggtattcctggtcagtctcgtggttgggttggggtattcctggtcagtctcgtggttgggttggggtattcctggtcagtctcgcggccgggttggggtattcctggtcagtctcgtggttgggttggggtattcctggtcagtctcgtggttgggttggggtactcctgagtcagcttaatgtcccttgactgcttcctcccacacccatatttaagcctcagtcccctgctgcaggggctgtcacagcagcaactctggcaaagccttccacacagctctttgtctcccctgccagctgctgggggatcctgactgccaggctttgaaaggctcacctgataaaatgtggtcccccgaccagtggagaagtcagcatcgtcccagaacggagccaccagggccacagggtcccggcctgtgaagcctgttgggagtgggttggggtaggagaaaatctggtagtctgactctgggaagatgatctggccattgtctgtgaactgagcacatgggttttgtggtcagcattcagggagggaagtggggaggaaagtcccagccttggtccagctcctcaaaagcgtgacccccaagggtagagctttagagatgctaacaacccctggaagtcacctcctgtgtcctgttttggggagagccctttccatatattctcacagaatgctccgccctcaggccatcccttgcgtcctcgggtggtaggcttggtcctgtttcactgcagatccctggctgtggaccagcccctcacaggcacacccctcttggccagtcccctgggccccatcctgaagtttgcgacacattaggtggggctcagggagtggaaccctctctccatcgctcagggggtggagccctccctccatcgctcagtgggtggagccctccctccgtcgctcaggggtgtagacaccctctctccatcgctcaggggtgcagacaccccatctccatcacttagggggtggaaccctctatctattgctcagcaggtgtagacaccctctctccatcgctcaggggtgtagacaccctcccttcatcgctcaggggtgtagacaccctcccttcatcgctcaggggtgtagacaccctccctccatcgctcaggggtgtagacaccctctctccatcgctcaggggtgtagacaccctcccttcatcgctcaggggtgtagacaccctcccttcatcgctcaggggtgtagacaccctctctccaccgctcaggggtgtagacaccctctctccatcgctcaggggtgcagacaccccatctccatcacttagggggtggaaacctctctctatcactcagcaggtgtggacaccctctctccatccctcaggggtgtagacaccctcccttcatcgctcaggggtgtagacatcctctctccatcgctcaggggtgtagacaccccctctccatcgctcaggggtgtagacaccccctctccatcgctcaggggtgtagacaccctctctccatcgctcaggggtatagacaccctcccttcatcgctcaggggtgctcagggctatagacaccctcccttcatcgctcaggggtgtagacaccctctctccatcgctcaggggtgtagataccctctctccatcgctcaggggtgtagacaccctctctccatcgctcaggggtgtggacaccctctctccatcgctcaggggtgtagacaccctcccttcatcgctcaggggtgtggacaccctctctatcgttcggggtgtagacatcctctctccatcgctcaggggtgtagacaccccctctccatcgctcaggggtgtagacaccctctctccatcgctcaggggtgcagacaccccatctccatcacttagggggtggaaacctctctctatcactcagcaggtgtagataccctctctccatcgctcaggggtgcagacaccccatctccatcacttagggggtggaaacctctctctatcgctcagcaggtgtaggcacccccctccatcgctcaggggtgtagacaccctctctccatcactcaggggtgcagacaccccatctccatcacttagggggtggaaacctctctctcactcagcaggtgtggacaccctctctccatcgctcagcaggtgtggacaccctctctctatcactcagcaggtgtggacaccctctctccatcgctcagcaggtgtggacaccctctctctatcgctcagcaggtgtggacaccctctcgccatcgctcagcaggtgtggacaccctctctctatcgctcagcaggtgtggacaccctctcgccatcgctcagcaggtgtggacaccctctcgccatcgctcagcaggtgtggacaccctctcgccatcgctcagcaggtgtggacaccctctctctatcgctcagcaggtgtggacaccctctccatcgctcagtcgccctctcatgctgtgttcggactcagcctcctccctcagggccacaggagccaggactgtccctccaactctgctccaggaggcagggaccagggggccagagacaaatcccagaaggtggaaacggcaggaacagtccagtttcccaagtgtagctttttactcctgagaaggccccgcagaagcagcggtgggcccagcaggtgggcagccctcgcctggcaccctgtgttcctcaggcagaggcctgacattaaggaggctgtggggatggacgaggggcccagccaaggctgcttccattcccgcttcctctgggttccgtctcgaagcaggagagagaagtgggccctgggagttcaggctgcgcgggccgcagcccggactcacgtagagggaatcacggagagaggagccaagggggaagccagtcgccggcttgaagagtggggaggtgaagtccacggtcctcctgacgaactccaggtccccggcgcctgccccataggggaagagggaaactcctgggccaggacagagaagagcaggaagtccaagtgggcctgggccttctttagggctgaaagggatcccagagcgctccctgcaggctgcccacacctgtcctgtgttccccgagggccccagaggcagccatctagggtgcttctcgctccctctccacccacattaaatgcatgtggtcattttactccctaaactgcgcctctcatccttccccagcttggagaaaaacaggtcctgctgtcagaataccagcaaacgattctcaatctcttagtctcaatccttttcagggttaaaagacaaaagtctatgctgggtgcggtggctcacgcctgtaatcccagcactttgggaggctgaggcgggaggatcacgaggtcaggagttcgagaccagcctgaccaacatggagaagccctgtctctacttaaaatacaaaaattagccgggtgtggtggcgcatgcctgtaatcccagccactcgggaggctgaggcaggagaattgcttgaacccgggaggctgaggttccagtgagctgagatcgcgccactgcactccagcctgggcaacaagagcgaaaactccatctcaaaaaaaaaaaaaaaaatagacaaaagtccagcgcaatgaagatgagtaactgcaaagcccttttcagggaatgagacttgtttcctaagacggcctttctccagataaacttgaagactcctccaatttaacctaggactccctagaggccctcgggctccagtttgagaaaccttgtcccaaatatttctcgcagctgccgactccttggcgccctcccctggtcctgcttggaaacccgcaggctctcctggcctcctcactgcctgcaaatcggaccgctccaggcaccacttgttaaatgccatttgtacaatgcaaaactgagtcctccctggctcccgttgcctacaggattccccgcatgccggccgcactttttgctacccttcttctcattttcagccaccccaaatgcttcggggatccacccccatgcagcaccgggacgactttctgcagccatacctaccacactcgtaccttccacggccataccttccacacccataccttccacagtcataccttccacacccataccttccacacccataccttccacagtcataccttccacacccataccttccacagtcataccttccacacccataccttccacacccataccttccacacccataccttccacacccataccttccacagtcataccttccacacccataccttccacacccataccttccacacccataccttccacacccataccttccacagtcataccttccacacccataccttccacagtcataccttccacagtcataccttccacacccataccttccacacccataccttccacacccataccttccacagtcataccttccacacccataccttccacacccataccttccacacccataccttccacacccataccttccacatccataccttccacacccttaccttccacacccataccttccacacccataccttccacacccttaccttccacacccataccttccacggccataccttccacggtcataccttccacacccataccttccacacccataccttccacacccataccttccacagtcataccttccacacccataccttccacacccataccttccacatccataccttccacagtcataccttccacacccataccttccacatccataccttccacggccataacttccacacccataccttccacacccttaccttccacacccataccttccacacccataccttccacacccttaccttccacacccataccttccacagtcataccttccacacccataccttccacagtcataccttccacacccataccttccacacccataccttccacatccataccttccacacccataccttccacacccataccttccacacccataccttccacacccataccttccacagtcataccttccacacccataccttccacagtcataccttccacacccataccttccacacccataccttccacatccataccttccacacccataccttccacacccataccttccacacccataccttccacacccttaccttccacacccataccttccacacccataccttccacacccataccttccacacccttaccttccacacccataccttccacacccataccttccacacccataccttccacacccataccttccacacccttaccttccacacccataccttccacagtcataccttccacacccataccttccacagtcataccttccacacccataccttccacacccataccttccacacccataccttccacacccataccttccacacccataccttccacacccataccttccacagtcataccttccacacccataccttccacacccataccttccacatccataccttccacacccataccttccacacccataccttccacacccataccttccacacccttaccttccacacccataccttccacacccataccttccacacccataccttccacacccataccttccacacccataccttccacatccataccttccacacccataccttccacacccataccttccacacccataccttccacagccataccttccacacccataccttccacacccataccttccacacctttgttccagctgttcccgccctcctccctgcctggggtgctcctccatccccggctctgcattccttagggccttccattgtgtgcacttagaccctgggatgagtcctctaaccgccgctaccggaccgtccatctatcccttgctgaatggcactggggtcatttctctgtctccagctcctggcccagtgccatgcacaaagccagccctcaggagcgactccgatgctgtgtccctgtcctcggtaaggccctccccacccgagagagcggagactgtgggaagtaggctgagagggagccttcagttacatcacccctcaaaaggcacaggcctcacctgtatggcctcacctctctcaggcaggatggggatgggggcagctgtggagcgggtgtgcatggcagtgctgggaatggtggaaatgatggtctgggaggttgtggggggtggtgatgtggctgtgcgtctcccaccgtctgtcttcagtgacggtgttgtcattcctggacacgtgaaaagacaaggcggggtgtttcttacagtaacaaaacaggagagtcaaagagattcaaagaaatcaggagctggaagagggagctggaaactccttgtctctcccctgctcatatccaaactactctcgacatcagtgcttttcgattgcggcacaaaggagggtgagcctgtcacccaccacacccatcacctcctcccctgtgggacctgacacggccccaccaggtaatgcgaatgcaccagtgttctcaggtactccttaggctgaattccgccaaggggcccactgggagacataaaggcgaggcagttggcagctacctggtgtttccatcttcagaggggagtccgaggatactgtggaagctgaggtagcactgctgacagcaagaggggtggcgtgacctgtggatactgaggaaaggctggtgacaggaagaggggtggcgtgacctgtggatgctgaggaagtgtcggtgacaggaagaggggtggcgtgacctgtggatgctgaggaagtgtcggtgacaggaagaggggtggtgtcacctgtggatgctgaggaagtgctggtgacaggaagaggggtgccgtgacctgtggacactgaggaagcgtcggtgacaggaagagaggtggtgtgacctgaggatgctgaggaagggatggtgacaggaagaggcgtggtgtcacctgtggatactgaggaaaggctggtgacaggaagaggggtggcctgacctgtggatgcagaggaagtgtcggtgacaggaagaggcgtggtgtcacctgtggatactgaggaaaggctggtgagaggaagaggggtggcgtgaccggtggatgctgaggaagcatcggtgacaggaagagtgctggtgtcacctctggatgctgaggaagggctggtgacatgaagaggggtggcgtgacctgtggataatgaggaagcattggtgacaggaagaggggtggtgtcacctgtggatgctgaggaagtgctggtgacaggaacaggggtggcgtgacctgtggatgctgaggaagggctggtgacaggaagaggggtggcgtgacctgtagatactgaggaagtgctggtgacaggaagaggggtggcgtgacctgtggatactgaggaagtgtcggtgacaggaaggggggtggcgtgacctgtggatgctgaggaacggctggtgacaggaagagaggtggcgtgacctgtggatactgaggaagtgtcggtgacaggaagaggggtggtgtcacctgtggatgctgaggaagtgctggtgacaggaagaggggtggcatgtcctgtggatgccgaggaaacgtcggtgacaggaagacgggtggtgtcatctgtggaagctgaggaagtgtcggtgacaggaagaggggtggcgtgacgtgtggatgctgaggaagtgtcggtgacaggaagaggggtggtgtcacctgtggaagctgaggaaaggccggtaacaggaagaggggtggcgtgacctgtggatgctgaggaagggctagtgacaggaagaggcatggtgtcacctgtggatactgaggaagggatggtgacaggaagaggggtggcgtgacctgtggatgctgaggaagcgtcggtgacaggaagaggggtggtgtcacctgtggatactgaggaaaggctggtgacaggaagaggggtggcctgacctgtggatgctgaggaagtgtcggtgacaggaagaggggtggtgtcacctgtggatgctgaggaagcgtcggtgacaggaagaggcgtggcgtgacctgtggacactgaggaagcgtcggtgacaagaagaggggtggcgtgacctgtggatgctgaggaagtgctggtgacaggaagaggggtgacgtgacctgtggatgctgaggaagggctggtgacatgaagaggggtgacgtgacctgtagatactgaggaagtgctggtgacaggaagaggggtggtgtgacctgaggatgatgaggaagggatggtgacaggaagaggggtggcctgacctgtggatgctgaggaagtgtccgtgacaggaagacgggtggtgtcacctgtggatgctgaggaagtgtcggtgacaggaagaggggtggcgtgacctgtggatactgaggaagcgtcggtgacaagaagaggggtggtgtcacctgtggatactgaggaaaggctggtgacaggaagaggggtggcctgacctgtggatgctgaggaagtgtccgtgacaggaagacgggtggtgtcacctgtggatgctgaggaagtgtcggtgacaggaagaggggtggcgtgacctgtggatactgaggaagcgtcggtgacaagaagaggggtggtgtcacctgtggatactgaggaaaggctggtgacaggaagaggggtggcctgacctgtggatgccgaggaagcgtcggtgacaggaagaggggtggtgtcacctgtggatactgaggaaaggctggtgacaggaagaggcgtggcgtgaccggtggatactgaggaagtgtcggtgacaggaagaggggtggcgtgaccggtggatgctgaggaagcgccggtgacaggaagagtgctggtgtcacctgtggatgctgaggaagggatggtgacatgaagaggggtggtgtgacctgtagatgctgaggaagggctggtgacaggaagaggggtggtgtcacctgtggatgctgaggaagtgtcggtgacaggaagaggggtggtgtgacctgtagatgctgaggaagtgctggtgacaggaacaggggtggcgtgaccggtggatgctgaggaagtgctggtgacaggaagaggggtggcgtgacctgtggatgctgaggaagggctagtgacaggaagaggcatggtgtcacctgtggatactgaggaagtgttggtgacaggaagaggggtggcctgacctgtggatgccgaggaaatgtcggtgacaggaagacgggtggtgtcacctgtggaagctgaggaaaggccggtgacaggaagaggggtggcgtgacctgtggatactgaggaagtgtcggtgacaggcacaggggtggtgtcacctgtggatgctgaggaagggctggtgacatgaagaggggtggcgtgacctgtggatgctgaggaagcgtcggtgacaagaagaggagtggcgtgacctgtggatactgaggaagtctcggtgacaagaagaggggtggtgtcacctgtggatgatgaggaagtgtcggtgacaggaagagaggtggtgtcacctgtgtatgctgaggaagtgtcggtgacaggaagagaggtggtgtcacctgtggatgctgaggaagtgtcggtgacaggaagagaggtggcatgaccggtggatgctgaggaagggctagtgacaggaagaggcgtggtgtcacctgtggatactgaggaaaggctggtgacaggaagaggggtggcctgacctgtggatgctgaggaagcgtcggtgacaagaagaggagtggcgtgacctgtggatgctgaggaagggctagtgacaggaagaggcgtggtgtcacctgtggatactgaggaaaggctggtgacaggaagaggggtggcctgacctgtggatgctgaggaagtgtcggtgacaggaagaggggtggtgtcacctgtggatgctgaggaagtgctggtgacaggaagagcggtggcctgacctgtggatgctgaggaagtgtcggtgacaggaagaggggtggtgtgacctgtggatgctgaggaagggctagtgacaggaagaggcgtggtgtcacctgtggatactgaggaaaggctggtgacaggaagaggggtggcgtgacctgtggatgctgaggaagtgtcggtgacaggaagcggggtggcgtgaccggtggatgctgaggaagggctggtgacatgaagagggttggcgtgacctgtggatgctgaggaagtgtcggtgacaggaagcggggtggcgtgaccggtggatgctgaggaagggctggtgacatgaagaggggtggcgtgacctgtggatattgaggaagtgtcggtgacaggaagagaggtggcgtgacctatggatgctgaggaagtgtcggtgacaggaagaagggtggcgtgacctgtggatgctgaggaagtgtcggtgtcaggaagaggggtggcgtgacctgtggatgctgaggaagtgtcggtgacaggaagagaggtggcgtgacctgtggatgctgaggaagtgtcggtgacaggaagaggggtggtgtcacctgtggatactgaggaaaggctggtgacaggaagaggggtggcctgacctgtggatgctgaggaagtgtcggtgacaggaagaggcgtggtgtcacctgtggatactgaggaaaggctggtgagaggaagaggggtagcgtgacctgtggacactgaggaagcgtcggtgacaggaagaggggtggcatgacctgtggacactgaggaagcgtcggtgacaggaagagaggtggcgtgacctgtggacactgaggaagcgtcggtgacaggaagaggggtggtgtgacctgaggatgctgaggaagggatggtgacaggaagagaggtggcatgacctgtgaacactgaggaagcgtcggtgacaggaagagaggtggcgtgacctgtggacactgacgaagcgtcggtgacaggaagaggggtggtgtgacctgtggatgctgaggaagggctggtgacatgaagaggggtggcgtgacctgtggatactgaggaagtgttggtgacaggaagaggggtggcgtgacctgtggatgctgaggaagtgtcggtgacaggaagaggggtggtgtcacctgtggatgctgaggaagtgtcggtgacaggaagaggggtggcctgacctgtggatgctgagtaagtgtcggtgacaggaagaggggtggtgtcacctgtggatgctgaggaagtgctggtgacaggaagaggggtggcgtgacctgtggatgctgcggaagtgtcggtgacaggaagagaggtggcgtgacctgtggatgctgaggaagggctggtgacatgaagagaggtggcgtgacgtgtggataatgaggaagcattggtgacaggaagaggggtggtgtcacctgtggatgctgagggagtgtcggtgacaggtagaggggtggtgtgacctgtagatgctgaggaagggctggtgacaggaagacgggtggtgtcacctgtggatactgacgaagcgtcggtgacaagaagaggggtggtgtgacctgtggatactgaggaagtgtcggtgccaggaagaggggtggtgtcacctgtggatgctgaggaagtgctggtgacaggaagaggggtggcatgacctgtggatgccgaggaaacgttggtgacaggaagacgggtggtgtcacctgtggaagctgaggaaaggccggtgacaggaagatgggtggcgtgacctgtggatgctgaggaagtgtcggtgacaggaagaggggtggtgtcacctgtggatgctgaggaagcgtcggtgacaggaagaggggtggtgtgacctgaggatgctgaggaagagctggtgacaggaagaggggtggtgtcacctgtggatactgaggaagcgtcggtgacatgaagaggggtggcgtgacctgtggatgctgaggaagggctagtgacaggaagaggcgtggtgtcacctgtggatgctgaggaaaggctggtgacaggaagaggggtggcgtgacctgtggatgctgaggaagcgtcggtgacatgaagaggggtggcgtgacctgtggatgctgaggaagggctagtgacaggaagaggagtggtgtcacctgtggatactgaggaaaggctggtgacaggaagagaggtggcgtgacctgtggacactgaggaagcgtcggtgacaggaagaggggtggtgtcacctgtggatgctgaggaaaggctggtgacaggaagaggggtggcctgtcctgtggatgctgaggaagtgtcggtgacaagaagagggatggcgtgacctgtggatgctgaggaagggctggtgacaggaagaggggtggcctgacctgtggatgctgaggaagtgtcggtgacaggaagaggggtggcgtgacctgtggatgctgaggaagtgtcggtgacaggaagagaggtggcgtgacctgtggatgctgaggaagtgtcggtgacaggaagagaggtggcgtgacctgtggatactgaggaagtgtcggtgacaggaagaggggtggtgtcacctgtggatgctgaggaagggctggtgacaggaagaggggtggtgtcccctgtggataatgaggaagcatcggtgacatgaagagcggtggcgtgacctgtggatactgaggaagcgtcggtgacaagaagagaggtggcgtgacctgtggatactgaggaagcgtcggtgacaagaagaggggtggcgtgacctgtggatgctgaggaagggctagtgacaggaagaggcgtggtgtcacctgtggatactgaggaaaggctggtgacaggaagaggggtgtcctgacctgtggatgctgaggaagtatcggtgacaggaagcggcgtggtgtcaccagtggatgctgaggaaaggctggtgacaggaagaggggtggcctgtcctgtagatactgaggaagtgtcggtgaccggaagaggggtggcatgacctgtggacactgaggaagcgtcggtgacaggaagaggggtggcgtgacctgtggacactgaggaagcgtcggtgacaggaagagaggtggcgtgacctgtgggtactgaggaagcgtcggtgacaggaagaggggtggtgtgacctgaggatgctgaggaagggctagtgacaggaagaggcgtggtgtcacctgtggatgctgaggaaaggctggtgacaggaagagaggtggcgtgacctgtggatactgaggaagcgtcggtgacatgaagaggggtggtgtcacctgtggatgctgagttagtgtcggtgacaggaagaggggtggtgtcacctgtggatactgaggaagcgtcggtgacaagaagagaggtggcgtgacctgtggacactgaggaagcgtcggtgacaggaagagaggtggtgtgacctgaagatgctgaggaagggatggtgacaggaagagaggtggtgtcacctgtggatgctgaggaagcgtcggtgacaggaagaggggtggtgtcacctgtggatgctgaggaagggctggtgacaggaagagggatggcctgacctgtggatgccgaggaaacgtcggtgacaggaagacgggtggtgtcatctgtggaagctgaagaaaggccggtgacaggaagtggggtggcgtgagctgtggatactgaggaagtgtcggtgacaggaagaggggtggcctgacctgtggatgctgaggaagcgtcagtgacaagaagagggctggcgtgacctgtggatgctgaggaagggctagtgacaggaagaggcgtggtgtcacctgtggatactgaggaaaggctggtgacaggaagaggggtggcctgacctgtggatgccgaggaaacgtcggtgacaggaagacgggtggtgtcatctgtggtagctgaggaaaggccggtgacaggaagaggggtggcgtgaccggtggatgctgaggaagtgctggtgacaggaagaggggtggcgtgacctgtggatgctgaggaagggctggtgacatgaagaggggtggcgtgacctgtggataatgaggaagcattggtgacaggaagaggggtggtgtcacctgtggatgctgaggaagtgtcggtgacaggaagaggggtggtgtgacctgtagatgctgaggaagggctggtgacaggaagaggggtggtgtcacctttggatgctgaggaagtgtcggtgacaggaagaggggtggtgtgacctgtagatgctgaggaagggctggtgacaggaagaggggtggtgtgacctgtggatactgaggaagcgtcggtgacaggaagaggggtggtgtcacctgtggatgctgaggaagggctagtgacaggaagaggcatggtgtcacctgtggatgctgaggaaaggctggtgacaggaagaggggtggcgtgacctgtggatgctgaggaagggctggtgacatgaagaggagtgacgtgacctgtggatgctgaggaagtgctagtgacaggaagaggcgtggtgtcacctgtggatactgaggaagtgtcggtgacaagaagagaggtggcctgacctgtggatgctgaggaagtgtcggtgacaggaagaggggtggtgtgacctgtggatgctgcggaagggatggttacaggaagagaggtggcgtgatctgtggacactgaggaagcgtcggtgacaggaagaggggtggcgtgtcctgtggatgctgaggaagtgtcggtgacaagaagaggggtggcgtgacctgtggatgctgaggaagggctagtgacaggaagaggcgtggtgtcacctgtggatactgaggaaaggctggtgacaggaagaggggtggcctgacctgtggatgctgaggaagcatcagtgacatgaagaggggtggtgtgacctgtggatactgaggaagcgtcggtgacaggaagaggggtggtgtcacctgtggatgctgaggaagggctagtgacaggaagaggcatggtgtcacctgtggatgctgaggaaaggctggtgacaggaagaggggtggcgtgacctgtggatgctgaggaagggctggtgacatgaagaggagtgacgtgacctgtggatgctgaggaagtgctagtgacaggaagaggcgtggtgtcacctgtggatactgaggaagtgtcggtgacaagaagagaggtggcctgacctgtggatgctgaggaagtgtcggtgacaggaagaggggtggtgtgacctgtggatgctgcggaagggatggttacaggaagagaggtggcgtgatctgtggacactgaggaagcgtcggtgacaggaagaggggtggcgtgtcctgtggatgctgaggaagtgtcggtgacaagaagaggggtggcgtgacctgtggatgctgaggaagggctagtgacaggaagaggcgtggtgtcacctgtggatactgaggaaaggctggtgacaggaagaggggtggcctgacctgtggatgctgaggaagcatcagtgacatgaagaggggtggtgtgacctgtggatactgaggaagtgtcggtgacaggaagagaggtggcgtgacctgtggatgctgaggaagtgtcggtgacaggaagaggggtggtgtgacctgtggatactgaggaagtgtcggtgacaggaagagaggtggcgtgacctgtggatgctgaggaagtgtcagtgacaggaagaggggtggtgtcacctgtggatgctgaggaaaggctggtgacaggaagaggggtgacgtgacctgtggatgctgaggaagtgtcagtgacaggaagaggggtgctgtcacctgtggatgctgaggaaaagctggtgacaggaagaggggtgacgtgacctgtggattctgaggaagtgtcggtgacaggaagaggggtggtgtgacctgtggatactgaggaagggctggtgacaggaagaggggtggcgtgacctgtggatactgaggaagcatcggtgacatgaagaggggtggtgtgacctgtggatgccgaggaagcgtaggtgacaggaagaggggtggcgttgctgatgagggccgtggtgaaggttttaccagaccctgaaggtgacagagtgtgggtctcggtttgtggagatgtaagcccagtggatgtgatcgatggaggtgtgggtgggactgttgagaaggtgtcggttgcctgggacgccaggctgatagtgtcagaccctctgctggttcttgtcctctgagtctgggccatccgggaaatggcggctgtctcctgaggagaggcactgggagaagttgggcttgactgtcctgtcggtctccctgcagtggaggcctcagagagggtgggatgaaaggtgccggggacgatcgaagacgccattcctgtgcttactgggatggcaccatgactggctgaggcggacagcaattcggttgttgactgggttgtgtgactgtccctggaggggtttgatgaaaaccttgtcgtctctcctgaggtggatattccttcgcttcctgaaggtgttgtgccactcgccccggatgaggaaggggtagctgtgcccgctgaggtggttcgtgaccctgaggaggccggttcgctggtctgtgtttgtccagaggcctctgtgctctcagcctggtgggtatgggtcatggctgctgctgtgtcaggtgaggtgctggcagaggctgatgtccattgtccttctgggccccctggtgttgacactacagagttggccagagtaagggcacctgttttggaaagtgacgtgcctcctgagggccccagggtggcatcatggctgctgggtgctgcctgcagtgctgtggtcggggcctgggttgtgtgaccatccccggtgggagctggggcaaaggttgttgctgcacttatggtgggtgcgtcctgaggaacaatttctgagggcgagtgcccactggctgtgaaggaagaacctggggtggtgactgtcttggtgtcagtcatgggggagacggacctcgtggtttgtgattcttgtgtggtctgcggggcttgagtgtgacccctttgggaaacagctggtgattcctgaggagaggtgcttgtggaatgtattgttgaatgatttgttgatggtgccgttgtaatttgttgggatgtgtgtctatccagcataggtgaagaagatggggatgtggccgtttttatcatctgagtcacactgtagcttgggctgctgagaagagcctctccagtggtccccgtttcttgtgtccattgtgtctgggcgcctgcccctgttgtttttgggagagttgtgctgtgggaggagtatgtggtgggctctcctggttcccctattgctgagaccttagaggggacccttggaatagtgccagctgtccctgtagatggatttcctgtgacaagcctagtggcagcacctgttgatgttgagggcagttctgtttgtgaccaagttgtgtggcctttgctggagaatgaggaaggccatgttgttgtttcatgtagagtaaatatttcttgagacacacctggagagaatgagctcctctcatgaggccgtcctgtggtctctgcaccttcactctgctgggtgtggaaagctgtggatatttttggaggtagagaactgggggagagtgctgttgacagagtgtctgaccaccatatggttgaaactttggaagtgattgcagaaatggttccacttacagatagtgatgtctcctctgtgtttccaagagtagagtctctggaggttggcattctgaacacctttgatgttaccaggaatgtattgctgacactggaaggggatgaggtggttgtttcaccagaagggaatgtctcctgagaaactgttccacttgggttgaatccacttggtgaggataaaacagttgatgttgtaaccggtgtgagggtgttgagggtgttgatttgagatactctggtggtctccacgctctgagtctggtggttcttagaaaaagctgttgtgtcctgagtagaagtccttgagaaagttgctggtgattgtccttctggatcaaatgttactaaggctgctgaggtgactggcataagacttccagtaacaggtactgatgatgtctcccctgggtttccaagagtggagcctgtggaggttgtcactgttatcttctctgatgtcatcatggatgtgtttgtgacactacagagggatgaggtagctgtttcacctgaaggagatgtcttctgagaaacagtccctgtcacattgtgtacacttggagagaaagaaggagttgaagtggttctgtgtgttagggtgctggtttgagattccctggtggtctgcgtgctccgagtccagtggttctgagaagaagctgatgtgtcttggatagaggtcctccaggaagttgttcgtgattgtccttcctgtccagctgttattgagactgctgaggtcactggggtagaactttcagttcctgctgttgatgtctcttctgtgtttccaagagtggagtctgtggaggttgtcattgttatagtctttgatgtcatcatgagtgtgttggtgacactggagggaaatgatgtggtcatttcatctggaggagctgtctccatcacattgtgtacacttggggaagaaaaaagagttgatgtcatcatctgcgtgagggtgtcggtttgagctttgctggtggtctccgtgctcttagtctggtggttctgagatgaagctgatatgtcctgattagaggtccttgaagaagctgcagttgattgtccctctagtgtcgctgttgttgagcctgttgaggtgactggggcagcagttttacttccagttattaatgtgtcctctgtggttcctggagtgaaccaaaataggcaagcagagagctaaatcatgaatgaactcctattcacaattgctacaaatagaataaaatacctaggaatacagctaacaaaggatgtgaaaactaccattcttcacagaatgagaacaaactactttaaaattcatatggaatcaaaaaagaacccaaatagccaagacaatcctaagcaaaaagaacaaagtgggaggctacctgacttcaaactatactacaaggctacagtaaccaaaacagcatggtactggtaccaaaactgacatataaaccaatggaacagaatagataccttggaaataagaccacacatctacaaccatctgatctttgacaaacctgacaaaagcaggcaatggggaaaggattctctattcaataaatggtgctgggaaaactggttagccatatgcagaaaactgaaactggaccccttccttacaccttatacaaaaattaactcaaggcaggttaaagacttacatgtaaaaccccaaaccatgaaaaccctagaagaaaacctaggcaataccattcaggacatagacataggcaaagattttatgatgaaatctccaaaagcacttgcaacaaaagctaaaattgacaaatgggatctaattaaactaaagagctctgcacagcaaaagaaactatcatcagagcaaacaggcaacctacaaaatgagaaaatttttgcaatctaaccatctgacagaggtctaatatccagaatttacaaggaacttaaatttacaagaaaaaaataaacaaccccatcaaaaagcaggcaaaggatatgaacagacacttatcaaaagaagacatttatgccaccaacaaacatatgaaaaaaggctcatcatcatggatcattagagaaatgcaaatcaaaactacaaagggatatcatctcacaccagtcagaatggcaattattaaaaagtcaagaaacagcagatgctggcaaggctgtggtgaaataggaacgcttttacactgttggtgggagtgtaaatcagttcaaccattgtggaagacagtgtggcgattcctcaaggatctagaaccagaaataccatttgacccagcaatcccattactgggtatatgcccaaaggaatagaaatcattctgttataaagatacatgcacacgtatgtttactgcagcactatttacaatagtaaagacatgaaaccaacccaaatgtccatcagtgatagactggataaagaaaatgtggtacatatgcagcacggaatactatgcagccatgaaaaaggaatgggatcacgtcctttgcaggtacatggatgaagctgaaagccatcatcctcaacaaactaacaggggaacagaaaaccaaacactgcatgttttcactcataagttggagttgaacaatgagaacacatggacacagagaggggaacaacacacactggcgcctgtcagggacgggacaaggggaggaagagcgtcaggataaatagctaatacatgcaggtgatgggttgataggtgcagtaaaccaccatggcacatatatacctgtgtaacaaacctgcacgttctgcacatgtatcctgaaacttaaagtaaaaaatgaaaagaaataaaaagaaaaaatgaaaaattaatatatcacaactgtacatatttgggggataaaaaaataataagagatggggccgggcatggtagccccacctgcaatcccagcactttgggaggctgagatgggtggatcacttgaggtcaggagtgcgagaccagcctgggcaatatggcaaaaccccgtctctactagaaaaaaaaatacagaaatagctgggcgtggtggtgggtgcctgtaatcccagttactcaaaaggctgaggcaggagaattgcttgaacccaggaggtggaggttgcagtgagcagacatcatgccacttcactgcagcctgggcgacagagcaagattctgtctcaaaaaaaaaaataaataaataaaataaaaaaggagagagagatgggggtgcaggattcccacagaggaaggcccctgataagcactgcttcaaatcgcctagaaaaagcacagttgcaggaatatagccaatggtcttctccagctcccgcctgtcttccttgtgaggaggaaggtgaggttagactagaatggtgaattaactgtgttaaactccatgggaagaagcaaacagtacccctgctataagccgggttaactctctcaacttgaattatagcattatctttcttaaaaataaattaaatttctacttttctttttcgttgttaacatctgtgccaatctggtaaaaaacccaaggggtaaatgcatatactcttgccctggtcacagactaccaagaagctaatattattgaccataaccactttttaaaaaaaaattatttcccaggcagaggccaggcatggtggctcatgtctgtaatcccagcattttgggaggccaaggtgggaggatcactcgaggccaggagtttgagaccagcctgggcaagatagcgagaccctgtgtcttaaaaaataaaaataataataataataataaaaatagatattaaataaataaagaaaaatatttcccaggcagaatgtttaaatattggctttttttgtttaaaatatttcacagcacctgcactagccacataccatcttcgtgaatattaccttagcctctgagtctctgaaccaagaagaaaccaagaaaacttgcctttttttttctcttagaaactgactcttttgggttttcattagttccctagctgttctcaaacttctttcttttttctttttaaacatatatatatagagagagagagagagagaagaaagagagagagagagaaagaaagagagagagagaaagagagacagggtcttctgtcacccaggctgaagttcagcggtgtaattggccttctgagtagctgggactacaggcacacacaaccatgcctgggtaatttttttatttctgtagaggtggaatcttgctatgttgcctaggctggtgtcgaactcccggcctcaagcgatcctcctgcttcagactctcaaagtactgggattaaaggtgtgagccaccgctcccaccctttttttcaacctcagtgctcctagatagttggcaagatgatactcagagagacaaagtctcagggaagaattcagcttcaagtccactttctggaattgactgtaattcgccaccttctcttcttcagacagtaacttagactctcaagtgagtgataatggttatgaaccagctctaattgttaaaaaagtgactcacgtgcaagcttctgcacttcattaatagtaactgcttactggtgacacacttgtaaaccgacgtggacaaaggcacgggctgaaccgcagagccctctgggaggtccctgggcccctggcttaatccaaaatgactccacttcaactttaaacggaaacttcctttagttggaattaggttgagatttgttgataggactctaaactcgatgcctgctttctcctagagaaaatttgcaaaacttggtttctccaaataaggtttaaatttaaaaacattctctatgcagttatttttaaccttatttcatttccctgataacataattaagagcatttgtctatcatcaggctttgagtagacaggagctatctaggggccaaactttctgaatgtgtaaattcttggcaattaacatcttttcagagcctgcatcacctctgctaaaatcagtgtcagcagcagaagtttcatgacagcaccgtccttttttttaaagtaaagatttttgtagttctttataaaagtggcacagctccatttcagcaatatggaagaagagataagcctctaatagcaaaaccagccaatgccagataaatacaggttataaatgtaataaatgttttctaatgcagaggtgagatgagaagaaagaaagggaaacactcaggagtgaagaagttaacaactaagatggtgagtcaatgcccttggaaatgtgctgactgaaaggctgaaaaaggaaaggaagcaagaccctcggtcacgacactgaactgagtttccctgcaaaaagctggaaccgccagcaaaaaaggtagactagaaagaccaggaagaaaaaagaaaaaggaagcagaatgaaggatatagtaacagaccagaactcactatagaaacaattaaaaatggaataaatgaagccaaagattagttctttgaaaataaaacaaatacctggcaagagaaagaaagtgggggaggggggtgggaggagggagagagagagacagaaaagacacagatatcaagattattagaaacaaaaaagggtacataacttcagaaaaaaaatttaagagacagtgctctgatgaatttataccaaaaagtatgaaaacttagataaattggatatactgtccttaaaaatataatttatcaaaaatgaattaagaaaaaaacctggctaaaaactattttattttatttatttaattttatttatttatttttttgaaacagagtcttgctttgttgcccaggctggagtgcaatggcatgatctcagctcactgcaacctctgcctcccaggttcaagattctcctgcttcagcctcccaagtagctgggattacaggcgcatgccaccacgcccggctaatttttgtatttttagtagagactgggtttcaccatgtcgtcctggctggtctcaaactcctgacctcaggtgatctacccacctcggcatcccaaagtgctgggattacaggcatgagccacctcgcccggccactataaactattttaaattgaatcagcagtttaaaaaatataatctaggccgggtgcggtggctcacgcctgtaatcctaacacgttgggagggtgaggcaggcggatcatgaggtcaggagattgagaccatcctggctaacacggtgaaaaaaaaattagctgggcatggtggcaggcgcctgtagtcccagctactctggaggctgaggcaggagaacggcgtgaacctgggaggcagaggttgcagtgagcggagatcatgccattgcactccagcctgggtgacaaggtgagactccgtctcaaaaaaaaatatgtatatataatctatccaccccacaaaaaaatgcaggctaagatgagtttacaggcaaatcagacattcaaggaacaggtaatttcaattctatacaaacatattcagagtttggaacaggaggaaatgatctactaataattttataaggttggaaaccaaagataggataagaaagacaaactatagattaataagtcccagtaataatacatggaagcatcgtaaataaaatattagcaagccaaagtgcatcatggccgggcgcggcggctcacgcctgtaaccccaacactttggcaggccgaggcaggcggatcacttgaggccgggagttccagaccagcctggccaacctagagaaaccccgtctctggtaaaaatacaaaaaatttgtatttttttggattacaggtgtgtgctgggcttggtggcacacacctgtaatcccagctactcaggaggctgaggcacgagaattgcttgaacccaggaggcagagattgcagtgagccgagattgtgccactgcactccagcctggtgacagagcaggactctatcttaaataaataaataaataaataaatattttaaaagtacatcatgatcaagctgagtttaaatcagaaatgcaagataaagacaatgctttcttaatgtaaatcaccatataaacagaacggaggggagacacaatcaccacagcagatacaggaaagttatttgataaaagtcaacacttactcctgttaaaactcctagcaaactaaaaagagacgttaactcttttaacctgataaacaatgtcaattataaccccgtgtaaacattatacttaaaacaatagaaacgtttctgtaaaatcaggaataaaaacaagatgccaacaatcactgcttctaatcaacattaggttgaaggttttagctggtgaaataagacgagaaaattaaacaaaaagtatgagagtacagaaatgtgattttgggtatggaagggatgaaacaagcctatggttatttgcagataacataattgtttacatagaaacttcccaaacatatacattattagcaaagttctatatccataatcaaaattttaaaaataattgcattccagctgggtgtggtgattcatgcctgaatcccagtgctttgagaggctgaggcaggaggaacacttgaggccaggagttcaagaccagcctgggtaacatagcaagatcctgtctctacagaaataaaaaataaaaaaataaaaaattagctgggcatagtagcacacacatatagttccagctactcagaagttgaggggggaggatcacttgagcccaagagttcgaggctgcagtgagctatgatcaccccactgtactccagcctgcatgacagagggagactctgtctcaaaaagagatttaaaaacaaaataaaactgcattcctatatatcagtgaaagagaaaatatttttaagactatagtgtttatgatggtgaccaaaaaaagtacataaaaataaatctaacaaaagatgtgcttaatctttatggacaaaattgtacaactgcattgaaatatgccaaagaaaacacacatactggttacgtgcatttgggaacatttatagttgaaagatcaaaacccataatcttgctaccagacaatgcttccttccaggatgtttttatgctttaaaaaatatatagtttaggccaggcgtggtggctcacacctgtaatcccagcgctttgtgaggctgaggtgggcggatcatgaggtcaggagatcgagaccatcctggctaacagggtgaacccccgtctctactaaaaatacaaaaaaattagccgggcgtggtggcgggcgcctgtagtcccagctactcgggaggctgaggcaggagaatggcgtgaacccgggaggcggagcttgcagtgagccgagattgcaccactgcactcctgcctgggtgacagagtgagactccgtctcaaaaaaaaaattaaaaattaaaaaatatatatgtatagtttaacttattcagtatacataattttgtatcctgcctttttagccatacctgatatgagcatttcttcaagatactagcttcgtaaacatagcctgagaagacgcacatcttttatgtcttggatggcagttccttgcttcccccttttggagtcctacaagagctggctcagggggactgggagagctcagctccatagtaaaatctagggtgctgtataaaaactccccctgctgagctctggtggcctccttcctaacaaagccactcccccaactggaagcgttgttacccttcccattttctgttaaacaggagcaggtctctctcctgtaccacatcctgctgtgtgtccaccatacccacctctctgtgcaatgagagctcgggggtcatgtggactccactgctccctgctcgcaatttctccttaatacatcttactttatgcccgttctgtgtgttgctagtatgtatgtgtgacactgtgtgtgtgtgtgtgtgtgtgtgtgtgtgtgacactgtgtgtgtgtgtccctgcccttatggaacattggacatagcctttaaacatttttttttccagatggagtttcactcttgttgcccaggctggagtgcaacggcacgatttcggcccactgcaacctccacctccgtgattctcctgcttcagcctcccaagtagctgggattacaggcatgtgccaccatgccaggctaattttttgtatttttagtggagactgggtttcaccatgttggccaggctggtctcaaactcttgacctcaggtgatccactcacctcagcctcccaaagtgctgggattacaggcgtgagccaccgcgcccggcctaaacactaaataataagccatcatagagaaagctcatattgttaacttactgttggacaattaggatatttccaatgtattgcttattttaaataaagccctgatgactatcttcgtgtctaatgttttgtttacattatttcagctcatctccttaacataaatttctatcagtggaattgctggtttatgccgttataaaatttttcatgttattaatacagactgccaaatttctttgcagaaagcttatgccaatttacagacctgttggcagtgtgcaagagtgtgcctgtttccccatatccctagcctgtgaacaaaggggcatgatccaggacaggccccatccctcacctgctgctctttgcttcacagcatcgactgaaaatcggccaggtgcggtgcctcacacctgtaatcccagcactttgggaggtcgaagcgggtggatcatttgaggtcaggagttcaagaccagcctggccaacatgatgaaaccccatctctactaaaaatacaaaaattacccaggcatggtggcgtgcacctgtaatcccagctactcaggaggctgaggcaggagaatctctcaaacctgggaggtggaggttgcagtgagccgagatcgcgccactgcactccagcctgggcgacagagcgggactccatctcaaaaaaaaaaaaaattcttgctaaacagggctgtgtcctggtagtcctccttttaaatctttatttagagaacttgctcatcttgagccaagttgattagagtttcctgctgccgcaaataggagggcaagtgagtcactgcatgtggaggacatagttttattgtctaggggagaaggcgctgtcaaaatctctcaatctgttgggcttgtgaggaggaagagattagcattcgttacgacaaaactacagttattgcatttgtctttcaccatcatttaaacaatacctctgaagccactcctgcaatagattgattattcagctgtttaggaaaacaatttgcagataactcaatctactaagcttgagtaggttatttgtaggtaagaaatcctgtgttcaagtatgacctatctttacaaagaagaaaaagaaagaaatcctagtggatggagagactatggagaatgatttttggtaagaaaatggttctcagctgggcatggtagctcatgcctaaaatcccagcacggacaggcagaggcgggaggattccttgaggccaggagtttgagaccagcctgggcaatagctcaagaccccttctctgaaaaaaaaaaaaaaaaaaaaagtggttctcaaaaggcagagggtgcatcagcattttaacacatgtccagagtgattctgatgcaggtggtccgtggaccccacgttcagaaacacttcccttaaaataaaatgatagtatccactcttaacaatgtttgtaagccaaaaccatctcgctgaagttgtcaggcagagaaatttgaagccttgatcaagttttattctaaaaaatactcatagccttgttcttgctgctcaagtgttggccagaatgaactgaccttggctctcaccaggatgcaagtcaggcccttcaggttccgtcagattgtcagacaactgaaacttgttctcactctggccaaacgcataaacttggggagcagagagctgggagatttgcgcctaaagagttgatattggagagaaacaggtctctcctctctcttctctccccgtgaccctccattttctacttcactgaaagaaccaaagccgtgcccttcatctccttcaatgcccagagccttctccgcaccctccccggggccccggggctccctcctgcccggatggctcactgctctgcctctgtgtctccgacgttctttctgcctttctccttctctcctgcctgtgagcatgttcaggtgtctgttggcctaaaacaagtctgtcatccgtctgtgtcctcctcgtccctccagcagcatgaaagccgggcttcccctgccgcctcttctttaccacgcactgctcgctctgcccccacctcactcacttcgctcaagccgttttcctcagagctaccagaatctccttcccaacagcaaaaacgattttctccagtcctcacgcgtctcatcagttcggccccatccattcattcattcatgaatctgacagatgtgtattgcgcccccccctccacgtgctctccctggccggcggccccgtgccaccacccagcctcaccctcattgaagctgacgggtcctgctccaccgtccacgctcccgggccctccactccactccccttgccacctctctcccccgctccacgcccagatgacatgtctccagccctttccctctcctgctgcccctccctctctggccaccctgcgtctactctcacgccttacaaatctgtacttctccctgacttcccacccatatgctggcctcaccctcccagggatttcctgcctagctcatgcaatgcaacaggtccaggtcaatctttccttgcaagctttcttccttccttctgttcatgctaacaacagtcccccagacatccagcccagaaagctgtgggtcctctggatttctttctcttccttgtcccctgtgtcctagtcagtactcgttgatcttcctcccaagtgttcaccccatcgcgtcctcttgtttgctttgccacatcctccccgtcgctttgactactgcggcagcctcctcactgcccctgctgactcgggttccgcacccctgctctcagcctccaccgcacccctgtgggttgatcctcagctctgagggccaggagggagggttgctgctgctgtctccttagctcgaattgctttggaaaatggcctgccctgcctgccctggaaggtgtctggtaggtcctggggtcacagactggtgactggcattggtcctgggtgtctgcgtaggtcccgggggcgtgggtctagtggtcagagactggtgactggcattgccattgtgacacggatgtcagaaaccagaatcctcagagggaggccactgggcaagaatgaccttcgtctggttgtgactgaggaaagatacttccagcgcgtctgtgtgcgtggcagggtggcttctgtaataagaaatggccacgccaagggatttctcgtttctgcgggagacattgttcagttttgtagccggcagcttaaattcaaaatgcattttaaacatgttttcccctttctcttgggtttccaaatacaaccttgaggcagctgcaaaggccgttttcctcagcctaaaaatagacttcacgcccctcccttttctcacgatctgtacacactccctccctcttctcaccgtctgtacacactccctcccttttcttgtcatctgtatacactccctcccttttcttactgtctgtatatactcccttccatttctctgcgtgcgaggatcgaattatatgtcttcctaaaagttgcaggggctaaaaccttgagagagacaaaccacatctgaaaatccagctgcaaaatcccagaaattacttcaagacagctcttgttaaaataatgtcagccagaggtccggacggactgggacccagaagagccaccagaacaagacatgcggacacaggactcagcccgattcttgcgtgccttccttatcaaggctttcccctctgaaaattaaagcagctactttaagtagaaatctggctgcttcccctttactagttttggttaataaattcacgttcttcctaccagaccttatgaattaaactatccgtttaatataatataaactctctgcaagcagcgagagcctccgcatctgcgctgggtcgagtgactgagggtcagctgacttgtgatgaacacaccagggaggtggggcttctttttacttctctcgtaggcacgttatgactctatgaataatacaaatgttcacagctcatgttcatgtggtgctttatagcttatcttgttaatagcggccccatttcacaggcggggaaatcgagattcagcggccccatttcacaggcagggaaattgagatttgaagagaccgagtgatattatatgccttggaagtagcagggccgggggctcggggtaagagccattgctcggaagctgcgagctgctcagctctgggactgccaccgagtggatggagagctgaggcaaagatggagaaatggtcactgacctgccccaagttcttggactgccacatgcagagggctctgagcctgaggccgagccaggcacattctcggggtggacgctgtgacactggggtgtttttgcaatgttcctggtgtctcttttctgggatgatgttagagtgagtgtgaaggctgttgacaccttaaggtgacaagatcactgtgagaagacacacgtgtgtcattgagtaaaacggatagtttttaagacattctctcagaggaagagtctccatccagggacgaggagggcactggcgttggcactgaggtagagacgttccccacatctgagtccttgaaggctctgtcaagcctctgccatcacgtcagccagagatctcccatcaaggtagttcttttctctccttgaaccacgtcaggtgggagacggcccacagctgcctcacgtctgttagggctccaggatgtgaaggccgagtggcagtaggcatcgttttccccagatggcccctctggtgactccacaggtgtgccgaggtgacaggtgtgctgttggctcgggagaaggagtggcagcagtatgagtgacgctggcagaagacagattccaagaagggtgaagccactccctgaagacacacaaagcctgcggctttctaagtgctgtgggttgaggcttattcctagcatctggtctgtttgtcttgggtttttcctggaactggaggtgaggaacccgtaagccgtatcgccacagtgtttcactttcctggaggggaattacttcctgacgggtggggccccttgccaggctgcctcgggcagggcagtgtaagcccaagggaagtgcccaacggtaaggatggccttgaggagaacattcagccccacacaggcagcaggcggcccggaaggcgcgcagacgctgaaccgctggccccaccgcctttggcagggagctaatgctatttgtgtatcagcccagaatcaactgtgaccagggttgtgtccactgggtacttccctagaattcaagatgaggaaagacactaactcaagatacccttggaataacagacctcttgtgatctccagcgcctgaaacgagacttggcatacagcagtgacttcgtacacatctgtggaatacatcccaggccctgtggcctttgttgccttcagccgaggctggagagagggtgacgttgcctgtttctttatctttatcttttttttttttgagatggagtctcgctctgtcgcccaggcaggagtgcagtggtgcgatctcagctcactgtaacctccacctcccaggttcaagtcccttcacagtggactccaaggcgagaactttacccgttctttccaacgatccccgccgaagtcacaccccaacccatggatcccaccaccggtcatttgacctcatttctgtcagcatctggtgtggcagcacccagccactctggtgatcgccacagaagctccagcaccaaaccaagaagcaccaaaatccggctgtgagcacagcacgccggccagctcaactctcttttccccaacgcctccttctcggaggtgccatctccagtctccaccatcttggtgttgccacccatctctcctggctcccactggggcaggcacatcctcctagcctagcgctgtcctcaggagcctggctgcctctccacagtggttagcctcgggctgtcctggtgtggtggtgtgtgcctgtgatcccagttggaatcaagtgcttctcctgcctcagcctcctgagtagctgggattacaggtgcccaccaccatctcctgctaatttttgtatttttagtagagacggggttttgccatgttggccagtctggtctcaaactcctgacctcaagtgatctgcccgcttcagcttcccagagtgctgggatgacagccatgagtcactgtgcctggccttgtctgtcatttcaattactcaaaatccataatctgggccgggcgcagtggctcacactggtaatcccagcactttgggaggccaaggtaagcagatcacttgaggtcaggagttcgagactagcctgaccaacatggcaaaaccccatttctactaaaaatacaaaaatcagcagagcatggtggcatgtgcctgtgatcccagctactcggggggctgaggcacgagaatcccttgaaccctggaggcagaggttgcagtgagccgagataacgccacagcacttcagcctgggtgacacagtgagactctgtctcaaaaatataaataaataaaataacataaaattcataatctattccacagcttgcaaagccctgcgcgatctaacacctgccttctctttcaagtcctccaaggggccaagctctttcctgcctctccatgagctccgcctctgcctgctcaggcctggcaccttctccacctggctgtcctcagcctcaggcctcagctccccgcagaacggttcctcacagggcccttcctgacttgtcagtcagatgcacctcccctactctctggccattcgaaatgcagctctcagcacaccctgtacttttccacactgcatttaccacatgtgcagttgagaacatttccgtaattatttgatgtctgtctgcaccaagattttagtgccaagagactgggccacgtctgtttcactcttcactgtgtgcatccagtgctgtgtcctagaacaatgtcaggaacttaaggcaggcgtttcctaaatggtggtttaattaacaaatgaatgaatgaatggctgtctcagcagggtgtgtgaatgcttctgttcttccctccgtcggtgggctgggctggtttggagattgccgaaaggctgtgtgctgcagtgagtcaggagacctgggttctagtcccagctgcctcacttatgggttctatgatcttaaacaagtcacttaacttagagagctttgaaaagcaggaactgtgacgcattcatcttcctgtccagagcagctggcatgagtagaaattctgcaagtgaatgaacaactccaaagtctaggctgtttcttattccaaattcccccaaaatccactggccactggacttttggaacctaaactgcaacctgggcggggcggcatctctacagagagtcgatgtctgtcctctgtggtccctaaacacatacacggggagtggagctgcgggcaacccaggccagtgcccttcctccaagcagggccgccattgcaaggcctcacgtgcaacacaaatgcccagttcctgagacttcttcagagtctccaggaaaagggtgaaaaggcatttaaacctctatgaagtagggccaggcacagtagctcacgcctataatcccagcactttgggagccgaggcgagcggatcacctgaggtcaggagttcgagaccagcctggccaacatggtgaaaccccatctctactaaaaatacaaacattagccgctgtggtgttgggcgtctataatcccagctactcgggaggctgaggcaggagaatctcttgaacccgggaggcagaggctgcactgagctgagaccacgccactgcactgcagcctgggggacagagagaaactctgtctcaaaaaacaaacaaacaaacccaaaaaaccaacaacaacagcaacaataaaaaaaccgtctatgaagaaatcgtcgatgaggtgccaacagactcagttattttgactcaatttctcagaacatgctggggcgggaactcagcctagcagtaagaaagacgtatatttaaggtaaaaggctgaaactagggggagagagagcctataaggtctctgtcctggccttcagagaagtggctctgtgagctacacgatgtgcatattttaagcacttaacagcaccgtgaaatcagagaaaagacacagagtagcaaaaccacccgttgagcgtacaaaaggccaaccacttcttgtcctctcattgcctcttgtccttagcaatgaagacacaaatcacttgcgtgtcaagcactgccaggccagcctctgccaggccagcctctgcctccacggctgagcccagaaaccaagggcgtggcgggactcacaggcagggagcggtgaggcagagctgtccgctggagcgagcccctgctctagggccatggccctcggggtccgttcatgcagcaagccacattctgaatacaccaagccagcccttgcaaacccacaggaagcacggggtggctttttagaggcacgaggatccttagatgaagggatatgaccctgggccgacacaagtgccattccgggttcaatcaccctccttcccccgtcttcccaggcctctttctcaaacacgtctttatggcttttcttttttttttagacagagtcttgctctgtcacccaagctagagtgctgccatttcggctccctgcaacctctgcctcccaggttcaagccattctcctacctcagcctcccgagtagctggaattacaggcgctcgccaccacgcccggcaaaattttttatttttagtggagacagggttggccaagctggtcttgaactcctgacctcaggtgatccacccgcctgggcctccaaaagtgctgggattacagcgtgagccaccgcgcccggccctttatgccttttctactttacaccagatgctgtctcgtttcatcctcatgacaaccctacgtagtagccccttccccctgggctcagtttgccgatgaagagcctaagactccagagccaaaaggcgttgcctgtgttccctgggctgccaagggcgtcgctgatgctggacctctgagtttcagcccctgctcttccctgtgcaccttgctggtcgttggccaaaatttggctgatgttcctggcaggacctcttgtccagggatcctttccttttgagtgtcctggagcacagtggggtttcccagaggggcagaggggtctgtggagagttttggtgtcctcggtggcaagttgaggtggcctgtcccagactgacagatagaccgggggttctccgaggaggggcccataaagacccttccccgtggagtgcgctgtggccggcgtcccctcccctgcctgccctgcacttgctccagcctgtcacctccctggggtcactgatagtgctggagaccaaggcctatttcgacccagttgcctttccctgtggcatggaaccaggacggccaggcttccttctgagtcattcctgcctggggcgaccagtagacaccaaatttccatctgtccttgtctagcccacctctgtctgctgtgccttatcctttaacccttgagagccagggctgttccttaaggaaaccctcattgcggcagctcctttgtggaaaccctgtgtttttcctctggcctgggcttcagtgtgacccagcctgggtgagggtcctgccggcaagtgtgcaaacagaccctagactcaagtataggcaggtcatctgtaaaccccttcagggagccaaaaggaacggggctggctggctgccagtcctccagcagctgccctgtgggggtgggggctgcccacccgcccttggtgactgcttttcctgccaaggccctggtcatgcccggtcagatgtgtgggtgccatctcccagccacgaccatctcctctcctggcccagctccacttggtccccttagcgacgcaaaggactcagcgctccacgacatgcctagcttcttcgggtcgtcatggagacgcccttgcacaccaacagtccttcactccttctccgggtcacgcccccgtgcttttccacgcccaccccaggtcttgcccctctgcgctcctctccacagaccccacttcctggctccacatggagctgagtgtccagctggtacccagcacatttgggctcagctttaaatcacagatttggaaactcaagaacttgggcgtcaggaggtccaaccgttcaccactgctttttacacaggggaccggggccctggggagacacggggcagggcctggtcacaggggccagaacagttcacggcaaagacttggccctggggctcctaaatccaagctgcctccccggcgccccaagccccagcctcgctctgggagtcatgattcccgtggagactccttcaaccacatctgcagggcagggccgtgtggcggctccttccggcctccacgtcctcacggtgggatgagcactggagcggggttgtgtggccagggtggggtgggggtgctggagggtggggaggtgtagggaggtggtggcagtttcctttgccctcagcctagtcctgaaacatcccgaggtggaagggtccgcttcaccagcatggcttctcttgcagcctttaaacggcactcgccttctgactcactcccaggaagctcctcaaatatgcgcccaagaaatattttccctcggcgactgttcttagcctgctgagaggcagggcaggagctgagactctaaccccagcttgaactctggaccccagactctcccccaaagactcagacacccagaaacacagaataaaacttggtcctgaagccagagggacagcctggaaagtgtggggaagaggacgggggcccccgagggaacatctcccacaggcctggcatccctcccctcccagctctgtacacggaggagcccaaggccaatgccggggctacgagccccaggcaaggccgtgacccaaatggaggcttttaaacccgagctcagaggtaagaagcccacggccagcacctcccggccctctgcgccctggccgcctcctccgcaccaccctcccggccggcctgcccctctcctccttgtcgcttcccttgcttgctgctgtctcccgatcttctcctctctccattcccagggtcctcagtttgtctgcgtctcacctgtctcgtcctctcaccctgcagctttacatgagttttcttccgtctccatcacccagctttcctggcatcccctctacccccagctctgtacacaagggtgtacatctttctccttgactctgttcctcttgctctggctctgcctgtctttctctctgcgagtaagcctgggctctcaccatggatccttccagacatcgccgggctgctctctggccctctgttctcttttctctctctttcgagcattctccctctgtctttcccctcagatcttgtcccgtatctgccagttcatgcctcctcttccccacttttctcctcttcttattttttattttattttatatttatttatttatttatttatttatttatttatttatttattttgagacagagtctcgctctctctcccaggctggagtgcagtggcgcgatcttggctcactgcaacctccacctcccaggttcaagtgattctcctgcctcagactcctgagtagctggaattacaggtggggcccaccacgaccggctaatttttgtatatttagtagagacggggtttcaccatgtcggccaggctggtctcgaactcctgacctcaggtgatctcctgccttggcctccgaaagtgctgggattacaggcatgagccaccgcgcacggcctccactcttctttctctctccctcttctcttcctcttctttccctctctgggtctctctccaccttccccccatgttgtcccattcatctctttctcctttccctctccctctttttctctcccttctcttcctcttcgctgtctccctttcccctattctctctctctctctctctgtctccccggacctctttctctgacagctcccacctcccccaagtgctccccgcagccagcctcatctgctgtctccatcacttacctgggaccacatgcggaaggaggcagagacacaggcagctcagggacacccaggggaccctcctccagcgtgcccccttcatggctgcggcaaaagtccccctggctccctggggaagctccacggcccagcagctgcagtgtgaggagcagacgtgagcccgtcccctcaggcggctggcccgaaccaagtgcgtttctccgaaggggccagggaacctgggaagaggacaaaagag

SEQ ID NO: 98 - DNA, 63933 bp, Homo sapiens; identical to SEQ ID NO: 97

SEQ ID NO: 99 - DNA, 63933 bp, Homo sapiens; identical to SEQ ID NO: 97

SEQ ID NO: 100 - DNA, 5191 bp, Homo sapiens
ttaatgaccttctccttttatttctctgtttcacaacaccagttcagctttattgttaagttcttacattctccaagaaaatacctattgcaaatcacagcaagatggaagatttcccaaaatgttttacaaaatggcaaacacttgcacttgaaatggataagcaaaacaacatgtgtggtcagtatcatccatacacttagatgttgaagctaactaaaacttttattacaggaacaatatttgaaaattaccaaaaggaaacaaaaagaaatctccaagtcacccgatggaagagaaacctaaaggcagtatacaatgtgttcccttccattcactgtgccttctactactgagaacactgacttctctcatcaaacacagagggaagaatgggcctgatttcacacaggacagggaaactgctgggtgtggccctgaagcatgcattggcccatttccctgcccgctggccctggttgcatctcatgctcagactccctctccctcctctctcaaagcatcttcatacagggatgggtaagaagtgggatccctcccattggcattggctatgtactcaagaactttcatcttgctggtctcagcgtgggcccttggaccccacaggaactcatagcatgcaggatcagtgccgggcacctgccggtacaccaggtacttttcctgcacccaattttgggtgaggagcctcttgggctccccaaagaggaagtgctcccttccagcatacacccccataatgctcaggacttcccacataacctcttcagggatgcagttcccctccatgaagattacacccaggactattatcaggaggccagacttgggcatgctctgctcattacactgtatgccatcataagagaggttgagggaggtgacaaggacataggagtggctagtggggtccacttccttcacatcaatgccaaagagcagttgcatgcatacagaggcttccctaaatatctcaggaaagtagtcctcataatttttgatgacactccccagcatttctgcctttgtgatcagccccttgactcgatacttgcggagcaataaatgaaccaaatcaattatcttgtcatgtagtatatcttgggaaaaggactcagggtctatcaggtcaggcgaggtacttggcccctccttttcttggctgccagagccctcatcagataggctcccaaagatggcatccatggcagtgggagagaaggactcttcctgaggactctggggaggacttggtgactcagcagcaggcaactcctctagagtgcccacattcagagtagaggagaagaaggcagcctcctgctcctcagcttggagagcctgtgcacccaccaggcccaggtcttcttcttgggcctgaaggccttcctcaggcttgcagtgctgacttctttgctcaagaggcatgatgactctggttaggtcagcaggccgaactgtgggaaatatctgggtgatggggccccacagcctggggagagagggagcgtgagaacagactcagatgagatatgaaccatggagaatctaacaaaagcctacttacacttgttctcctccagtgatcctctgggttctcctgggactcctgtcctccaggttggcctgttctctaaaaacctgaaaaaggaagtgagaaggctgctcaagatgcagctggacatcagagcaggaggctccaggactgaggtagggcaggtgaggttgcaagctgggggtccctttctgtactggggcaggtggggccatttgtagattaagggtgaacatctcatcttgactactggcactgcctaggcttcctgtgttctgagatctgaagacattgcttgagaccaaggcctcactgctcagtttttggagcttctagaagaggaatcatggggccatcaggctgcagactgcaagcacccatcctggcaccccagcactgtcagaaaggtgggccaaactctgtgagtttctcacttttttggagtggatggtcccctctgtgctcagggccctcacctttctcctgccagggcctggaagacacagctctcctgacctgagaaactctcagatcaatagctctttcctgatatgaaagaggacatgtggggatacacatctggccacatgtacacagggctacccaggaaggacagcaagagatggtgacagtcagcagggtccatgtgtcctcgggtaaggagcctgtttggttcccatcttgatgcctatcttggcctgggaccctccctctgttgacctgacgccatctccttaaaccaaagctctacctccaggagacatcagaagaggaaatcagggaaatagaaacacccatggtcccagggacttcccatagctgacagaaggggcagggaagggctgagtcccatgtttttggtaagtgctgtcccgtcagcccccaccttgattctggtcatggcctgggaccctcccactgctgacctaagtgcagccctctcagaccaatgtctcccgctccctgagaccaatgatcccagtataagagaggggtctcagcacatagtcctgcacatgctctctggggagacagcaggggcagagcagatttctaagcagccctctgtgttctggccaggaggaaccctcaatcctccctcaggtttctcacctggactcttggcagatcctgggaccactgtagttgtggaccatatggggctctttctgttgactggaagtcgtcctctgagaacatagtgctcacctgcccaagattccaaaacagaagtaaggggccccacgtcccatcaccccatcatgtggttgtccagggctgacagcagaggctggacccttcggttctggggattccaaagtcctcctgtgggtttttcatctttacttctgccagggcctgtccttccttgactcccaacccctgagatgagcagacatatccctttacaccaagacctcatctccctgaaggtttcccaactttctgcctgtggtacaagtgaccttgccacttggggccacccgtgatgaggtccccatacagccaaggacaggggacagagagactctgtgggatcccttcattatgggatgtgggtatctccagtcctcaccaaggggacacatacaccttgagtcctaaagatcctgggactcctccctctgctgatcaggtgtggctccacctgctgacctgtcatcacccccttgaaacaaggtgctcacctccctgagcaaggtgccacccccaacctcgtggcagaaatgtgagcatggcacatgcctccccaacttgggcctccgagggatgaaaacagaggaagcaaggattggtgaggtccctttttctttggcatgtgggagggtacattcttaccttcagtcttcatcaattttcctctccttgactactggcagatcctggactccaccctgtgctgaccaggtgtgtatccctctgctgacctgaggacctgcctcagaccaagggccccacctctctgagatatgggaggcagaaagtgaaggggcactacatggacacccctcatgggatgccaaaggctgacagatgaagcagatttcaggggtgcctcctctctctgggtttcctccaggtattcagatttactcctgacaaggcctatccatgtctctcctgctgaactgtggatgagttttgcaggccacgaccaccatctcccagagaaccccaactaggaagtggggagctgcctctctttcctagagtcctgcttggggcctccaaggaccgatggcaggggcaggttttctacctcagggataattggttgcctgagtcctccctctgggactcctccctgggttgacctgaggctccactcctcagaccacaacccactccttgctgacaccccaaaggcagagtgaggatgcaccacatgtggccactgtgccttggaactccaagggccaaggtccctactgacctggagtccaaagtctcctgagtcctccctcttcttcttcctcttgatgctggcagggctgcaccccagaccccctctgcggaactgagtctccatccctcagattcccaaggctgaatgaaaaggcacctcagtttgagacggcgggactatgggggggggctgttctggggtgctgggtcccttcagttgtccctcaggccttgctcacctcccagcagggactgagccctgtctgtgctccccctaggtctttctcatgataccaagccccttccctctgtcagcccaggatgcggaaatcaggatccacttgcctggcagcaatgccaggaacttcccaggactgacagcagagagggagccttgctctgtggggcctcagccctccctcggggtcctgaccttgatgcctggcagaacctgggtcctgccccccccaaccagccctgccctggtcacaccaagctctgaccccacagtcccctgaggcttaagcggcggggggcagaagccgaggggggtgtcagaggggacggcccagcctgagaagtccatccccatggggtgatccagggctggcagcagaggcggtgctggattatctggggtcctctatctgggtagggagcatcctcagtcctccctcagcatctcatcttgcctcctcacagagcctgggcccgctgccctcagcaggtcacaagccgcccttcagaaccgggctatcacttctctctgaccccctaatgtgcaactccgcagtaccaagcccggaggtcctttgcgttgtctgcagggacaaggatggactttgtggcccctctatcaggatggggtggaacctctccataatttctcagagtcctgatgttgatgcctggaaaggccggggccccaccctttatggaactgcctctgcccgggtcacaccatagactcgcagagtctccttgggcattgaggagggggattgtctcagcctgataatttggtcccctgttgtttcagggctggctccagggttggcgctggattatttggggccctctatctgggtaggaggactcctcagtcctccctcagctctcaccttgcctcctcatggagcctggacccgctgccctctgccactctcaagacacccctcagaaagacgctttcgcttctctcagatc

SEQ ID NO: 101 - DNA, 29031 bp, Homo sapiens
ttaatgaccttctccttttatttctctgtttcacaacaccagttcagctttattgttaagttcttacattctccaagaaaatacctattgcaaatcacagcaagatggaagatttcccaaaatgttttacaaaatggcaaacacttgcacttgaaatggataagcaaaacaacatgtgtggtcagtatcatccatacacttagatgttgaagctaactaaaacttttattacaggaacaatatttgaaaattaccaaaaggaaacaaaaagaaatctccaagtcacccgatggaagagaaacctaaaggcagtatacaatgtgttcccttccattcactgtgccttctactactgagaacactgacttctctcatcaaacacagagggaagaatgggcctgatttcacacaggacagggaaactgctgggtgtggccctgaagcatgcattggcccatttccctgcccgctggccctggttgcatctcatgctcagactccctctccctcctctctcaaagcatcttcatacagggatgggtaagaagtgggatccctcccattggcattggctatgtactcaagaactttcatcttgctggtctcagcgtgggcccttggaccccacaggaactcatagcatgcaggatcagtgccgggcacctgccggtacaccaggtacttttcctgcacccaattttgggtgaggagcctcttgggctccccaaagaggaagtgctcccttccagcatacacccccataatgctcaggacttcccacataacctcttcagggatgcagttcccctccatgaagattacacccaggactattatcaggaggccagacttgggcatgctctgctcattacactgtatgccatcataagagaggttgagggaggtgacaaggacataggagtggctagtggggtccacttccttcacatcaatgccaaagagcagttgcatgcatacagaggcttccctaaatatctcaggaaagtagtcctcataatttttgatgacactccccagcatttctgcctttgtgatcagccccttgactcgatacttgcggagcaataaatgaaccaaatcaattatcttgtcatgtagtatatcttgggaaaaggactcagggtctatcaggtcaggcgaggtacttggcccctccttttcttggctgccagagccctcatcagataggctcccaaagatggcatccatggcagtgggagagaaggactcttcctgaggactctggggaggacttggtgactcagcagcaggcaactcctctagagtgcccacattcagagtagaggagaagaaggcagcctcctgctcctcagcttggagagcctgtgcacccaccaggcccaggtcttcttcttgggcctgaaggccttcctcaggcttgcagtgctgacttctttgctcaagaggcatgatgactctggttaggtcagcaggccgaactgtgggaaatatctgggtgatggggccccacagcctggggagagagggagcgtgagaacagactcagatgagatatgaaccatggagaatctaacaaaagcctacttacacttgttctcctccagtgatcctctgggttctcctgggactcctgtcctccaggttggcctgttctctaaaaacctgaaaaaggaagtgagaaggctgctcaagatgcagctggacatcagagcaggaggctccaggactgaggtagggcaggtgaggttgcaagctgggggtccctttctgtactggggcaggtggggccatttgtagattaagggtgaacatctcatcttgactactggcactgcctaggcttcctgtgttctgagatctgaagacattgcttgagaccaaggcctcactgctcagtttttggagcttctagaagaggaatcatggggccatcaggctgcagactgcaagcacccatcctggcaccccagcactgtcagaaaggtgggccaaactctgtgagtttctcacttttttggagtggatggtcccctctgtgctcagggccctcacctttctcctgccagggcctggaagacacagctctcctgacctgagaaactctcagatcaatagctctttcctgatatgaaagaggacatgtggggatacacatctggccacatgtacacagggctacccaggaaggacagcaagagatggtgacagtcagcagggtccatgtgtcctcgggtaaggagcctgtttggttcccatcttgatgcctatcttggcctgggaccctccctctgttgacctgacgccatctccttaaaccaaagctctacctccaggagacatcagaagaggaaatcagggaaatagaaacacccatggtcccagggacttcccatagctgacagaaggggcagggaagggctgagtcccatgtttttggtaagtgctgtcccgtcagcccccaccttgattctggtcatggcctgggaccctcccactgctgacctaagtgcagccctctcagaccaatgtctcccgctccctgagaccaatgatcccagtataagagaggggtctcagcacatagtcctgcacatgctctctggggagacagcaggggcagagcagatttctaagcagccctctgtgttctggccaggaggaaccctcaatcctccctcaggtttctcacctggactcttggcagatcctgggaccactgtagttgtggaccatatggggctctttctgttgactggaagtcgtcctctgagaacatagtgctcacctgcccaagattccaaaacagaagtaaggggccccacgtcccatcaccccatcatgtggttgtccagggctgacagcagaggctggacccttcggttctggggattccaaagtcctcctgtgggtttttcatctttacttctgccagggcctgtccttccttgactcccaacccctgagatgagcagacatatccctttacaccaagacctcatctccctgaaggtttcccaactttctgcctgtggtacaagtgaccttgccacttggggccacccgtgatgaggtccccatacagccaaggacaggggacagagagactctgtgggatcccttcattatgggatgtgggtatctccagtcctcaccaaggggacacatacaccttgagtcctaaagatcctgggactcctccctctgctgatcaggtgtggctccacctgctgacctgtcatcacccccttgaaacaaggtgctcacctccctgagcaaggtgccacccccaacctcgtggcagaaatgtgagcatggcacatgcctccccaacttgggcctccgagggatgaaaacagaggaagcaaggattggtgaggtccctttttctttggcatgtgggagggtacattcttaccttcagtcttcatcaattttcctctccttgactactggcagatcctggactccaccctgtgctgaccaggtgtgtatccctctgctgacctgaggacctgcctcagaccaagggccccacctctctgagatatgggaggcagaaagtgaaggggcactacatggacacccctcatgggatgccaaaggctgacagatgaagcagatttcaggggtgcctcctctctctgggtttcctccaggtattcagatttactcctgacaaggcctatccatgtctctcctgctgaactgtggatgagttttgcaggccacgaccaccatctcccagagaaccccaactaggaagtggggagctgcctctctttcctagagtcctgcttggggcctccaaggaccgatggcaggggcaggttttctacctcagggataattggttgcctgagtcctccctctgggactcctccctgggttgacctgaggctccactcctcagaccacaacccactccttgctgacaccccaaaggcagagtgaggatgcaccacatgtggccactgtgccttggaactccaagggccaaggtccctactgacctggagtccaaagtctcctgagtcctccctcttcttcttcctcttgatgctggcagggctgcaccccagaccccctctgcggaactgagtctccatccctcagattcccaaggctgaatgaaaaggcacctcagtttgagacggcgggactatgggggggggctgttctggggtgctgggtcccttcagttgtccctcaggccttgctcacctcccagcagggactgagccctgtctgtgctccccctaggtctttctcatgataccaagccccttccctctgtcagcccaggatgcggaaatcaggatccacttgcctggcagcaatgccaggaacttcccaggactgacagcagagagggagccttgctctgtggggcctcagccctccctcggggtcctgaccttgatgcctggcagaacctgggtcctgccccccccaaccagccctgccctggtcacaccaagctctgaccccacagtcccctgaggcttaagcggcggggggcagaagccgaggggggtgtcagaggggacggcccagcctgagaagtccatccccatggggtgatccagggctggcagcagaggcggtgctggattatctggggtcctctatctgggtagggagcatcctcagtcctccctcagcatctcatcttgcctcctcacagagcctgggcccgctgccctcagcaggtcacaagccgcccttcagaaccgggctatcacttctctctgaccccctaatgtgcaactccgcagtaccaagcccggaggtcctttgcgttgtctgcagggacaaggatggactttgtggcccctctatcaggatggggtggaacctctccataatttctcagagtcctgatgttgatgcctggaaaggccggggccccaccctttatggaactgcctctgcccgggtcacaccatagactcgcagagtctccttgggcattgaggagggggattgtctcagcctgataatttggtcccctgttgtttcagggctggctccagggttggcgctggattatttggggccctctatctgggtaggaggactcctcagtcctccctcagctctcaccttgcctcctcatggagcctggacccgctgccctctgccactctcaagacacccctcagaaagacgctttcgcttctctcagatcccagaggcggaagccaatggaggtcacatccggcccccacgcctggagcttccctggatttacagcaggagcgaacccgattctgcccgtgtgggggcggggcgaggcgaggcggggcggggcgaggcgaggcggggcggggcggggtggggcagggggaaaagtagtggcgaggggtgcagatgtggtcgagggtcatgggggtgcctcagtcctccctcaggtttctgaccttgattccttgcagagcctggagctccgtcctctgccaatgatgtctgctcctctcggaccaagtctctgactctgagtcccctgaggtggcagtgagcgggaggtgtgaggtcgggggacaacattgccaaggtcttccggggctgacaggagggaccgagctggattctgtggcccctctatgtggggagggtggaccgtcagtcctcactcaggagggtcctcctcttggctactggttctttcatgaagtgatgggtgggagatgctctgtttctgtcacctctgagcattgcccaactgcaccccttgcagacaatagctgcggatcccaggctaggtgcttccatgtggcttcagtacccgtgattgtagtgacctctgggagaagatgcacaccttcctacgggggctcctccccagccagatctagactttgcaaacttttgccctgaaagctttatttttacactgaagaggctgagtggctgcaagaaatttgcggaagtcctgcgtttagaatttatctaacacttcatagttcattttagtgattttcattttttaattctcattcagtgtcaaaaatcatacttaacctaactgcctatttcactctaatggtcaatactctaatttaatccattctttatcttcaattaaaacgataatttttaaaaagccaatctttatctactgacgtggttttagtggttatcagcacaaattccagccgtattcctttaatcaaccagtgtttcctcatgtcctgaagttaccccatgactactggcacctgtggtctgagaccctacccgagttttccacagtgaagtaggggcagaattttaaacatttctttcttcctatccaccccaacttccctgccactcttcccccccaatcacaagtattccttcaaaatacaatgaaattctcagggctctctcatgttttttttgtttagatttcttttttgatattgtttgcttgttcctttatttatttatttttattctttagttttcccgggttgttttggggagtctaagatagaagcccaagactgaacgcggtggttcacacctgtaatccaaacactttggtaggccaaggcaggaggatcacttgagcccagtagctcaagattaatctgaactacataacaagaccccatctcaaaaaaaaaagaaagaaagaaaaagaaaaagaaaaaagaaatgaaaaattagctgggtgtggtggcgtgtgactgcagtcccagctggtagggaggctaaggtgggaggatcactggagcccaggatgtcagtgctgcagtgagctgtgttcacaccactgcactccagccttggaaatagagtgaggtcctgtctcaaaaaaacaaaaccaaaccaaacaatcaaaaaccaacagatgcctgagcttgacagtcatcttggctggttaaggaattacgtctgtcaatttttgaaaaaatagaattgccatctttgcaatattctgttccctatcaatgatatcatatactgccttgtttatttgggtgctctttgaactggatatatcagtacttgtatagttgcctcagtaaaaatcatacatgcttttgttagtcttcttgttaggtaatttttggatattgttgctattgtgaatggggtattttctatgacctgttcttaatagttattgtctgttttgcaaatcttttgattttgctttattgatcttctgttcgctatttttcacatgtctcttattcatttgactatttcaagtgtgcatttttttgaattttctagatagactgttgcattaccctaccaaatatcactctttctttccaatatacatacctcttatttattttggtatccatatctgtggctttgtattccaatacaactttgaaaaatagcaatgatagcatacatttatgacctgtgcctgacatgaatgcgtccaacattttacaattaagtatatttgctatcaatttgatgaaacaaaatttccttctactcttaattttctagttatttttatcatggatgattactaattttttcaaaatatttttctgtatccattaatatgatcatatgttttgcctctataatcttgttaatatagggaatcacactgaaggtatattttaatgtcaaattgtattttcattctttggatatatcccgtttttccatttagtacactgccctaatgaattggctattaatttatttaggatatttgttgctatgtgagtaactttggtttaagtgttcttttcatggtgaggtcctcttctggtatttgaaacaaagaacactagtctcagaaaatgagttccacagttgcccatctttttgtatggtttttaagagtttgcttaggatggcaatgagttctaattatttggtaaaactggcctctgaaactttcttttcctggatcatttgtgggtggcttgaactgagaatacagttttagtttgtaatgtttgattaaagttttctgtttctttatggaccaatttgatctttttttttttttttcgagacagagtctcgctcagtcgcccaggctggagtgcaatggcacaatctcagctcactgcaacctcctcctcccaggttcaagcaattctcctgcctcagcctcctgagtagctaggatttcaggtgtgcgctaccacacccggctaatttttgtatttttagtagagacggggtttcaccatattgtccagacgggtctcgaactcctgacctcgtgatccacctgtctcggccttccaaagtgctgggattgcaggcgtgagccactgcgccgggccattttttttttttataaaatatagttcatttcacttaggatttcaaatttaatggcatgatattatgatgaaataactttattaaagtgtcagacatgtaaaatagtatagtataatatacccaatatacttgatattcagcatcaaaaatcttcaatccattactaatctgtttccaactatacttctacctaccccacgtctcaaatgctggaataatgtaaaccaactcagtaaccttggatagaatactggatccaataagccagttcatggtacagtgcagctgacctggctctgagacagcctatggctcagagaaaagggtctggcttcaatagaccagcctccctagacccctacctcctactctctgttccagggtcctgaggtactgcacgcctttgttctcttctagacacatgctcctataatactgctagctaatactgctttccagacacccttgggtctctctccaaatatcttctctgtgaggccttctatgaataacctttctttttcttcatagaatttgtgtctttattatttatttttgtaatttcactttcattttagattcagggggtacgtgtgcaactttgttacatgggtatattgtgagatgctgagatttgtgatattattgatcccgtcactcaagtagtgagcatagtacccaatagttggatcctgacctttcatcatatacaaaaattaattcgacatggattaaagattgaaatgtaagacctcaaactataagaatcctagaagaaaacctaggaaacaccattctggatatcaccctcgggaaataatttatgactatgttctcaaaagctattgcaactaaaacaaaaattgacaagttaacctaattaaactcaaaagcttctgctcagcaaaagaaactatccacagagtaagcagacaacctgcagaatggaagaaaatattccccaactacccatctgacaaaggtctaatattcagaatctataaggtgcttaaacaattgaacaaacaaaaacaaataacctcattaaaaagtgaataccctttctaaaattgcaatcctccctcttaactcatcccaaacacttattcagttctctagattcaatttgtttccatagtatttatcaccatgtcaaccaaaattaagactggttaggcaaaaataagaggataaatgtttattggaagccaaatgtgaggactgacctgggaggagaaaccaacaaagttgggagtgttctggagagtcttacaagttggaagggttttatgagagtttagaacaagagagaactttttatatggcagttgtcgttttttattagaggatacaatacggaggttagaatcattgtaccaaattgcaacatacagactaaaatgtccatgtgcaaaacaaccagtaaaatttcatgatttaaaaataaatcagcaaacttttcaatgttggtacattacatattaatccatatgtaaacaatttgtggaatgcaggataagacactttactgagggacaggatggcaacagaaatcacaagacctcccccaggtgagttcatttggaagcctaccaaaggtgatttggaagttaaccattaaatctactgcacctttaagtttgtttcatgatttattgtgtgcctaccctttacctcactagaatgtaagttccacctagggaggaaatgtgttcaatattgtatcctcagagcccaggacagtgcctggcacacaatacatgctcagtattcatttatggaatgaataaagaactgccagttctatggtcctagtatttggagcttctctggtactaaagtctcatggaattttcaatctttccaaacacccaacagccaaagtttgaatgctcccactatcttctaattgttggctcctggaccaggtaagcatctgagttttaaagggactccaaaggcctgctttcccagcttctggtttgtgctcctcacatcctgggtaagtgagcatggcagggctctagccacccagggctatctgaacactctctcttgtcaggaggcagctgtgacctttccctgatgccctgtttctttttccatcttgtttggatatgcaagttaacacagtagtccttgcaaggtggaatctaacagcctaattgtacctgttgggatttggggtttccttctcctgaggcccatctctgagcccccatcaccttggctgcagtgcccacacttgcccacagtttcccgtatctgacttcagtcttcccaactggggcttggaattgcagctctccaatacaactactcaagactcagtgctgaggcttatgaacagttaaacttttatttaaaattctctacttagaaatccccttccaaagtattatggttcagatagaactggcagaagatgaggtagccatttggtgagtttcctaggggttggtaaataataaaagaatgctgtgtgaatgagtgacaaatcactataatgatgacttacttttcaaatgatcccctatgtaatgcccacacattaattaaactaatcacctcgttaaggcgcctatgagtttttgctttctaaacttgatccagagaggtgatgccgaactgttttgtcagctacccaaagagccatctaggatctcggtgtacccccaaaaagtttaagaagactaatgggtgaaacccactgtgaggtctgtggtcattagtatactcctccaggtcccagaatatcctcaggtcaaattaggatttggaaaggagccaggaagggtaaggctttcttgttaccaaagggcataggctgtgatgagtttggaaaagtgtgagaaggatcacctgctggatccatctatagtgccttaggctggccacgggaggaatgtagaagtaaaatgggactggaggtgagctggagccctgcaagatgtcatgaaccgagtgcttccagaaagaactccagagcagactgctttgtcgcactccaggatgacaactgtgacacttagtgccctttgttggagagaaacgacggatggggagaatgctaactctaggatgcctaagtgttgcagggctagagcagctagggggtctcacagcaccccaccaacagcctcttctggaggcatttccagggtctagcatatcccacagcagcctcctgtgtggttacacaccacagaggatggaggcaatcctgaccagggtagggcagagcagatgggggccttcctgtgcccatacatgggaaggtcctgactgtctctagatgtcctgagcctgcccactgagggactgatgtgaggcctgtcagccatggtcctgctctcctaagagacctctctgttccaccagctatgactgaaaccctgcacttaacttcagcttccttggcaaggggctgacctcctgcatgcttcttgaaagctgtattagtccattttcatgctgctgataaggacttacccaagacctggcaatttaaaaaagaaaggggtttaattggacttacagttccacatggctagggaggcctcacaatgatggcggaaggcaaaaaggagcaagtcacatcttacgtggatgacggcaggcaaagagagcttgtgcagggcaactctcattttttaaaaaccatgagatctcgtgagactcattcactatcacgagaacagcatagggtaactgcccccatgattcaattatctcaaaccgtgtccctctcacgacacatgggaattatgggaattatgggagtacaattcagaaggagatttgtgtggggacacagagccaaaccatatcaccagctcttccctgtgccaattaccctgtcagcttttcctgagcaaataaggagtcctgggtctccttttatccttgatcccagggctggagctgaacatagggatagcgggggctagtggcaggatgcttgttatgtcccaagggaaatccacaaaatagcatcagaggacaaagccaaggttgcccatcactcagactgagggtcagtgcaaacaagccctgcagacactgacacctacgtggatgcagtgagagtccacatgtctcatgagcactgcgctccgtcctacttgccccaccatgtatctggttgccagcctgctcagtggagttggctcgaaggaaattgttgagtcatctaatctgctgagaataaaagagaccaggccaggcaggtacacagcaaggcagggcacatgtctggacataatagcagcctctggaagactggacttctgatatccatgtcaaatggttgctgtagcttagcctgggcaactgcacttgggccatgagctgccagggtaccctaaaggtcaatggaagtcttcctggaggctggacttcctggcatatatttgaggttctaagcctgcttcaggctccaccatcttctcacttgatttatctctgggatccctttgttttatttgtgtgtaatgcattttatcttgctgtgttacgtacttctttgtagcctgctccaaatattttctgaatgaagcaggagtgaaaaaaagggggaggaaaatagtgagcgaagtcccttctcaatcccacttaactctttaatgtcttcacctcatctgcattcccctctggatccccagtgttctgttaatggagcacaagctcattgcaggggtcgcggttctgaactgcagcccatctggagctctcaatgcagaaacttgtccatcttcacaccctttatcctaggacccacctctcctccacagcatttgtctccatgtcatatggatagaacaggagagaggccattgggtaggattctgtttcaagctttcactggcaccaccacttggctcctttaagatcagtcctaggggcatattgatagggcaatagttagcagtggaagatggctggcactcccttgtttgtgggttgcagctcaacccagtacagagacagggctttgaacccataagaaagtaagtttgaatattagctctgtcgcttataagcccatacatcaagtatcctttatgtacttcagttttttcatctgtaaaatgggagtaataatagtacaacttcagagtgtttatgtgagcatcatataacatgccacttgtatgtaaaatgtttggccctaataatgtggtcattaataagtggctattattattgtgtgcccatgatgtaccttcccccatattttaatattcctgaacctgtatatgtcttatgatccacatgtgcattaattaacgcatttattttcttttccccttgaaaatctgttaccttggattgtttaatcccacatctttgagctgtatagacatgatataacttgttctagtcctgcttggggcaataaccagggctattgaaccaggacctagatcaacacataggtctgtgagagttgctttgaagaattcctccaggctcaccctccctgcatccaatctcacaccccagagctctgcaagggagagtcctccaggtgaacacactgaatgccaaagaaaaggtcccacactgtgcctgaccctggctgcccaggttcacatctctgaggagtactagagccacattccaaattctccacaccactgcttgcacttcattgggatggctcaatggttattttaaaaagtacattgttccttgcacaaatgtttttgtattttgaaaaagcctagagttacctactttccaagtataaatctctttttgtgcctaacatgttgtcaattttcttttctccctatcttaaatttaaaggagcagataaaggcaatcttatgtgcccagaaagaagagaaccaaatatttgtgaccagccctgatatgcacaactgaggtcattttagaggaggaagctgaggccccttttctccatctgcttgtcattgctctagtctaggcctgctcttatcctgtgggaatcctcaaccctggacattccagcctcttaacagttactgtatgacaatagcaacacaaagaagtagggagagaatggaactgtatgtgaacaaacccattgtatactattttaattaagttggtattaatttaaatagattggtacaagttaaactatcaattgtagtccccaggacaactgctaagaaaataataccttaaatggcaatgggattaaaatggtagactagaaaaacatatatttttcacaaaggaaggtagcattgaaaatataaagaaggaaaaatacatatgtaatataaagagtaaatcactgactacaacacagaaatattaccttaccagtaatcttaaatgtaaatggattaatcacctcgattaaagtcagagattggggaaatatattttggaatcctgttctaactatatactgattatttataagagatttatatagatgtatacatctaaatacataaataggatgaaagtaagtatatgggaaaagatatatcatacaagcagtaaccaaaagagagctggaatggctatgctaataccagacaaaatagactttaaaataaaagttgttactagagaaaaagaaagatattttataatgatgataaaagttttagtctatcaaaaatatgaaacattataaacatatatgtacctaataacacagaccccaaaatatagaaagaaagaattaaagagagaaataaataattcaacaataattattggagactttaaaccctaatttcaataaaggtataacaagatagaaggtcgccatgactatagaatatttcaacaacaatataaaccagccagacctaacccccaattatagaacacagcacccaaaacagcggaatatttttctcaagtatacatggatcacctttcaggataaacaatatgtaagcccacaaaacaagtctcaataaatataaggggattgagattgtacaaagtactttatctgtctgcaatggaataaaatatgaaattaacatcatgctacctgacttcaaactatactacaaggctacggtaaccaaaacagcatggtactggtaccaaaacagagatatagatcaatggaacagaacagagccctcagaaataacgccgcatatctacaactatctcatcttggacaaacctgagaaaaacaagcaatggggaaaggattccctatttaataaatggtgctgggaaaactggctagccatatgtagaaggctgaaactggatcccttccttacaccttatacaaaaattaattcaagatggattaaagacttaaacgttagacctaaaaccataaaaaccctagaagaaaacctaggcattaccattcaggacataggcatggacaaggacttcatgtctaaaacaccaaaagcaatggcaacaaaagacgaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaacttaaacaaatttacaagaaaaaaacaaacaaccccatcaaaaagtgggtgaaggatatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaacctagttcaacccttgtggaagtcagtgtggcgattcctcagggatctggaactagaaataccatctgacccagccatcccattactgggtatatacccaaaagactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtcaggggaggggggagggatagctttaggagatatatctaatgctaaatgactagttaatgggtgaagcacaccagcatggcacatgtatacatatgtaactaacctgcacaatgtgcacatgtaccctaaaacttaaagtacaataaaaaaaaagttaacatatttaaatttccaaaaaaaaaaagaaattaataacgttggtaaatttcagatattcacaaatttgtgaaaattaaactacatactcctaaacaaccaacgggcaaaagaaaaaatcacaaaggaaattcgaaaatattttgagataaatgataatgaagatatatatacacacatggtcatgtacaaatgaacaccagctcatcgcatagttcaagtgcactagcttgcattgttgattgcacagttttagagagacatgttgatgaccctattttgccacttccagagaccagatgtactgtgcaattaaccagaaaacactgatttataaagcatgaaaataagaatctcttctgagcttataactaaacatatctaaactataataaacattaaattccaaggacttgatatggtttggatctgcatccccacccaaatctcatttcgaattgtaatccctacatgtcaggggaaggaccatgtgggatgtcatcagatcatgggggagggtccccccatgctgttctcaagatagtgagtgagttctcatgagagcagatggttttaaagtgtagcacttcctcatttgcgcaaaccctccatcctgcagccttatgaagaaggtgcctgcttccccttagtcttccaccatgattgaaagtttcctgaggccttctagccatgcttcctgttaggcctgcaaaactgtgagtcaattaaacttttttcctttataattactcagtttcaggtaatattctttatagtggtgtgagaatggactaatacaggactacagctgtgcctgaacaggttacatcaaaaataataataaaaaaactactccaaaagatgaacaatggctacctctgccaaatggaagagtttagatgggctgccttctcaagttgggaacacaatcctgtacatacgtgcttaccagtgccacaccatagatttacaagtcagcatgggtaacccaatcagagactataaaatacccctcaataaatactttgttgcacagcttcaataagtgtgcttatctgacagcctaatatctctttcagggactaactttacagctgaagtcacaatcttctaggggtggccaccaatcaatgattaggcaatgcagttttagtcaagaacatacacttctcagaaaggccaccagccaatgactgagcaagtcgagggtaaaatggcttagaaagtcccataaaagggacccctcctccaagcaatctttgcttcagagctccaaattggactagcaaagactttgtgagatctccccaaaagacaagagggagaaattgggtatgtgcaattgttaagtacttacatgacatgcgaaataatatattatttgaaggtagattgtgattaagtagagattacattgtaaactttagggcaaccacaaaaaattcactaaaagagatatacataattaggcaacaatgaagataaaatggaataatagaaaaatgagtgcctattcacaatagcaaagacatggaatcaacccaaatgcccatcaatgatagactatataaataaaatgtggtacatgtacaccatggaatactattcagccataaaaaggaatgagataatgtcctttgcagtgacatgaatagagctgcaagccattatcctcagcaaactaatgcaggaacaggaaaccaaacatcacatgttgtcactcatacgtgggagctaaacagtgaaaacacagggaggggaacaacatacaatggggcctgtcggtggtgcaagggaaagagagcaacaggaaaaatagctaatgcatgctgagtttaatacccagaaagctgggtggcagcctgagggccatcaactcatgcatttaatcagaacaaagaggtacgcatcaagcctggaacaaagaaatatattgtctcacaagacaataagcccagcacaggctgtgagggctctttatctcccaagaagaaaatgttccaggtacaaggcccatcttatgcagctgagcaggttggtcaacagacaggacatgactgcctttaccaacaatattaaaaggagaatgtatcattattgagatttgtctcagaaattcaatattcacaaatcaatctctgtaattaactgtatcaacagactaaaggaaaatgcatttgatcatattcaaatgattaaaaaatttttatgataaaaagtctagacaagtcgaattaaaaaagaaataattcaacttgatataggacatgaaaaaaaaaagaaaacctctacagttaacatcatacttaatgatggactggataaaaagctgggatgtcaattctgaccaatcctaccaacatctctgtgaaagtccagaccaatgtaataaagcaagaacaagatattaaagacatactgacaggaaaagaaaaaaatgaaaccatctctatctgcagatgacattgattgtatttgtcccttttcacactgttataaaaaaatacccaagactgagtaatttagacaggaaagaggtttaattgattaatagttccacgtggctgaggaggactcagaaaacttacaatcatggcagaaggggaagcaaacatgtccgtcttcacaaggtggcaggaaagaaaagtgcagtgcgaagggggaagagccccttataaaacaatcagatcttgtgaaaactcagtcagtatcatgagaacagcatgcacctgcaggcccaataccacctggaaaccaccaaggcttggggcttgcactttctgaagcaatggcctgagcagtacattggccccttttagccatggctgggatgcagggcaccaagttttgagattgcacaaagcagcaaggccctgggcctggcacacaaaaccatttttttttccttaggcctcaagccagccaggagtcctgaattcctagccttcccacccctaggaaccccctacccctggtaggggcgaaagcatctgatgtcaaaaagactcaagggcatcatggaccttccatatgggtacaggactgcaggacgtccatcagcctcgaaaagacctctccactgcctttcagttgctagcttctcagactcataggcccaggcgaattacaatggggctgccgctggcctgggaagagcaaaaactgtggggccttgcacgtagcaggaaaagactggaaggagactcaagaccatgacaactcctttctgtgaggagccctgagagggtgaatcggtaatgatggagggtgccaagtgagaagaatgtaatgaagggatggttgtgaaatttgaggagagaggcggtgaggtcagggaagagatgtggggtcctcaggagggtgttgaatagggagagggcacagggtcaaggggtgtggtgcttggggtctgcagaggatgtggggtcaggaaagggtcttaggatttcaggtgtggggacacacagtgaggtcccaggagtggggcccattgaagtggaggctctgttctatctgcagtcttggtccacactccttaagattaaccagagaaacacgtagaggacaacaagatagtgaatatggacagagcagtgaagatgccagtggccacggaaaatactatttcttccatgctgtctccagggagtgcttgctgcagtgtttgatggaaggtacagcagtaggagtggtgtcagcttcgacctgcccgagcagagggacagtacttgaaggaaatgctagggccagaagccatgtaaaagcttccaaatgcacgtgtgtcagggccagcagtggcaggaggagccagcaacccagaccctatgactccttctgcggggatcagtcagatggccttggcattggtcagacaggaagtgaggtgggttaggactgagaactaccaggagtcagcagggcaccaccagcttggatcctgagtctggaagaagacctatacctgaagcagtgcccctcctccctcggatttgccccaggtcatccctaggaggccatcccattcttctcctgccatctcaggaaagtacatcacagtggagggcataagccagaccagcacccccaaccaaccatcatcccatgcgtgactttacacacagatactttcctacacacaaagaccaattcaaagctgcttgtcaccatctcttaagtgaatctttaagaagcctaatgtggcagggcttcaggtcagggccacttgatcaaacccagcaccttctgaatgaccaccagggcacaccgagaatctgcctggaggaagcccaagccctgccctgactgctttttctctacttcacctttctctcctcttccaggaaataaatttgcttatgctgagggtcagttgtcaccagtctgacttatttcttccactctgtcctacaacagtgcttctggactccaggcaatgctcctccaaccgcatcacctgggggctagttaggaaccagcatctcaggccccactcagccctaagcagtgagaacctacatatcaacaagattcacaggagactcctgtgcatgtccccatgtgctaatccagacgtggtgtttcttctttgtgcctctgcctcagggagtctgtgactcactgaattcagggtcctctgttcattagtcaggtggaatcaggcaggatgtcctgactggatccttttcagaatcttccgccaacaaaatcataccacatagcaagagctgctttccactttctgaagtggatgcacttttttgcaatttaacattcccagcaacaatgtatgagggctctaatttctctaccaccttgtcaacacattattgtcatttttattgcagccattgtagttagtatgaaatagtatctcatttaggttttgactcgcatttccctagtgactaacgaagttgagcatcctttcatgttcttttggccatttgtagatattctttagggaaatttctgttcatattctttgctcatttttaatggtttgtcattatatggtggtattgtaaatgttccttatgtattctggatacaactttcttatctgatacatagcttgcaactgttttctctcaatctgtgggttgtctctctgtctagaggtgccttttagagcacaaaaaggttttttgttttttttttgtttttagtttgaggaaatctagtttatcaatttgtgtttttgtgggggaaaactatgctataaattggagggaaaaatgcaacctagccacagtatgagctcaaggaagacattttttgaaagttgaaattgtcacattatttttaggtgtcaacgatccagtaaagagcaaggattagctaataaaagagaaaaaatgagacaatttcaagagaaaaatgcttgagaaagagtccattctaggctcttagatagtgctggaatgctttgtcttttgtcagaaaagaaatgacagagaatgcaggcatattggtggcatcagaggcgagataaagagtgaactgccatcaaatagctttcgtttgccttatcagaaaggtggaaaattggccgggtgtggtggctcatgcctgtaatctcaacatttggaaatccaaggtgggcagatcacctgaggtcaggagttcgagaccagcctggttaacatggtgaaaccccatccctactaaaatacaaaaggtagccgggtgtgatgacaggtgcctgtaatcccacctactcgggaggctgaggcaggagaatcacttgaacctgggaggcagaggttccaatgagccaagatcatgccattgcactccagcctgggcaacaagggtgacactttgtcgaaataaaattaaaaaaaagaaaagaaaagaaagaaagagaaagaaaagaaataaagagaaaagaaagaaagaaaaaggaaaatcatcagatactgttgaaggctggagtgttttggagatttgagaagattcgaaatagattttttgcagagtgagaaagtgaattcactagaggaattgagcaagttgtctcaaatacttcaaaggacatcatcaaaaaattgaaaaggcaactcacagaatgggagaaaacatatgttaatcatagggataaggatctaatatccagaatattaagagaacagtcacattttaacaattaaaacacataaccccatttaaaatgagcaaaggatttgaatagacagttctccaaagaagatacataaatgcccaataagcacatgaaaaggtgctcaacatcgttagtcatcagggaaacacaaatcaaaatcacaatgagataccactttacatacactagaatggcaaaaataaaaatgacagacaataatagtatctctaaggatatacagaaattagaatcctcatacactactgctagaaatgtaaaatgatgcacctgctatgaaaaacattttggaagatcctcagaaagttaagaatggagtgttaccttatgacccagccattccattcctagtcctacacccaaaataattgaaagcaaataatcaaacacttgtacatgaatgcacatagacgcattattcataataccaaaaagtggaaataacctaaatgtccatcaagagatgaatgtataagcaaaatgtatatacatacaatgaaatgtcattcatccttaaaaaaatgaagtgctgatacacgctatcacatgaatgaagtttaaaaataatatggtaagtgaaagaagacaaacacacacaaaaagctacatgttgtatgattacattattatgaagttcccagaataggaaaatctatggacaaaaagtagattaattcctgccaagagctagaagaagagggaacggaaagtgattgttaatgaggaggtgttttctcttggggataatgaaaatgttctggaatttgctatggcacaacttattaatagttaaaaatagtgaaatgatggaatcatacttttgaagtggtaaatttatggtacatgtatttttttaaaaaagaaagcaaactgacaacacatagaattgtggtgaagaataggaaagagcatcagtagagagcctctctggggtgcagcctactgagctcataaaagctgaagagggggcaggaactctgatataacactctcacatgatagacctcactctgcacacaggtagagacagatcaccattgggagactttgaaggtgatagcaaaaacaaagcctaaacccggctaaactactgaagaaattgaccacacacttccctcacacacaaacttacaacctagctgaataagatacattccaatttacatgcattaatattatttacctcagcctctactgttcttctacacatgaggactggcattcaataaaaattataaaatacaaaaaaattaataactagtaactcattttcatgaagaaaagcaataaacagacctggactcagaaatgacctaactgctgactacattacaaagatacttgaaaagaattgtgattaatatgtgtatcagtccgtttgcacactgccaacaaagacatactcgagagtgggaagattacaaagaggtttaatggacttacagttccacatgactggggaagcctcacaatcatggtggaaggcaaggaggagcaagtcacatcttacatggatggcagcaagcaaaaagagagagagcttgtgcagggaaactccccttcatagaaccatcagatctcatgagacttattcactatcacgagaacagcaggggaaacacctgcccttatgatttgattacctcccaccgggtccctcccacaacacgtgggaattcaagatgagatttgggtggggacacagccaaaccatatcgacatgttaaagaatatagtggaaaaactgaacaatatgcatgaagagaagtatcaagaaaatcatgaatcactgcacacacttgttaaaataattaattgggaggccataagactgaagcagctctagcaccctgagttcctatgtaaacaaactgaaactttactcaatacaaatggaaaaatgaaacaaactttaccaaagttggccagctaacctctaacaggggctttgccaatcagaaaccaccaaacaaccactaactaggggctttaagactactgctccactttttttttttttgagacagggtctcactctggtgcccaagctgttgtgcagtgttgtgataacggctcactgcaacctatgcctctcaggttcatgtgattctcatgccttagccacctgaatagccaggattacaggtgtgtgtcaccacacccaggtgatttttgtatttttagtagagatgaggttttgccaggttggccaggctggtctcgaactcctgacctcaagtgatctgtccacttcaaccttgtaatgtgctaggattacaggcatgagccactgctcctggccctacagctccacctaaaccaaaaaaaaaatattttctttgccttgcttctgcatgcacatcataaaagttctgccctcatgcccttttggtgaagccctggaccacttgtggttttatgctgcccaattcatgaattgctgtttgctgaaataaactctttacaattttaatttttctaagtttatcttgtaacacaactattttcagtttactgtacatattgaaacaaataactgatctctgagcgatgagagatagaaaataaagtgagccctaaaatttccttagcttactgcctggagggcagagtacacagcaggaaagccttgatgttttttgagttgaggaggtagaatttagaggacagggagactaaaatttgcagaacaaaataatgaagaggagaaagcggtacagagagaaatctccagagcttacatgggtttgaggatagttcttgtttcctctattcagagtgaaaaactttataaagcatgggacatcagctaaaaaccttaagagcgttttgtccaggttatgaggcattataagctatagactaaaaactgctctgatctcacctaaaaagagcaagacttgaaaaaaatgccactattttcaagaaacttacccatgctgaagaataaatcccaataatattttatagaaatacaaaactatctagcactcaacaaagtaaaattcaaaatgtcttccatccaatcacaatgaccaattttgtaaaaaagcagaaattaggatcaataatgaggataaaacacacacatgacactgataatagagattgtaggcaaagacatttaaaaatttatgaatgtatatgagaaccacaaagcagaggggaaaatgagggataaaaaaatacttgaggaaataatgaaaagttttcaggtttgataaaaactataaaccccaaaatctaataaactaaaaaaaaaatcacaaaacaataaacatgtataaaggtataccaaggcatttgataatcatattgtttaaaatcactgagattttaagaagaaatcacaagaaacttttaaaagtaaacagagatacaaattatgtacattacctacaaaggaacaaagataacgatgacagcagatttcttttgaaagataatgaaagccagaggagagtactatatttaaatattgaaggaaacaaatactaaagacgtaaacttctatattgatgaaaatatattccaagaataaagatgaaacacttttgtttcgggaatgcaaaattagaatgaatttatcaccaacatatgtgcactagaagaaatgttaaagtaagtcctccaggcagatggaaagtgatgccagagaaaaatccggatctacacaaaggaatcaagagccctagaaggtgcaactgcatgcataagtataaaacatattttccttattatgtaatgtcttcatagcaaagtaactgtttaaaataacagtacttaaaggtattaagttaaaaatagcaatgtatgatgtggcttacaacatatgtaaatgcaaaatgtatgcttagaatagaccataggatgagaagggggaaatggaagtataccgttggtttttatgtatctgactattctaagtgccaatgggtagagctgaatagagatgactgttttcctcattgcacatgaggtatactaataaggtgagcctgcacataacaagacatttttaaaaaacactcatcgtttattatgtgaacagagagagtgctgtgaactccagacaattactctgtaatattccttaaatgagaaactcttatagaaagaactttaccttgttttcttaaaggaaattaagagacatatctctaataaattttggttgagatgaagccatctgaacatcagtcaaggggattgtgcaccatgtgcggaagcagaggcaacaggtaaaagtaaaatgagtcaagatccttgctcttgttgagcatgcttgtacatggtctaagaacactctcaaaagaaggaaacacagtgaacatgcccatagtgctgtttggtgatgataggcagtagcaggggcctctttcccggaggagaggctgaagcagggctaggaatgaggttagagacagagattggggccaacactaaggaagatccttgcaaaattctcagagggatagtggattggagggagggagggtaaacagtcccattttgagaatagagaatagataaatatgtagaagaacagtgtgtgcctacgtgtgtttaggtcaggggtaggacaatgaagaactgggtaaacaagaggtgacatggtgaggtatgctgatgataaaaagattgggggctatcagttgttggcagggctggagagccaggaagcaaaattgggattcagtgcattgggcagaatggcatccacatagatatgtgcctgtgcaggggcatgatgaagcccacctttgaggaaggtcttctagcacagggctttcccagcagtgcaggggcatccccagtgttctgtagcaggtaaggcatcagggcccactgcctaaaggagggagaaaggatgctgggcgaacaggactctgggactagagtgctcacttcagccagactgctctgccttctaatgttcataaattggagttctatggaaggcttcagttaaaataagggattctatgtctaaaatttggcaaccatggtctactagtgagatatgggatgcattgtggtgtcctggcatcctctacttgtgcctaatattgctttcagccctttgcttcactgactttagttactgcaaagttgccagctgcctagaacacactagattagaagaggtttaacaaggaagtgtgtaccatctccatgggttttccatctaccctccaaatatctgcactttaaaccaatcctctattccagacattatctgctgacatatagacccacttttatagtcacaggacacaggttctctgttgtgacaaggacgcagaaaccatgggaggcattctgagctgggaacatcatctggatcatttttcatagccctttatctatagttactgaattagttggtcctgggcattcccactccagcttacccctccttgcagatgcacattcccttaccttgctcattggtattcctagcctgtatcaatggtcagccatcagtcaccagctccacttgcatagcacccacctctatgaaaggggtccagtgtacacaggaaaaaaattgtcagcctccactgggggtcaagacagctccctgccctggtgagagtgcacaggattactacagtgatcaagagaatgactcaggcagccagctatacccttcctgacaggagatggggaaattttaatgtaggctaattgtatatgtatatgtatgtgtatgtgtatatgtatatgtatatgtatatgtatatgtatatgtatatgtatatgtatgtgtatatgtatatgtacatacatatatcactccatgattcctgacattcttatagatcttgttatttcctaagtgagtaaaacaatacgaatatctttcattaaaatatttgtcctgttgtctttggttcccgaagcagcttcagaacagcttcggaatagtaaaggtggaagacagtcttctgttgtaatgttggagtgctttaggcctcagaaggagacctcggaaaacacaatctcgctttctaactttcttttgcccccctttcaccttcttctttttctccctaagacaagccatagaaactaaaaacagtcatctctcctcacctgtcttagagctggtcataaagaaattctctgacctaccttgtctgattgtaggtcttaaactcccatttcagaagaggtcctgacccat

SEQ ID NO: 102 - DNA, 14758 bp, Homo sapiens
ttgagagagaagagagaccatattcacaaaacttttattacattatattgtcatcattgtcctattttactattagttattgttgttaatctctcactgtgcctaatttataaattagactgtatcatagatatagatatatacatatacatataggaaagaacacattatatgtaggattcagtactctccgcgatttcaggcatccactgggggtcatggaatttgtccgctgtggataaggggacttatgtgtaaaggaatctccaacataaaggtgagttcacaatcagaactgccaagcatacgagcttcctactgcagctggaacagatcaccacaaatgtggtggcttcaacagcacaatttactctcccacagttctggggtgcagaaatccaaaataggcctcagtgggttagaatcaaggagtcggcagcgctggttcctctggaggccctaggagagaattggtttccttgtctttttcagcttccagaagccacctgcatccctcggctcatggccccctctccacctacaaagccagcagcagagcctctctccggcctgctcccactgcggcgtatctctctgaccctcttgcttccgttttcattttttccttttttaatgtattcccatcgttaagcacttgcttccatattataaggagtctgtgatgacattaggaccacctagataatccgagataatctcccatctccagagcctcaacttactcatatcatcagtgtcccttttggtcccatattcacaggtgccagggatcaggaccaggacatctttgggggccgttattcagctaccacaccaagcatggaagacagccaagacagaaaggaaacggcagcgcaaccgagggaaggagtcaccccactcccgcccctgggaaacataactgagaaagcaattaggagactccggaatgtgtgtagacatctcggcgagagccaggagaatgctgtgtgtgcagagagggatcagctggagaaagaaaaggaacagtacaaacatgaattcaaataaaacgccaccgtgaagggactgagtagcaaaatggatgaagatgaaaacattgacaggatgaagactgagcccaggaaggcgactccgcagattgtggacctagaaataaattgtcaaggaaaagctgagaaacacggaggtgagatccacaagtcgtcgtcgtagccatccagcaggctttccagaaggaggacagagagggaggagggcagagaggaggcaccacccacacacggacacacaggcgcacacagatgcacactcacacaccacacacacaccacacacatacacaccgcagacacacagatgcacacacacaccacagacaatcgcacagacacatacataccacacacatacagatgcacacagatgcacactcacaccctacacatacacacataccacagacaccctccccacataccacagacccacagatgcacacacacaccacagatacacacatcacacacacataccacacacacagatgcgcacagatgcctactcacacaccacccatacacacacacacaccagacacacacccccacagacccacagatgcacacacacacataccacacacacagatgcacacaccacacagatgcatactcacacaccacccatatacacacatacataccacacaaccccccccacatacacaccacacgtacacacagatgaacacacagacacatgcatcacacagaaagacacagatacacaagcacacacacagagagacacataccacacatacagatgaacacacacatacagatacacaagcaaacaccacacatacagatgaacagagatacacaagcatacacacacacagagacacataccacacaaacggatgaacacacacagatacacaagcacacacacagagatacacaccacacgtacacacagatgaacacacacacagatacacaagcacacacacagacacataccacacatacacagaaaacccagacatacacaaataccagagaccacccacctacacacgcacaccacacgtacacagaaaacacacataccacacatacccacacagaaaacacagacacaccacatagacacacacagacacagacacagacacacacaggaaaaatttccccaaattgaagagaaatgtaagttttcaggtgaaaaggggaaaacaaaatgttgacctgacacatgatagttagttttgaaaactttaatgataaagacaaatcttaaaacctgagaggggaattgtgtccccacaaaaaatatgttcaagtcccgcccccagcagctgggagtgtggcttgacttggaaatagtctttgcagatgtgatgaggttaatacgaggtcaccctggattaggatgggtcccatgaccagtgactgttatccttagacagagcgggagatttggacacagagacaccaggaggaggccacatggtgggagaggcggacgttggagccatgcagcaatgagccggggaccgccggggaccgctggcaggtgcccaagcgaggagacgggcatgcggctggccctgccctggaggcttcagaagagcacgtcctgccagcaccccgacttctggacttccagcctcaggaactgtgagagagtaagtgtgtgttgtcctaagccgccaggttcgtgtcaggaaactaatgcgggagggagggaggaggaggagggggagaggaaggctatgaggtaaagaaggaacacaaatcagattgacacgtacaactggagtataaagaccaatgggtgacagcttcaaatctatccgcagtcatcatctttcaagcatgagaggaattccaggcatttgcaaacccacccggactcagggagtttgcccccacaagcctgcttaagggaaggaatgacgggacaacactgtccacgagaaaacaaaaggccctggaatgaagccacacagcaggcagaggccagcaaagcatgcactggagtccacaggcgctgatcgtaaaccaaagagcgcagggcagccacgatccctgttatctgtgtctccttagccctctctccctcccaaaccctcctacaataacaggaaaggaattttaaaaacttccctctaaaggagaaaagcccacaagaaaaagaaaaaaagctggggaggagacaacagtagatgagagattttttttttttttttttggtgggagatcgagtctctctctgttgcccaggccgggcaaacctttgcctcctgggttcaagtgattctcctgcctaagcctcctgagtagctgggatgacaggtgtgtgccaccatgcccagctaatttttgtatttttagtagagatgggatttcaccacgttgcccaggctggcctcgaactcctgacctcaagtggtccacccacatcggcctcccaaagtgttgggattacaggtgtgagccaccgcacttggcaagatgagagattttgatgtcccccacattttagcccaaagctgaggagggtgactgacttagcaggtgtagctgtcagcctcggtggagctctgctgtggtaacaaacagccctggaatcccagtggctccggcagcccaggctgcttcctcacgcaggcacacgcctatcccagatgctctgctgctgtctcacaccccatcctcctcccactttaccccagaagccagcagccctccctgagacagagccgtcctgtgccggaaaggggcacagctcctcaaacgtctgctgggagggattgtcatcacctgcccatgccgcactggctgaggcacatcaggaggcccagccccaggcccacctgcaggacactgtcctcctcccacaggcgtggatgacgagcactgtgaccacagcatggatgaatggcggggctggggctgggagcccaggttgctatgggggacccacaccccttccctgcctcccacagccaggcccgatggcccttccaaagctgacaaaacaaggtcttctctggagaaactggatctaaggggttacagctgagggacacgggatggctaaggtctggggagaaggtggaggaggggctgcctcctgacttgtggcccctggaacccttcctgcactcggctcaggctgccattggctagacagggacccccaaccccaagcaggagacctcaggggccttcctgggagatgctgaactgcctggggaaaagacctccttttggggtccccgagaaagaagcaggccagcccccaggctctacctggacaccccacaaggagttgctagtcttgctcctcctatggaaaggcaggccttccccccaaaaaggaaggaccaaagcacacagaggagtacctgggggaaactgaggcacagcaaggagcagtgaaaatgccacctaccaaaaaggtccctaacatgacaatcctcagagagataagagatgacaccttggacccacagccaagccaatctggggaagaaaaaaaggtaaatgctttctcacattcacaaaaatggttctgaaaaccacttcaagctgggtgtggtggctcatgcctgtagtcccagctactcgggagactgaggcaagaggattgcttgagcccaggagcttgaggctgcagcgacctgtgatggcaccaatgcactttagccacggtgatagagcaagaccctgtctctaaaataaatacagaaacaaaataaaaataaaaaccacttcagttcccggctgggcacaatgactcacacctgtaatcccagcactttgggaggctgaggtgggtgaatcacctgaggtctggattttgagaccagcctggacaacatggtgaaaccccatctctactaaaaatacaaaaattagctgggtatggtggtgcacacctgtaatccagctacttggaggctgaggcaggagaattgcttgaacttgggaggcagagattgcagtgagctgagatcgcgccactgcactccagcctgggttgcagagatcccgtctcaaaaaaaataaagataaaaacaaaaaaaacacttcagttcctgagtcctgatatacgtcctttccaaataccacataaaagtaaaatgaggccaacatgaaacaccaaaacaacaaaacaccgagaaggtcaggacagagcctgggcgagcagtgcctggtctcggggcggggaagccccgttcaggccgaggctgcggaggatgggtacatttgactctgacaaaatgcgcaatctctgcacaggaagagaaagagtttgcagtgaaagtctggtgagaaatatctgtagcatttataaccaacaaaaaaaaaattcccagagaaatgggcaaattctctacctagagatcccaagagtccaatgagcaacagggggatgaaacacgcttggccttacaggtggcctgggatgtgcacagtacagccacctggtgtcaccattcatctgccggatcagcaatacttacagattttgtaatatcggccgggtgcggtggctcacgcctgtaatcccagcactttgggaggccgaggcgggtggatcacgacgtcaagagatggagaccatcctggccaacacggtgaaaccccgtctctactaaaaatacaaaaaattagccgggcgcagtggcgggcgtctgtaatcccagctactcgggaggctgaggcaggagaatggcatgaacccgggaggcggagcttgcagtgagccgagatagcaccactgcagcccagcctgggtgaaagagcgagactccgtctcaaaaaaaaaaaaaaaaaaaaaagattttgtaatatcaaggggttggcaggttgctgccagagggggtaggttccagccggggcagctctatccacagtggaagaggatgtggctggcctggctgagcctggacatgaggctgcatcaggaccccctggcctggctgaagcccactcttccagaccctgccagggagggaagggggtcggtgcatggggggtgctaaaagcaggagactgtggcccctgcttggcctgtggtcacttgcccttgcctggctgccaggctagtggacaaactctccagccgtgcgggttcccggctgtttacttagcactcatctgagtttatacaaaacccttctggtccaagctctgatccttcattagtaagaggaatgagcttctgggaaaagtgaatggggaggggctgtttgctcagggagccatctgggcaaatggggcaacaggcccacaggccttggcacagaaagtgtatggtgcccccttggtcaggtacatcccatctgatcatctgtcaccacagatcccggcatgagcagcagaccaggggcgcgtccccccttccagatggggaagggggtccaggcagcttgtgggaggagagcctccagcccagggagctcctgtccctctgtctctgcaccacacacctctcccgagggggcaacccgggtcacctgccctgacagcagctctcacgggacctcgttcagcccgtgcaaactgtaggggttattgtgcagtgctgcgcctcctggggtgcaaacagtccctggctttctgcccatggtgggatggggtgcttgcagaagcacccaagggaccctccctggaactggcccactgcagactctgcccatcacctcgaagcctctccttggagggttctgatctggaaaccagggcaatgacctcatccaggggcctgggccaagccgagagggtttgcaaattgatgcccacttaaccactttattagcttctgctgctggtcctcttaaaacatctccagggcttgaggatgctataaatttttggtcaaggatcctctggcagcctcactatgccagcatcggtcacatggcccagccctagacctcccagagagaggccggggcctgggggtgccttttctggaggcgcagatcatacattcccttccttctagaagcagcgtgaggctgcttttctgtgactcggaaccagcgcaccccatcgctcactgcaggtaggaagcatttcgttgcttcatgaagaagtagacattctgggccacgagacagaaggggaaggaaggactccgaggtttagaataagctggtctcactgccgcagatgacttggggggacccactaagggggtggggggcacaatagcagcagcccctgctgttggctgagtccactcagggctcaccacagcccatctgcctcccaggcacagggaaaccccccacgggaggtggggagacctcaggggggtccctccgcccaggaggaaggcttgcgctggccaagtgaaaacacaggaatctcattttagttctagtgggaaggttcgaccgcagcgagggtgggctgggatggtggaggtgtcttgccgcccacttcctgccctgcccacccagtattcacctcggccacttgaacctggagtgggggtgacccgtggggtggggtggggggcgttctctgaggaaacgccgggtggcagagtttgaagatgggggaagaatgttccaggaagaaggaaagtaatcttcgaggagcgggagaggaggctgcagaggcaggaggggctctggtctcactgagggtgctggggctgtccggaaggaggtggcgcggctgggacggggtggcaatggcgaagcagccaggcagctgctacctcaggagcattttgaaaggagaacgagaggtgtggcccacccacaagcggctccctccatgcagcctgggtcaccccatgcacaggaactggccaatgagaatgtcctggccccaccagagacaccaggctctgatccaactcagaatgcgggactccctcagagcgctgcagcctgtctcttgcacccgcagcacgccctgcactccagaggcttcctgcgagccgcttgtgttcggccccacccagtccctctggcctctccacgccgcgccatgccggtccacaccctgtccggcccactcataccatccacgcccctgcacatactgacagctcagtaccccttaggggctgggctcagaacagaccctctaaagaatgaggccggagtggtagggccaggcaggacccacctatgcctgaggctgccgccgctgctgaaccctccgttccccgcccccgtctcctgtgtctccttcgtgtctttttccctgcaagtatgtactttcccctgcaatgccagcgcgttcagaaactcacattccacttttaaacgctgacacccatgacaagctcttcctcaacggcaagcagcaagcccagcttataaaggacaagcggttcggtcaccttccagcccatcagggatcaccactgggaagaagccatggctccgtgggcctttgtgggcaggtactgccctcctcagaggcagcctgcagtgaccgggaggtgacggaggggtgccagcctggggcacgtgcagacacacactacccagcagaaagattccgggcggctcgccacacaaccctctgcctggttttgcaaaaaaaggaccatctgaaggccaccgggtagtgggtggagaggccagtccagagtgaggtggccggcacaaagtccaaggactctgctgccaccgacccccgtggcctgcaggctgaacgcccgcccagtcccacccacccccggcatggcatccccagtgtacctgagactgggttatttatttatttattctgagatggagtttcacccttgtagcccaggctgcagtgcagtggcacgatctcagctcactgcaacctccgcctcctgggttcaagcaattctcctgcctcagcctccggagcagctgggattacaggtgcccgctaccacacccagctaattttttgtatttttagtagagacggggtttcaccatgttggccagggtggtctccaactcctgacttcaggtgatccacccgcctcagcctcccaaagtgctgggattacaggtgtgagccaccgcatccagccgagactgggtaatttataaagaaaagagatttaattggctcacggttccacaggctgtacaggaagcatggctgggaggcctcaggaaacttacaatcatggcggagggcgaagaggaaagagacgtgtcttacgaggcggaaggaggaagagagtgaagcggaaggtgccacacgcttttaaagaggcagatctcgtgagaactcactcactatcacgagcactgcaaatcagcccccatcatccaatcatctcccaccaggcccctcccccaacactggggtttacaatttgacgggagatttgagctgggacacagatccaagctgtatcacccacacaactcacttcagggtctagcgttgccaagggcaacggggtagagtggcctctaccccaaggggtacccctcagtgagggaagtcactggagacagggaggggggctctggaagccttccaagaccggcagacctccctccccactccatgctaggggtagagtctcagatctgcctcagacccactgggcaaaggaaatggatgacagatctactcacagcatctgagatttgcagccggccagggcaggtggctgcacagaggaaggtgccctgcttctggggggcaccacacatttgtcaccgtgggagggagggctcagctcagtctccaaggcggcacaaggccacagcagccttccaggaggacaaccaggatgctcccgttctgtgccgtcaggggctggctctgtatggcagggcctgagccaaggaggagagaggaccagggtgggggaggcaagcagccgtcacatgagagatgagatagagaggagccatgaggaggtgaatggctaggctgggagaatcccaagcctgagggctggcttgaatttgcaatgttgaatgtgggcatcactgggttatggacccctctgcgccccactctgtgaccacacagcagccttgagtgagcaggctcttatggaaatccagcatcctccaggtcacattccacaggagctgatgggggcccacccgcttccacaccatccagggccaggtatgagacccaggcctgactgcttaacaccttccccatgtccagccacagctggcttggaaatggacagagtacagaagctgcccaccccaagggatctcccagagctacctggacagcccgacttttttccactggcaaagcctgaacttgtgaggtatatacagggagctgtgggctttatcctgcaattacaccaggacagtctgtctgagagtggagccatcacaggggagcacagatggaaagagactcctggatccagctatgcctgaaaccaaccgacctctctctggtcacacaaatcaacaaactgccctgtgcttaagccagtctggtgggctggtatcagcgctcagaagcccactcaccaaccagggaccgagttccatgctaggtcaacactggggcagagagaggagtcagttgcatggcaagagtggatgtaagagttctgcagagacagaaaatcagggccaaaggtgaccggagaaatgtaggctcccaagaagtcaaagcactcttgggaaattgagggctgggactgggcctcctccaggtctcagtggacaggaagacctcagctaactccagcatgacccaagttttttaaggtctgaataagggtttgcggtctaggtactccagattgcttaatctcctcatctgctctctttttaaaatttgttttagaaacccgtctttgctaagttgcccaggctgagtgcagtggctattcacaggcactacagccctgaactcctgggctcaagcaatcctcttgcttcagtctcccaaggagctgggactactagtgcggtgtcaccatgctgggcttgatctcttcataaacactgaggtcatttttttttttttttgagacaaagtctcgttctgttgcccaggctggagtgcagtggcatgagctcggctcaccgcaacctccgactcctgggttcaagcaattctcctgtctcagcctcccgagtagctgggattacagacatgcgccaccacgcctggctaattttttgtatttttagtagaaacggagtctcaccttgttggtcaagctggtctcgaactcctaacctcaggtgatccacatgcctcagcctcccaaagtgctgggattacaggcatgagccaccacgcctggcacacttaggtcattttcagttccttactgctagcaatgttccatattgaacatccagagacacagctttacctggtttctgcagctcctgggatgcagaacatgtctatcaattatgcccagtggcccactacccccatgtcagagcccaggagacggctccaacaggagacaggaagcaggaagtatgagttcattctgcacaggaggaaactgagcctgtgaatggggcaggaagttgcctgaggctacacagcgggaaggttgcaggtgtgagcttcctggtctcctgcctgcaagtacaggctcttcccctgacagaggtacttcaggaaccatggagttagaccccaaggtttacagtctggccatgcccagtcttgcagtgactccttgggcgagatcttttccctctctgcatttctgtaatgctatctacagggaatcccaaacctgactgctcttcagaaatctgaggcgcacactgtccaaggagctctagactctacattaaagagttcattaaaatgcaccctcagattttactgtactacagcttttctgaaaaagcagctaacaatgactgagcacttactacatgacatggattaagaattcagtcctcccaggctgggcgctgtggcttacgcctataatcccagaactttgtgatgccaaggcaggtagatcacgaggtcaagagatcgagaccatcctggccaacatggtgaaaccccctctctaccaaaaatacaaacaattagccgggcgtggtgtcaggtgcctgtagtcccagctactcgggaggctgaggcaggagaatcgctggagcccaggaggcggggttgcagtgagccgagtttacgccattgcactccagcctggcaacagagcgagactccgtctcaaaaaaaaaaaaaaaaaaaaagaattcagtcctctcaacaatcctaggaggtaggtattattattcttcctacttcccagacaggaaagtcatagcagatagaagttccatagctttcctagcttctggtaatgttcctgacaggtttcggtattaaaattacattgacctcataaaatgagttgggaaatactccctcatttttagtctctgtgcaggtttgtatgagactggtggtatttttttaactgttgagaagaatttctcaatgaaaccatctgaacctagaattttctttgtgggaagattttaaattacagattcaatgcatttaattggtgtaggactatccagattttctatttcttttagtgtcagttttggtaagttgtgtatcatctaaaatttcaaatgcactgtcaaaaagtcctccatactatctttttatccctttaatgcttgtagtatctacagtgatgtcctctttttcattcttgatagtgaaatttgtgttatcttttttcttactcaatctttctggggatttatcagttctattaatctcttcaaagaaccaatttttggctttgttgattttctctattttttgctttattccattaatttctgctcttatttttattatttcctttcatctttagttttattgttcttttctagcttcttgagtggaagcttagagcagtaattttatttttctttttccttttttttttttttttttgagatggaatcacactctgttgtccaggctggagtgcaggtgggatgatctctgctcactgcaaccttcgcctcccaggttcaagcaattctcctgcctcagcctccttagtagctgggattacagacacctgccaccacacccaactcattttttgtatctctagtagagacggggttttcaccattttgacccggctggtctcaaactcctgagctcaggtgatctgcccacctaggcctcccaaaatgctgggattacaggtctgagtcatttcacctggcctaattttcaatccttcttctaaagctatcaaatttcctctaagcagtgttttagttgcactgtacagcatttgatatgtcttatttttcactgttcttgtcaacatattttaatcttccactgtgattattgacccattgattatttagaagtgtgacatgtaatttccaagcatttgcagattttccagtaatttttctgttattgacttttaattcagagaggacacactgtaagatttcaatccgttgagatttgctgagacttgtataaggtccatgatatggtctatttcgataaacatcctatgtgcacatgggaagaataagtattttatagtgttgtacacacgtgaattaggccaagttggttaatcctattgttcaaactgtgtgaggttgattcaaggataaagaaataaaccagtgggatagagttccgagacacacacacacacacacacacactcttcagctgatttatgttgagatgttggggactcctccaattcggtggaaaaaaaatgatgcttttcaataaatgatgccaggtcaattggatatctacacgaaaaaaaatgagctctagccccgtaccacaccattcacaataattaatatgtaatcaatcatagatctaaatatgagccctaaaacaagcttctaaaaggaaatacaggaggatatcccaataaaaaggtactaaccataaagaaaatattgataaattggacatcactaagagtaactcctgttcatccaaagcaaaagtaaaccacaaaatagaggaagatatttgcaataacttcaataaatgcgaatccaataatccatctacaatacaaagggcatgcgtccggaccaagaacacgtctccagactctggaaagaacctctacgaacgaagaagacaacccaattttcaaatggaccccggggaacacccaggcggctggggctggctctaggtccccactgctctgccttgcgggggccgctccggcctggtcgccttctccgggcgcatccagggaactcgctcggtcctccttaagcggggaagctcggaaagcgtctccccgactccgcccccagggttgcctttcccttagaaggccaagccccaagcccagcctctcgccagctgggagtcgcgcgctgcccacctcgctgcccaggcccccgacgccgcggcaggagccccccaagagcgcgggaagccccgtggacctggcgctcccggctcgggcgtggacggggcgggcgccggggcggggcgcgcgtcctcgcgggtctgaatggaagggtcgaggtcgtcgtcggcggcgagcagatcctgaagccagaactccaccccggcgcccgcgccatgcggcgggagaggtgagcgcggcgggcgtggcgtccgtgccggggtgcccggggtgccacgggaacggcgaggccggggacacgcgcgcaggacgccagcggcggaggtgggcggccccgggccggggcggggagggccgggtcctggcagtcgccgtgggg

SEQ ID NO: 103 - DNA, 15408 bp, Homo sapiens
gccccaagcccagcctctcgccagctgggagtcgcgcgctgcccacctcgctgcccaggcccccgacgccgcggcaggagccccccaagagcgcgggaagccccgtggacctggcgctcccggctcgggcgtggacggggcgggcgccggggcggggcgcgcgtcctcgcgggtctgaatggaagggtcgaggtcgtcgtcggcggcgagcagatcctgaagccagaactccaccccggcgcccgcgccatgcggcgggagaggtgagcgcggcgggcgtggcgtccgtgccggggtgcccggggtgccacgggaacggcgaggccggggacacgcgcgcaggacgccagcggcggaggtgggcggccccgggccggggcggggagggccgggtcctggcagtcgccgtgggggacgcgctgggctgtgccctccgcccccgccgcccacgcactcgtcttcgagggcgggcccggcggccccggagcaaaccgccgtctccccgcggccccaccggtccctggcagcctcggggaatgtctgtagctgaattcgggctctgaaagaaggtggcgctgggtttttaaagatttggggcacaaaaaacgagagcggacccggcgccggctacggcccttcccgagggccacgcccagcccggcgccccgcgcgccccgttccccgcgccgcctccctccacccggctgagcgcttgtgcccgcaggtgcggcgccccccacccgcgtcgccgccatggaggtgctgcggcgctcctcggtcttcgccgccgagatcatggacgcctttgaccgctcgcccacagacaaggagctggtggcccaggccaaggcgctgggccgggagtacgtgcacgcgcggctgctgcgcgccggcctctcctggagcgcgcccgagcgtgccgcgccggtcccgggacgcctggctgaggtgtgcgcggtgctgctgcgcctgggtgagtgcgccctggtgggatccccagctgcgcctcctcccctgctgggccgcagcctccctccgaggccgagatgggggtccggcccaggggcgcccaccccctgcctgggacggccaggcgctcgggacagggccacccaggcgggtgctcccggatctgccctctcaggcctcccacgccacaggcccccccatcagctgcctgctcagcccagatttcagtcatgctggccataaacaatagaaagctccagaaagaataatctattagtgggtggctaagcttccacagtgacccttgttctcagctgggcacagaaaccctttgtaggagcacgtgtcccgatgtttattttggaaaacagattcttgctgttactggccgagatcccgcccgctgccctctggattccgaggcctccgaggcccccccattggaaactgcgcccaccgggctgggtagccaaaacctcagtattcgttggtgctgtgaggacatctgggggtgctcggttctggggtcacacacggtccactggctgcccccaccgtctccaaggtctggacccaagagggagggaccagccccactgtgactgtccagtcccctcaccacagctgggctgtggccgtcacctgggaatgtttatgtgatgcccgaagagggcacatggggcgcctgtggctgagcccgggaaggggaggtgacagcataggtgaaactgaatcggtggctctccaggcagggggttggagtcggagggcacgaccccgtgaggggacacgctgcctcctctcaggctggcgctggcatgggctctaggtggcccctgcccttacgtggtgggctgggcccagagagcaaagctgtgtagacctggcctgcccaggagtgtgtgtggggtgcagacagaatccatggggaccagcacagagcctccaggaggaggtggagtcccatctgagaagttcagaaggagggagaggtctctgggtgggagctagggggttggtggggctccatgagatccgccgcctgctgctgcctctagtcgggctctgagaatgaccctaggggatccttttagtggccttctgaaaagatgatgccagacccctggaatggctgggaagaagtcccagatgtctagggggaccccagagggacacagctcagacctgcatctgccctcacggctgctcagggtcagtcccttgaggccagcgctgtctccctgcccttgggcagtgcagacaggaagaagcccgggttgtgtccccaccttcagtctggggccagcctgcagcagccccggagatctgtgtttgggagctgccgggtcagtcctgggaatttccatgtcgtcccccgcccccagccagcctctcatgggctctgctctgcttccagatcttaattaatgagatacagagcagcctttatcagctgggatggtccggtcagcagcattaccctgtttgctttggctggagaactggccgggctgcggactcccaatcccagggccctgtggcattctcggcaccatctgccccgtgcctgtgcgctgctgctgccaagggtgccacaggcagcactggggcggtgggcctgtaggggccatcctcggctgccaggggcagggctgatgcagtgccacctccaagcacatccccttggcagcaagagcccaggtgggagcgtggcagtgagggtggcccaggacagcggcccagccagcccaggtgggagcgtggcagtgcgggtggcccaggacaggggcccagccagcccaggtgggagcgtggcagtgcgggtggcccaggacagcggcccagccagcccaggtgggagcgtggcagtgcgggtggcccaggacaggggcccagccagcccaggtgggagcgtggcagtgcgggtggcccaggacagcggcccagccagcccaggtgggagcgtggcagtgcgggtggcccaggacaggggcccagccagcccaggtgggagcgtggcagtgcgggtggcccaggacagcggcccagccagcccaggtgggagcgtggcagtgcgggtggcccaggacagcggctcagcctctgcatctgagtggtccctgagccatgctagggcctgagccgggctctcgggctgtcccctgctctcaccccaatgctttctctgcccagcccctccccacgtcgggctcccctgctctcaccccagtgctttctctgcccagcccctccccacgtcggggtctggccgtctgcctggtccctcctgctctgggcagctcggctgcctgtcggctgtgagtcaccagcaggcacggcccacgctctcgcaggattcccgccccaccggcttggccggctaggcttaggggctggctcgtcagaggggcgggactgggggcgccttcagtacttccttggtcttctggtccctaggggccaaggttgggggatggcccaagggaggtcagatggggtcaagtggaggtgggaatcagacaagtgaggaacaggctggaattcaagcatggtcaggtgggggtcaggtgcagggtgtgccccaagccagtcgtgtcccaggaagctgggacgtgggctgcctctcacctgctcttgtgaccacacaggcgatgagctggagatgatccggcccagcgtctaccgcaacgtggcgcgtcagctgcacatctccctgcagtctgagcctgtggtgaccgatgcgttcctggccgtggctggccacatcttctctgcaggtatgcccagcctgcccgtcccatgggacctcagggagggatccagggtctgtggctcaggctcacagggaccccacgagctggcccccacccatcctggcgctgcccagtgcccaccggtgccatctcactgctgcaggtgtcaggagctgcccagccaccagcgtgggctcaaaccacagcattcagggtctcttgtggttctgcaggctggtgggcatgctgagcagctggcacaggcttcttgattggttgtagttgtggtccagcatccgtggggccgcgtgacctgcagtcctgtggggtggcacgtcctagggctgcctggtttcctgcaggggcccccgagcggggcttgggcttctcacagcatggtgctgtgtcccaaggaggagtggcaaggagcaggtttcccagacagctcccgagtagatgctgccaggctgttaggatataccctcagaagtcacgggtaactctgctggattctgatggtcagaagcgagcctcagggctccagcgtccaggagaggggagagcatgggggtccaagcagactggctcccggagggcatccggagaacagcagcgcatctcacctggctgtgcctgcctcacctgtgaccctcctgtgcgctcccatctctgccctggagaggcatctcctggccctgcctccctgctcctgctgctcccggctgtccacatgcttctaggcccacgggaggcttagggcttgtctcccctactcggtgcccgctgtccacttgtccagctgccttggcctggatttgcccagtgtggcttctgtccgcttgccccatgtcatcaggtctggccctgcagacctcagccccctgcctttgacctctgtgaccttgggtcctgtcctggcaccccgtgctatgagctgcccctgggtgtggcaggcgctgggtgctgctgttggggtgagtggtgcgccggccctgatgtggcacctccctgattggcacattcctcagctgttttccaagtgctgtccaggtgctgggcacagctctgggccagtgaaccccggggtgcgcaggattccctgaagcttggaggaggggcatgctgttcccctggggcagttttttggaagacccctgacagcagggaggccttgcacacccttgtctgggagctggtgtgggtccgtggccagtcagctgtgtgactgtggcctgctgtcatctctgtggcctcagctgccttgtctccaggcagtcctgacagcagcaggagccaggcatcaggcgccagaggaagccacaccctcgctgtgggagatgcatcccacgccacggggtgaccctcagagccaggggtcttcagatggcctcgggacctccacccaccggagggcaaggggaagaggccaggagtgtgaggaccactgcctctcgctcaggcagaccccacctttgtggggtgtcctccagctcctctcccagacgtctcctccgacccctggtgggccagccagatggggacagagcggggctgacaccctcggctggaggccaaggcggcgggggctgcgagcattttctgacagaatccggcctctccagtgccacgcttgctcactgctgacctccctggacagaagttactgtggctgggatgcagcggcgacctggcaggctgctggagcgggaaggctgagtccagggatgggagtccaggcggggtctggtcctgcctccgggcttgtcttgttgccacagcatgtgctggagtgcctcagaccacacctggggaggggcagtgacctcaggctgtggtgtggggtcaggaggcggaaccaagctgggtgcgggcgagactccctgtctggcgctcctggggtggcctcagagcctggactctgtcactgctcctgtgttcctttgggagatcgtaaatgaatcctcattggcagtttggctccaaggcccccacgtggcagctgagggtggggggccgggcccaggccaggctgaggcgtgtcatggggcagacctgagtcggctgggggtgcatatgggtaggggctggggagtgggcaggtggtgtggctcaggggccgggtgggcagggggcagggttcacggcacagtgggcagcggaagcatggtggcaggagctggcaagctggtgcccgcccctcctgccgccagggtgacccaggcaggcacggggcaggcagtgggtggggccccggaaggaagccaggggtggaaggcatcctgggctgacgaccactctcagccctcccttggccgacgccggcgcgtgggtggccacccgggtgtctgtctcggggccgctgggtttacgagctgcaggctggctttaaaaggaacagtcatttctgagaatgcagcagcctgcccagaggtggggcgcctcccccttcggcagggagagaggatggggccaggatgcccctacccgcccggccttgcttgagcagggcctggcctgaggtgggggcggtgcctaggaaggctctggttggttctgggagggcacctgggggccagggagggctgaggggaaggggatggctggacgagcgggcacacagctgacggggaatgtgggcggcaccggccaggtggcccgggctatgtgtagagttcagtttaagtcttgttttcactggaaaaccggagcccactcccctgtggtcagcatcccccaccccacccagcgccccaggcttgtcccacgcaggcccggctctggccatgtggcagcccccacacccccacctgctgctactctgaggcggccctgcccgaggggagccacgcaggttgaagcccaagagcctcgtgacctgcaacgggtttctgaacctccctgaaccagagccacctgactagggagctagggcagggccgccccttctgcccctcaggcccactggcagttgcacccccagcccccttcacctttgtccatcccagtcctcttgggcccttttgtctacagggcgagcctccagcctccaagtgctttacacatccttgcctccctgcctgaggcccctcccacgccagccatccctgcacgctctgacccccggtcttcctccctctcctcctcttagcaggcgcccttgagggtgtgcgccctgcccagcccctccactgcaggcaagctgcacagcccgcacctcagggctggggccttggctagtgttgtgagccgtgtgagggctgcagggcagggctccgtgggggtctccaagtctccagccccaggagactcccacgaaggcagaggccaacaaatgttgtttctggctgttttcatttagggcttcaaagttcctgctcaggactttggaaaaactcatctccaaagtggtagaactcaattttcctccccatttaaaagttggcaatagtgtttatttttttctttgaatttgaattgtattttctataaatacatatgtaattttatataattcttctaattatagttttattataagaaaaataaaaatggctgggtgcagtgactcacgcctgtaatcccagcactttgggaggccgaggtgggtggatcacctgaggtcgggagtttgagaccagcctgaccaaaaagaagaaaccctgtctctaataaaaatacaaaattggccaggtttggtggcacatgcctgtaatctcagctactcgggaggctgagacaggagaatcgcttgaacccgggaggcgcaggttgcggtgagccgagattgtgccactgctctccagcctgggtgacagaggcagaccctattctttcttttttttcttttttcttttttttttttgagatggagtttcactcttgttgcccaggctggaggtgcaatggtgcgatctcggctcactgcaacctccatttcctgggttcaagcagttctcctgcctcagcctctcgagtagctgggattacaggtatgtgccaccacgcctagctaatttttgtattgttagtattatttatattattagcagacagagtttcaccatgtcaaccaggctggtctcgaactcctgacctcaggtgatccacccacttcggcctcccacagtgctgggaaaaaacacaaatcagaccatgtcacttccctgcataaagttctcgtgttgctgtgacttcccgtgtctttcaaagtaaacctaagtttgaattcccagctgagctggcccctggcagactccagcccttttcctgccacctcaacctgtgaaatacgccagacacaaaatgaacaagccgtgtgattacacttatgtgaaattttcagggtaggtaaatctacagagacagaaagtaagatgagtggctgccaggggctgtcggtgaaatagggagtgactgctagtgggcatggggtttctcgtgggatgatgaaaatgttctagaattagatagaggtgatggttgcacagctttgtgaatatgctcaaagatatcccacttttaaaagattaattttatggtaatggaattatatcagttaaaaagacacagaagagctggaaggacacagtggacgccgaggctggtgcctccggactcctgtcttcctgtctttctttcccatccacccctctggagtggaaatgttgccatcactcggaacatagtatgttcttttttttttttttaatttttgctcttttgccgaggctggaatgaagagttgtgatcttgcaacctccgccacccgggttcaagcgattctcctgcttcaccctcctgagtagctgggattacaggcacccgccaccatgcttggctaatgtttgtatttttagtagagatggggtttcaccatgttggccaggctgatcttgaactcctgacctcaggtgatccgtctgcctcagcctccccaagtgctaggattataggcatgagccaccgcacccagcgtggaatgcactgttctgatggaaccggacacctcagaacaggttgtcccgcaagccacacgcagtgctgacatcaggctccgctccccgcatggccgtgcccttgaaggaggaacagccccacgtgctggggaagtgcagcgggtagagcaggggctgtgccgggtgtgcgcatcccaccaatgacaagggcaccttcgaggttggggtggcaggaaaagggctggagtctgccaggggccagctcagctgggaattcaaacttgggtttactttgaaggacacgggaagtcacagcaacacgagagctttatgcaggggagtgacatggtctgagttgtgtttttccccatttcttttaattgacgttaaactcacatgacataattatccacttaaaagtgtgcaattcagcagcatctgccacattcccagtgtggagcagccaccagctactagtctcaggaggtctttatcaccccagaatgcctgtgcccgtggccgccaccgccattccccacccctcgcccactgccagccgtgagcctgcgtcccagctctgtccctgactgttgtggacattttgcatccacggactcacactgtatgtggctttttatgcctggcagcttccacccaagcatgtgtttttgaggcccatccatgcccagcctgcctcagagccccatgccttcttttatttatttattatttatttattttttcactctattgcccaggctagagtgcaatggcgtgatctcggctcactgcaagctccgcctcctgggttcacaccattctcctgcctcagcctcccgagtagctgggactacaggcaccagccgccatgcccggctaattttttgtgtttttagtagagatggggtttcaccgttttagccaggatggtttcgatctcctgacctcgtgatccacctgcctcggcctcccaaaatgctgggattacaggcgtgagccaccgcgcccagccatttatttatttttttgagatagaatcttgctctgtctcccaggctggagtacagtggtgcgatctgggctcactgaaacctccacctcctgggttcaagtgattgccctgcctcagcctcccgagtagctgggattacaggcgcccaccaccatatccggctaatttttgtatttttagtagagatggggtttcaccatgttggccgggctggtcttgaactcctgacctcaggtgatctgcccacctcggccttccaaggtgctgggattataggcgtgagccactgtgcccagcctgccttctgtggctgagtaacatccaccacatttgtatccatttatctgttgaaggatacttgggttctttccaccttttggcaattgtgaattggctgctgtgaatgtctgtgactgagtgtttgtttgagctgatttatgttttcataacaaatccaggttggccgctgtatgagggtggattggagagcagtgcttcatctttgcatgtacagtgtcctcaggctaactccctccagggaccactgctgactccctccggggaccgctgctaactccctgcggggatcactgctgggctgcatgttttgtggccattcagatactgccagtgccctcaagctgggcttcccaccaaggtttacaaggctgtgcagtggcctgaatcctcacactgccatttaaaagcatgtatttatttatttatttagagacggggtctcgctctgtcgcccaggctggagtgtactggcgcgatctcagctcactgcaacctccgcctccccgggttcaagtgattctcctgcttcagcctcccgagtagctgggattataggcgcgtgccaccacgcctggctaattttttgtgtatttttagtagagacggtttcaccatgttggtcaggctgctcttgaactcccaaccttgtgatctgcccgcctcggcctcccaaagtgctgggattccaggcgtgagccaccgcgcctggcgtaaaagcttttaatgcaacagattacattttgttttaatttgcctttctttggttattaatgaaggtaaacatttttcgtgtctcttattataattttcttttgtgaatcagctgttccagttctgtgctcatagttcttttttgaaagcctctcttttctcgctcacgtataagacgtctttccgtgttgaggcgtcgtgtcctgccttttattctttcccccgctgtcaccatctttcgtcctctctttcaaggctgctcccatctcagttcagcctcagcaggttaggggtctggggaaggcagtttctctgcgggcctcagcttctttatgtgtaaaatgtggacgccaggcctgttgtgggaacaggcagcccaggggtgccacccgtgaggtcactggctgctcactccatctgctgctgccctcagttccctcgcctcaccccacgttgtccctgcggcctcctgcacagacgtgggctgggcaggtgtgcagtggaggccgagaaacctgcctgcccaagaactacctgacaggcatcctgtcagggagcggtccccccttgggacggtccctggtcattagctggacggcaagcaggacagcggctcagagaggcccagccccttccttaagtgctcccgtgggcgggattcaagtcctgatcttgaccatctctctccctgcaggcatcacgtggggcaaggtggtgtccctgtatgcggtggccgcggggctggccgtggactgtgtgaggcaggcccagcctgccatggtccacgccctcgtggactgcctgggggagttcgtgcgcaagaccctggcaacctggctgcggagacgcggcggatgggtgagcgcctgagtgcccgtgtgggtgggagagctggggtgcgagggtgcagaggtacaggagggagtggtggatgggtgagcctctgagcgcctggggggtgggagagctggggtgcgagggtacagacgtacgggagggagtggcggatgggtgagtgtctgagcgcctggggggtgggagagctggggtgcgagggtgcagaggtacgggagggagtggcggatgggtgagcctctgagcgcctggggggtgggagagctggggtgcgagggtacagacgtacgggagggagtggcggatgggtgagtgtctgagcgcctgtgggggtgggagagctggggtgcgagggtgcagaggtacaggagggagtggtggatgggtgagcctctgagcgcctggggggtgggagagctggggtgcgagggtacagacgtacgggagggagtggcggatgggtgagtgtctgagcgcctgtgggggtgggagagctggggtgcgagggtgcagaggtacaggagggagtggtggatgggtgagcctctgagcgcctggggggtgggagagctggggtgcgagggtacagacgtacgggagggagtggcggatgggtgagtgtctgagcgcctgtgggggtgggagagctggggtgcgagggtgcagaggtacaggagggagtggcggatgggtgagtgtctgagcgcctgtgggggtgggagagctggggtgcgagggtgcagaggtacgggagggagtggcggatgggtggtcacctgagcactcctgggggagatgggtgaggcagggggtggggcaagggccgagacctacaggcaggccctggactctcctctgcccagatccagcactgacttacccccgatcctacccctgtgctaaggacccgctgccccagcccccgccctcccgagtgggaaaagcaaggccccgaggggtgggtgtcagagccaaacccttcctctgtctccacgcccccaacttcctgccctgctccggccagaccgcagttgccgctgggccctgggtgtggagggtggctcccctgccgagagtctagccttctttcctgtacagcgggtgttggcctggtgtgtaaatcagcggccaggggtgacagcgctcagacccctctgctggggccttagctttagcatctcgagagattgaggtcacgtggtctgcgggggctgtggtctcctctgaaggctgaattgggggtgcagagggcaatgtcccaagatgtcgcacatggctacaggtgtccctcagcacagaaaccccaagacttccgtcccctcctgtcttcctcctgtggagtctggcatggggctgggcactgtgtgcccagtgggcgacgacactttgagcaacgccaaggccacaggtccaggctgcagggaaaagccttcatgtattagcaggaagtgaagggaataagagaattggacgttcattcacttccccagaaggaacttcagagtccagggagtccgtgggcttccggaaacgcagtccctgctgttgttccaggcagagtctgaatgaagctgggtttgccccttcctggtagcccaggctccaaggccccacaggaggatgacggcggcatacctgtagcccctggggggcagcaggcaggtggccgaggggagctggcaccctggtctggatgtctggagccccagcgagggccatgaaggcctctctcctgctcggcaggggccctccggccggcctgcctggctgccatctgtccccacctcccgtgcctcctggcccttcacactgtctgaatgtgcacggcatcgggtctggtcttgtgttggagccttcagtccaggccacagacctccttcccgaacagtctcctgcattcccttcatgcaattttgctgatattctggtgcacggtgctggggggcctggcggtgctgggggcctggcggtgctggctctgctttctaacggtctccctcttccctcccagactgatgtcctcaagtgtgtggtcagcacagaccctggcctccgctcccactggctggtggctgcactctgcagcttcggccgcttcctgaaggctgccttcttcgtgctgctgccagagagatgagctgcccacctggcagtggccgcagcctggccctctgggcccaacgcaggaggccctcagcacccgaacacatcttcctcctccccacccgagcctggagcactctaaccctcggagaccccctaagccccgttcctccgcagacccaggccctccggaaggggtgagtggggaggggctttcctgagcctggagctgggctttggggcagcctgcgaccctccccgcttgtgtcccttctcctgtgatctctgtgttttcccttttctttctggggccaggaagtcagggtcaactcccaggcctcagatgcaggggcccagaacacctgctctcacctgagccccaggtgaaggggcccgggaacacctgctctcacctgagccccaggtgaaggggcccgggaacacctgctctcacctgaaccccaggtgaaggggcccggaacacctgctctcacctgagccccaggtgaaggggcccggaacacctgctctcacctgagccccaggtgaaggggcccgggaacacctgctctcacctgagccccaggtgaaggggcccgggaacacctgctctcacctgaaccccaggtgaaggggcccagaacacctgctctcacctgagccccaggtgaaggggcccggaacacctgctctcacctgagccccaggtgaaggggcccgggaacacctgctctcacctgagcccctggtgaaggggcccggaacacttgctctcacctgagccccaggtgaaggggcccggaacacctgctctcacctgagcccccggtgaaggggcccggaacacttgctctcacctgagccccaggtgaaggggcccggaacacctcctctcacctgagccccaggtgaaggggcccggaacacctcctgtcacctgagccccaggtgaaggggcccgggaacacctctcacctgaacccgggggtcccatcccaggaagaagggccatctcaggacatgagtcctcaggggccctgcacattcaatctgaaggtgaccctggcctggctgaagctggaagagctgtggggactcagcctgtaaacagagcgtaaggttcacatgctggttgcttaatccgtttctggaggaagagtatgacacccacttgtgatggggtccttgtgcggtggggaccggggccggcgggctccaggccagcacacctaacccatggatgtggaacctacggccgagaaggaatgttgcatgagtcggatcccagtccattgtcagtggagggtgagggtgaccccatctgctatttttgtgctcatcctcatacaaccatttggggatgtgcctattagggctccgtaagaactcagatgcctgggaagcccagcccctcaggtgcccccacacacagccttcccttgacgcctacatttctaggcacatgtgaggcatctttcctggagccccgagccagccctgtccctccccagtgcagcatggcactcaggagatacaggctggacatggggcagtcgttctggggaggcctggcctagcagccacccacctgagccctcccggccaggcttcgtgctggggtgggccatgtgccaggacaggagggtcccggcggaaagccagccccggactcatcgtgacattgagatcccactggagggtaggggtggtaataaacttctccaaacgatcgttgtcattttagacagaa

SEQ ID NO: 104 - DNA, 153426 bp, Homo sapiens
cctcctccacagtggtgaggtcacagccccttggagccctccctcttcccacccctcccgctcccgggtctcctttggcctggggtaacccgaggtgcagagctgagaatgaggcgatttcggaggatggagaaatagccccgagtcccgtggaaaatgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgtgagtacccgggagagatcagggtaggacccagagatcaagggcatctgcagaggtggcccgaagtgcacaaaagcagctcaataacagcccgaagtagtgtgtgagtgtgtgtatgtgtgagtgaatgtctgtgtgtgtagatgtgtgtgtgtgctaaaaacttaatcgcccacacttgggaaggtatcattgttgacatcctcattcccaacacaggaaaatgttacaaaactttggtgtacaatgaccgtgagagctgttctttccaacaagctgctattcagcactttgcctaaccctggttgaatctgttttatttgaattaataaggataatggcatctcaggaactgacctttttgatcttaccttgggtaataaaaaattgcaaaaatatgtatttctcctttttgtttctctagatgggaggttatcttagcagttctgctgattcatcaaattgttgacaaaggtttaagcaggggccctttttaaaatgaactgtctatacagtatctgtaagttacttactcaaatgtgaactgccagtgaaatagtacgtccagaaccctgctttgtgatagaggtataaagaaatgaaatttcataaaagtatagtacatttatctgcatgttaaatgttaccagattagaaacctgatgttaaataagattatacacacacaacctgtttcttaacagcaatttaaatcagtgatcattgaaattgtagacaaaaccaagggaataaagtctgtcttgattagttaaaaagagaacagaaagaaaggacagtaaaacaacctaggctggttaaatccagttaagataaaaaaaaatgcaggttattaaagaaaatgttgatagatgaaaagaaatgggaaagttgcacctctagattttctcaagaatttagctcatgaagactatttaacagtagatgaatatttgagcacagagatatatttctgtgctcagagatatcctagtgtcttagcacacctgaattaattagttcaataacctccaaacagtgtggtagtcattctccatgctgccaccacagaataagatgtgtaaaaggtgtaatggcctcttgattacacctctacataggttgcttgtcacctctagaataaaattcttttgtgcagcctaccagatctttcaagacctagtcaagtctttccaacctcattgctcctcatttctctaacttccccctcctgctgagaacttctggcacttccccaaaggtccctgctgttacagctgcccttgcctttcttcccactttctggcccctctgcctgaagcacatttcacccatttcttcacccagctaatgcctactcccagatccagatcctggatcaaccctgcaggaagcttctcctgacccatgaccttcaggctgggtaagctataccccccttcccaacagcgttctctgcatgaacctaaccctagcccttagacattgtctactttcttgtaacttgttatttatttgcatgcccactcaagcaggacacaagcttctctaacatagggaactgccattcaaccccgaattcctgaaaccctggaactacttagacactcagaaaaaacaaaaaaaaaaaaacttaagtgaataaataaacaaatgaatatgccaggtctctgaatgtccactctatgttggggagaaagaaatccaaagacatcacttcttcagagacttctttaacagtggcagaaattcaagtcattgaagagagatgtggctctgacagtgaaaaggaactcgtagacatcctgtttaaaattccaccaaaagttgagaaagaaagggtaatggagaatgagcaatggaacaggagtcaggaaaccagcattctctttagcccttctttactaaccatgaaattgtgtaagatgactgatttggaaggagccaaatttccttctgggtaaaagagaatgttcaactaggtgctttctaggtgatgacatgatgctgatgagaatagtctgagggaaggcactgaatcacaagaaaaagacataaagacagtggcaaggaggatctgcccttgagaataatggagagggaggtagtatgtcctgaagaataaagttattctgagatcgaaaagagaaacctgataaaaagtgtgggtaaaacaaaatggtagtctcctttgaacaatggctactaccatctgcaacagtagaaaaatgatttttaaatcttttgggggcggtagaactctttgttgaagaaaagcatatgagagaagtaaaacatgtaaagctaacaattatattgtgtttacttacgggggcggggggtcctgttctcagcgctttgcatgaactcacccagtgaatcctcaccaaatccaattaagtaggtgatgttattatgctcattttatagatgaggaccttgaggcacaaaaataaaatgaagtaatttgctcaatgttgcacagcttgtaagtggtaaagtcaggatttgaatatcatatcatcaactatggagcctgcacccttaagccaccactctcagatgagaagtgtgtctcaccacaccagtgttcccctgatggtcataggctttggagaaaaaagtctgaaaacaagtcacattcagtaaaccgactgataacctcgggggctattcatcagatgcaagaactcagaaagcaggaggttagcagggaaaggaaagaagaaggaaggaagaaagagagagtggaagagaggcaaggaggacaagaaagactaagttagtctttcttgacaagaaaatctagatctttttttacatctttctagacaagaaagatctaagttatggaaggtattccttgctgaaataaaccaagtttttgtcattaaaaagccgttctgggtggtgacctctttttggaatctacttaaattatacaggatctactactgaggcatgttctctcacaagttttgtattattcagagtgtacctctttttaaagtttttgaagagcttacactggtttaaaatgtaaggtattttgttcctgtagagttatttgcattacttctgcaaccttcattaagatgctgtataaccacttcttagacattttacaaattatgatggtgccgagaacaactctttctaaactttatcttctactcatagattattgttctgaaaggtaaacagctctcttgccctactacccatatcccagccccgtggtcttatggatgcaggggagagagttacggactgtggccctcactgaagaagtgatgctgtatcttttcctcactcctcccctccagaagggtatgatgctttacctgagtggaaggtgagggagagctgggatccctacttcccccactgccagtggaacattctagaatctttgatgtgtaggtagtttgaaaaaaatcactctcttccattgaaaattactgatttaaggaaacttaaatgaagcaagagaataaaattaaaaatttaaatgttggcatataattatagatcatatatctcaaaaccaaggataacaagattgacccatcaccctctcttactcagaaagttgccatttgttgcctctgtgcatgagaagatccttccttctctgaataaggaggtagaaaggatttgacaaccattctgcaccactctatgtatttgtgtggattcttcctccagaaagtgctggcacgccttactgtgttgttttaaccctgctttcagtttcattatgacagtaactgctacatctgccttctccaaccccactgccatctgtggtcttgggtttcgacgaagtaagtggtttggacacctgtgtgccttcagatatgtttctgaaggagctgttgttttcaggttctgtttttactcatttgcattctgcatctgtggctctaattgatggactctcctactgtttactaaactgaagacaatcattcatcatctttggcatttgtaccctgtgttccatctgtgctgttatttactcagtatttttaagttgactcgcttctctaactgaaatttatttagaaaggttacaagtggaaaattagcatgacttcgtacaaataagaggtaaccagaaaactaaagacagaaaaaacaaaaatataattaaattctagctacagactattgtctgtgaatacactgagcctacagctgccttctctttgttaaaaaggaagcaaagtaagtgttaataagtattaaagagataacaatctggcacggtgtccttggtagtatcgaaaggatggaaagacaatagagaaaggaattactttctcactgtgtgattcacggttatttaatgccaggtgggcactccacctaaaataatctcacgtacctccaagtcatctttgttccacacttaaagaaatgtggatgttttgtatatttcacaatggttttagtcacaatcagtggttgtaatctgaataacaattgtttccaagctaaagagaagccccctgcttcaacacccacgtgctccccaaacacagccccacacatataaaggtgacttcatttcatatatccaggctctgtgaattattcttttccattctctctctcctctcccatacatatgaaacactgttctaagaggagtgaagaattctgacctgaaagttaaagggatttgatttattcacttggaatgaacataataatgaacaataaaatgtgtccatcatatatatatgagagagaatatatagagagagggaatatatctgtatacctatgtgtatatatatttagacagatatatatgtgtgtatttaaatcagtcaaggtttctgatgataagtaacagaaaaccaactctgtttaggttaaggaagaaaaaaaatattttgaaagaacatgtaatttacagaattactgtaggaccaggctttgaaaataggccaaggcctactgtgggcaaggaactggagccacagtgaatcatctgtttaggacaattccatgggcaatatagaaaccacagccactggacatctgcggtcttgtagctgccagactgtctatgtgctgccatcaataatttcccaactgtccctgtctctttaaatatcctacctgggagtagtatcctgtatgggagcatttgattggctggcaagccatagctgctggaggtaggaagagaaaggtggtcacccgcccacttttggcgtctgaaataggagacgcagaactgggtccttctaatattccacacaacaggggattccccactgaagaggggccatatgccctctacattgctcattacttccttcattctgcaaatctttactaaggactaactatatcccagacactgtgtcacactctggacttaatggagaacaccaccaacacgtccctgtctgcagggatcttacagtctagtgtgggagctgcatattaatcaaataattacataaacacagagttataattgtataagtgtgcttgagtatgctctttgtaggggtgagggatatttacttaaactgaggttcagcgaaggctttgagctacctcctgaagaaccagtaggagttgagtgtaagaagtttcagtggagcaggtagaaggtggagatgtggtgttcaagagctttgaagaattctgacctgaaagctgaaggggtttgatttattcacttgggatgaacatattaatggacaataaaatttgttactactcccttcataactcagtacaggttgaggtgaattctgatgtccttgggagcagtttctatgcacacacaaaaaaaacagttaatgggggtagctggcttcgtaaattaatatttggtttgttaaagaaataaatgtaaaacctagttctttattgagttttctatgtatttattattttgtttggaaatctaatcgtaacaattactttgaggagtattttatcatttaatattttaataactgatttcccatatagtttaatcaaataataaataatttaaatgaaaacaaatttaatgtattttattttaaagtacttgaatgcttgatgaaaccttcccaatccttagaaaatttgaaaacatctattatattaaactttataagtaccaggaatcctatgtttttagattgccaaactctggagtgagatcctccgggttgaatgccttggtctgctatttcctaaatatgctttgggaacattgcttagttcctctgggcctcagtttctccatctataaaaaaagagtaataataggccctgactcaccagattcctgggtggtatgaatgagttaatactgtcaacagataattttcaaagaaaggaaaaattgtaactttcatacacctataaattgaacacatgttaaagattttaatgaactcattgatgagtgtatatgaattgcctaagattgccataacaaagtaccacaaactgagtggcttaaaacaacagaaatttactctctcacagttctggaagctaaaagttggaaatcaaggtattggcagggtcatgcttcctctgaaggctcttgggacaaatcctttctggctcttcctaggggctggttgctgttggcaatccatggcattccctgcatcactccaattattggttttaggctcaccctcattcactatggactcaacttaactcattacatctacaaacattgtatttccaagtaaagtcacattttgtggttccaggtagatatgaattttgggggcatgctttaacccaccataatgaagaacctggtaagatattacaactggcttaaagggtagcccaccaactagacatatttataaattaggaatatcagagtgactatgcagatggaggccaaactagcttcttccctagtcagggagggaagttcatagaagctcttccatacgggacagaatttacaatccgtagacaaaattgttttgcattgctacaattatctacaatctagaaaggtgtaaaataattcccatagaatcagactgagaaacttggaagggtgtgctctagtcaattcacagcttttcattgaaacacatttttccccagtaatacatgcaaaattatagaaaagttaccacctcccagtgagcactatacaagtaaacttattaaaacctctaatttccttttcaacttaaatcacaagtcaaaataaattactcaattatacattttaaattggaatagcaagaccaatctattagatatcccaagtaggtcaacaacttctgttaatacaaatactcaaaataccaaatatatattgattattcttaaactcaacacaaacatattaatactatgggtctgatttagattctcatttctattgttaactctaaattttcccaagctaaaaaatgtttattaattttaaaaattgatcttcatcccctaatgaactccaggttctttatggaaccatccactggtttccaggttccatatagttagggttgccctatccaaatggaccctcctcttacacctgtaaggcagaaaatatcttttctttacccatcacatggtgcatggctgagaccctacaacaacaacaaaaaacagattgacaagaaaaaaaacattaaacaactattaaatataagttttacatgacacaggaggcttcagtaataaagacccaaaggaacagagaaaactgtatctttttatggacagtcatacagattggaggacaaaaggatatgatcgaatggtaataaactgtggtctgtggggcagatcttagcaagtcttatttgttcaaattcatcttgatgtctttgtgtcttcattccttttctcctggtgtagggagagcccctctgaaatgagggtcttaagacctactttagaggaagaccagagaattgtctgatgacctgactcaggggagaagggcaggaaaaagtcggagagaccttctgcttctgttgttttctcaaatgccaaggtgtcacatttggggatagaatgtcttgaaccccattacatctgtcattcaagtgtagttaatagcattcctttcactctcaaaggtgtcccaatttgggggataaattgctaatactaatagatcttcctattagaccatgaagtccagaggcccgtgggacatgctcagccttgtgtttcattgccgtaggtgggagtctatcacttaaaagaaggttggtctcagccaggtggggtggctcacgcctgtaatctcagcactttgagaggcggagcgggggcggatcacgaggtcaggagatcgagaccatcctggctaacacggtgaaacccagtgtttaaaagtccaacctcaacaatcagatcagttttgatgaggccaagaccattcagacatgatatcagaggcatagatccagaatgtccagttattttcatctgtgtgaacaaattagctatcctggggcctaagtctattctcttagatcacctctgatgaagtagtaagcatagaaaactaattcgtaatacataaaacatattgttaaatgaattagttttgtctgaatttatcagtcaatttactagagtagtagttttttgtccagagctgagaaattaagttgaattgatctatttgattatttcagtgtttcctggttatacaaagtgtgtttgttacccttcagactaaggtttattagacaaaagttcatgggcctccaggagttcatggttgtgctcttaggaatctgtggttgtgtgaaaatttgtccccatcagtgcatttctgagactctataactttccttagatcttcaaaggtgtccttgacccctcacaagttaagaaattctgctttggaataatttggcattttgtaagtgtactcactatgactcaatctttttattatattacaaacaaccctaacagacatattttaacaataaatgaaaatcgcctgacctttgtgtggcaagctgtcacagttagttactacttgagactgtcatttcaacagttactactgttactacttgagaccgtcactaggacagttactactgttactacttgagaccatcattgtgagaatgaacaaaggaatgaacgtagaaatgaaaaagtaagacgaaactgttttaaagaaagtgtccaggggaagaagaagagagctccctgcttctagtgagcaaaggcagcccctgagcttccacagccctttgtatttattgggtagcaagggcagggaggaggaggtaacgattggtcggctgcttaattgatcatgggttcatattgttactaacaggcttcagatgtacctaattacaagcaacactgcgcttggggtgtgactgccctcagcattccttctgggtggaggacgcacttttgtcagtttgccaacattctgcatttatgagaacagtttgctgtttactcatagagcctccagtggtatagtgagttgatcacgaccctcactctttcagcctgcaacacctttgaatgtcatggttttccttctgaacatgttattgtggtgattactttcttcatggctcacacttagcctgtcccttgataggctcttcacacagaagttcactgaatgttgccactttttcaagtcaatagttgacagattttttcaagtttctaatgcctcctacatgatggtaaattcttcatactgactctgtttccatttttactgaagctggtcaacatacttaattactctctttcattacattaattaaaaaatagcatttgaaaattttaagaatgagcaaaatggtcccatttgttcaaaattatagattgagttttaaagtgttccatttagatatcagaccctacttacttggcttcatttctgtatgaacctttaagaacatttagggtattccagaaattttcaaaataattttttaattacaaagttggcacttgtgatttttaagacatcttataaatattgttctcttatatgtggtgacaggtatatgtgctctggatttttatagcacagtcccactgaaaagactgccatcagaatgttccagaaattcaaatatttcatcatccttttaatctaaacttcccacatcacttgcacacctggaaagagcttccttatgtccaaatttttctttcagaaaacatgatctctgtatttatatgacacatgaagcttttggcttatattttgtaggcattaacttaatcttacccatgcctgtgtgttctcataattatgcaactccagcgaggagactgaaattgtttcctcttattgccaggtactgtcactttatattttgttatttcaatctttttttaagccaagaaactagaaggctacttttaggaaagggctctgtgcatgaaaataaagaggatctaaggacgggcataaatgagatactcttccatgagaaagtctttagtgggctttgagatggcagtatttccatctcaacacccttggcagttatttctgggtttgtggacatgatccaaagatttgagatgaccagaaatactacctctagataggtggcattttattgtaaaatgttcttccttctttccttttttatattttaaataaatatgtattgatcacctatcatacactagtactattctaggcattgatatataataaacgacctcattgattttacatcataacaggagaaaatagcaaaaaaaaaaataaaaatttaaaaatttaaaaaagtaaaacagagaatgtcagatggtgaaaagtataatggagaaatataaatgaaggaagagggagaaggaatactggaagttgcattttaaatagtcagcaaggtgtcttagtttgggatcctctaacagaataccacagactgagtggcttacacaataaccatttacttctcacagttctggagactggaagtccaagatgagggtgccggcagatctgttgtcttgtgagggctgcttcctggtttgcacttgaccaccttctcattgtatcttcacatagcaaaaagccaagctcacctctcttgtgttttttattataagggcactaattttgtcataagggttccacactcataaacgaatttcctcccaaaagccccatcttctaatactatcacatcagagattaggatttcagcatatgaatttgggggacacacaaacattcagtccataacagaagccctcactgagaaaatgacatttgaataaggacctgaagaagctaaaaaaggaatccaggctaatatctggaggagaaaaaaaaattatatatatatatgtatgtgtatatatatatatatatatatgcttatttttggaatgagataagaagctattaaggattttgagccacacacacacacaagcaagacctgacttacattttttttttttttttttttgagacagagtctcactctgttgcccaggctacagtgcagtggtgtgatctcgactctctgcaacctgcacctccggattcaagcagttctcctgcctcagcctccctagaagctgggattacaagcatgtgccaccatacctggattatttttgtatttttagtatagatgggttttcaccatgttggtcaggctgatctcgaactcctgacctcaggggatctggccgcctcggcctcccaaaatgctgggattacaagtgtaagccaccccgcccggccctgacctgacttacattttagtaggatcaccctagctactatgtttcttaatcgggtgagagatgatactggcttgaaccagcttaattgcagggaatgtggtaagaaatttcctgggcttattttggaggtgaatccaacaggattttctagcggactatgtggactttgagtaaaagagaggagtcagtgatatcttagtctgaattctccagaaagcagagcccatgtgagaattcttgttggggagtatgatcccaggagcagaaggtaggatggggaagtgaagcagggagagagggagagtttgctgctgctagaaacaaatggttgctgaaacccctgagaccacctgagaattcagatgacttgcatctcaggacccttgctttaggaaggaggaaaggtaaaacatctatccatcagttcttggctcccatgagtcagggatttaattctactgaccttccaggtttcctgtgcctgggtgatgaaagaatttcctgatattaacaaaaaagtccccaggtgggagatgagaggtgtgtggtacagggctgagatgcagtactgtcgagttgtacctgcctgaagctagtcagagctcatacagaactggtagctgcagcagggctagcataagaggcaagctgagagaatctaaaatgatgtaaaacaggtacccagggttggttagcctttgcacaactcagacctgcccaagcttttcattatgtctagctcccataataaaatatagggcctccgattttgtaagaatgagatgtccttactttttttttttttattcttacaagaaaggggaatacaagccccatcttccacagattccttcaagatgcagtccttgcaaagacataatgcaagagggtttgggaaataaactagtctgccctgctgcagctgatcttaaggatgccattgatagtccttatctctctttgactccaatcctagatttgtctcacccttgcccagcactctgactggttgagttgattgcctgatggaaagacccagacttcagctccaagggttctgaaagcttagttgccttgttcttgtcatatatagctgctgtattttctccttcaccattatctgtgggctcaaaagaaccaagagatgccccagtgaattccctgcattctagacacactccttactcttcctaatgtgtagcagctgccctagcttctcatggtaaagagggcctaatatttctcaatagagaaactcctttatttacctatttgtcctctagcatgagaagctcaaatgaccaggtggtcattatagtatcaacctccctgtattggaggaggaagaagtaatctttctcctcaggaactagtaccattaattgggcaggaatacagacaggaagctcaaaatttgaatgttaggttactagggtgatggtgagatgagccaattctatcattgcccccgggttttcagacatgtgtatcctagctacatagaacacaatagcatatgttggctattgattcagctcatatcctttcttagatcagatccccaatcctgcagggctttgtccccaagatggcaccttagctgagtctttaattcattccaccattctcgtaggcagtctggttcttcatgacagggcacatagtgagactagtggatatagtgttcatatgccctttgttgcaccttctctgccatgaaatgcatcccttggttgaggcaatgctgtacacgttttcatactggtagatcaggtattttataaacccttaaatggtggtgccggtggaggcattgaagtcagagaaggccaaatccaaagtaatcatgaggttttaaatgaattactatttcttacagggtggaaatggtccagtataatcaaactgccaccaaatgactggctgttctctttaaagaaatgtgccttaccaagggtgcagcaatgggctatactgctgaaaggttggtcatttacaggagaagtatcttgattagacttgatgaaaaggagcccaagccattgggtccatgcttggcttccattcctgtcaccatgaccacttcattcatgttcatttctccaaaactggatggcatttataaaatgagtcatctagtctacctgggtgttgagattcaccgcaaaccagagtaatcagtggatactctctgatgagcattaacgtgagacacaaaggtccacagaatttgttcccacccccatagatatagccatatttgtttcctagactttcttgttctctgttttccaatagtattctttctaggccagtggtcaaccaggtaaattacttgctacttcttggtattccatgtatacccttgccacggttctttctcccttcatacaaaaagaatgattgctataatgctcacagatgaactgactgtgaagatttcccttcaccactatcctttagggccacccttgagtggggctgtaatgcagcagtagttcattttttttggctggcattagcttgtgccaatctgtaaagcagacaccaacctatgaactccatcaagtggtcatatggagctctccatgaagccaatttcagtgagagtgcagcagaaataagtgaagtgggagtctaggccacctattcatgaatttaccttccctttctagactttcttgatccagaatgtaaaatttctatcataaaatcaattgctgctgtgctcaccttattttatgtagtagaactggcaatacccaattcacaatgggcagctgtagtcacagagtcacttagtgtcccattgaagagatctcagtctctactagggcagaatagcatgtcaggaattattttcctcataaagggtatttctgtccttcagaaggcagatccttgctccaaaactttaagagcctgagctttcattctcttcttgggacctgctggcgagtccacagaatatccttgtccaggatggatatctgtagtgttgtaagacctgctgggctgggctgtatggcccacatggcagggaagctggcatttcagcctgaatctgttatagactcttgtaggtcctacctgaaactggcagccttctgagttatctgataaatgggaaaatgggttacactgctgccaaaagccaagacgcccagcaagtgctgtacttctttgtaaaaggtagaaagggcaagatacaactgtatgtcctataccttagaagggatttttttgtgagacagggtctcactctgtcacccagactgcagtgcagcagtagttcattttttggctggcattagcttggcttgtggcaacctctgcctccaaggcccaagcaattaccctgcctcagcctcccaagtagctgggattacaggcacatgccactactgcccggctaatttttgtatttttagtagagacgggtggccaggttggtcttgaactcctgacctcaaatgacccacccacctcggcctcccaaagtgctgggattacaagcgtgagccaccatacctggccagaagggattttttagaatgccgcagactaagcatgttgctaatggaagaggtccctgaatctttgtgggatttatctgctgcccccaaccttcagatttcttactagactagctaggcttctttctactttttgcccaccaactctaattagcatatcatcaggtagcagaccagtatgatgatgtgcgtgatgtccagattatccgtccccacaaactcttatgaaatggaaccccttgggcaaagcagtgaattggtattgctattgttcctagataaaggtttactacttttgattctctctattgataggaatcaagaagagaacacattcaccagattgataatcacatataaagtgctacaggctgtgctgatgtgttccagtgaagacatatctggcacagcagctatgatagaacctacctattggttaagtttgttaaagtgcattgtcattcaccttaatctatttgtttggggtttttgttggttttgtttcttacagggggcagataggtgaattgaaaggatatgaagcaccaccattctgcatcctttaagtctttcaagttgacactaatatctgcaatttatccttggacatactcctgtcagtataagctcaaaccttgtatccaatgatcttcaagaagccttggatttctgtttaccagttgacagttactttggcaactggccacaggtcccttttaggaatgattgggggacagtcaccaataatacttgtagtggtatacactttccctacacttccctagggggatccagcaacacttttaatcaatgaattcctggttcctgagacattaaagttttaaaatatgtgcctcttaagatgatgaaatatagtaacttgatgtggttactatacacagtactagagggaagaattttccataacacaaatgtttagatttaaattcatgccttgaagccagataaatgaagtataagctataattacaaaacacctagttcttcagtgtttggatttatgaaaattgccatgattgttatctattgtgagttattaatccaagttacttttattacattttaacagttttagctataacataaattccatgggttttcgtttttgttttttgtactaccttaaaaaaacctatcattgttctgtggggttttttttgctcagttatgtgtttgtatcagctttatgcccagacccatactatatgtcttcacatataatatctcagtgttcacagtggtcttccttgggaggtgtttgactctcatttagatgcaaaactgagacccagaaatgtcatcttttttgacttttatgtcacagctggtaagtgaaagagtcagaattcaaattcatgtctcccaactctaaacccaaagctccttctactattccatagctatcttcctaaatctggtctattttctctccctctccctcccctcctcctctctcagttgatgtgaaattcacacaatataaaattaaccattttcaagtataactaccattcagtggcatttagtacattcacaatagtgtacagccagcacctgtatctagttccaaaatattttcatcatctcaaaggggagctcgtgccgattaagcagtcattccccattccccactcctcccagcccctggaaaccaggaatctgctctccgtccacatgggtctacctattctggatattttgtgtaaatggaatgctaccttatgtgacctttgtatctgactgctttcacttagcataatgctttcaagtttcatctaaattgtagggtgacaaagagtatgggcaatcagacaagtgacccaaagggaaaacagatgtaaacaggcctggctaaagcttgcagcaatttttggacaggttcatttctaacacatcaatgtagatagcagccccattccatgctgtaataccttataccttagatacaaaaatctgaacatcaaaaaaatctgcgtacttggccgggcgcggtggctcacgcctgtaatcccagcactttgggaggccgaggagggcggatcacgaggtcaggagatcgagaccatcctggctaacacagtgaaaccccgtctctactaaaaatacaaaaaattagccgggctaggtggcgggtgcctatagtcccagctactcgggaggctgaggcaggagaatggcgtgaaccccggggggcggagcctgcagtgagccgagatcgcgccactgcactcacgcccgggtgacagcgagacgctgtctcaaaaaaaaaaaaaaaaaaaaaaaaaatctgtgtacttattctcagaggcttagagctaccaaacatactttcccgtgtcgaaaggttttaagagttcccatcttgtgaaggaggctgtttctagccagttggcagaggaacactatgcatttatcccttctggatctcatggcaatcttaggcaacatttctagaaagcggcgacttaatagcaatgcatgaagccattattcataactcttttagagtcaatattcatgcaaagggcttttctctgttataaggaagctgaagaacaattctaacaatatcctatttctatcgatgtttcttataataatattggcttctatgcctttttttaaaatctccattaacaaatttaaccaatgtgccaaggaagaaaatttgctgtgaattggaaaatgtttaaatgagagacataaattattcttcaccttatgtttaccagagcttacttctcagttatttttccccaacctgctttagatgtggaggcagaagaggtgtggtataattcttatctcccaccatcgccctgggtgggagattctatttactcaattcacagggtgaacaaactagtaagatctgtaaaatctgctctccccacaatgagtgattatacggagctcatgagctaatgctggtagcatgatgtaacagaatacgccttgatcacaggttagctattattactaatgcggtggtaggtctgagagcctgtcagatgtggcctgatttaaccctcggtgtgagcattatatcaatttgtggagggcaagcttccatgcagggaccatccagcagctgtttggcatcagggttgcacagctttattaggaagagcaacacttgtctacttttcaaaggggacattttaaagacttccaagagttcttatcttcttccagatatattcattcccagtagggtaaagggactgaaagtctaactagggggtctctgtgccaatagagcacataaatctgtaagaatgatttatctgttctgtgtcagagtttggctgaaaatcctgttagtactgccaaaccctccagatgcccatatttaatgcttggttggccttatgtagcataaccaaattgccatttcacaaccaccctcaatccctggaatctaaaacaacaaagccagaagctctgaaatgtgctttatgaagcatgaaagaatcttttaaggctctgtctgattcatttctgtgtgatgatagaaggtctaatgtacttgtgaaggattccttttactcgtaagaaacttggcactttatagaaagtatgtatttcatgaccaaaaaaatagggtggcttggagggattgtgctttctttttgtattgtatccaatatgttcagtatcaacagcagcaaaataaagaggaaaaatatctggtataaagctatgtcagctaaaagtcacggtgaagagcagaggacagttttccactgaattcagggaaattattgcatgactatgtgaaaggactacttacacagtaagagtgctaagtagaaatggacagtggaagtcaggagaccttccataagtcctaagaatcttagcaaggcacataatcattctgtgtcttaccttttgtatctattaaaggaaaaccataagatggtcatgtcctatttcagagaactgttaggaagaccaaggacatcattgttcaaatgttcatggagctcttcctattcagggacaatcttccccattcagcagagtaagactatggcaggttattgtttgtcacatattttgaagaacacaaatgtattatacagggattctgaaagaacttgactattaaaacaaagcaacacaaatgaagtatttcatttaaaagaatctacacccatccttttcttctccacttttgtagcaatacaaaatgagtccctccacctacatccatgttcttttggtttcctcaccctattttgactttttcctccctctcctactctctcagatgcttttcacagctatctaaacacactcaagtatctttcctctaaaaaaatttcactccaatacgttctcacatttgcgtccacctaccactccttccctgcctctatccttcccttcacagctaaatgttcataaggagctttctcatgttgctcttctgatttttttactccccattcaccatttagcttggtgcaatctggcttttgcccccattacttaattgaaaaaggtcttgccaaagtcatattaacaacctttgttgcaaaatccaaaggacattttagattctttcctaagttgaatgctcagtagcttttgtcactgctgactgcttcccttggttttctccacatcatactccttgattgcctggtgccttacttcaggtcttctgagcagcacaggaggcagggctgctgttgcataatggggaggatactgagctggttaggtgtgccaactgcactccttgcagcttaacagcaaatgcattttttttttttttgagatggagtctcactctgttgcccaggctggagtgcagtggcacaatcttggctcactgcaagctccgcctcccgggttcacaccattctcctgcctcagcctcccgagtagctgggactacaggcacccgcaaccacgcccggctaattttttgtatttttactagagacggggtttcaccgtgttagccaggatggtctccatctcctgacctcgtgatccgcccgcctcggcctcccaaagtgctgggattacaggcgtgagcaagtacattcttaaacgaagccctcacttccacaacagccacagcccaccccttgcaagatacagatctggttctccacatacctttggggaacaggttatccaggattccagtgggcctgtcttcctgaggagaagcttgaaagaggtaacttagggagtagtctgacccctgttgcagcggttggtctgtctgggatcacaattggtacttatcatctctcttccactgttcattttaaattccccctcagctttcacctctgctggtcttgatgacttatctgctgatatgatcaaagccttcatttttgagggcctgaacccatagttaccatacttttcttaggctggggttattgcacttgtttgtctatagtcacaattgagcaagtatgtccaactggatcatctgagttccaaatatatttctccctgtcctcattgtgtaacagcagccctgcttcttcctcctgatcagggtcagttactcctaacaagatattgacttcttcagcctgctggtctctgtatacaagaagtcctgaatgcccaagtggcagtcatagcctgagttctccacagagcctagtattataggaagaggaaacacagactctttcagcgaatcattgaatgtgataagtggactctctcctgcttctgcccaatggttcccagaccaatatattcttcctaattgggataacatccatatagaggtttgtgatgcagtgtctagcctgcatgatgataccccaccatggcagatgccatgatgtaggcaattgcctacaaattggcattccggttgtgcctttggtaggctcttgcattgctctatagagctaccttctctggattatgtgatatgtgataaaaccagaggatcccatggtcacaggctcattcgtctcctcctctgtgaagtgtgtctctcatggtcggatgctgtgttatatggaattctatgtctgtggatcactttcaaatcctccagctagtagtgctgcctgggactttgtaggtaagaaaggcaaacagttatctagaataaatgtttactaccatgacaataattcacaggtccttccaggaagaaatggctcaatgtgtcataaagtggccatgtgatccctgttgtactgctcaggtttgatccctggtataccactttccactagacaaattgctgctgagtctgcctgacattctgacttaatgtattctacagagctcagctcacaaggggcagtttagaatgcatagttactggcttccatggtcaaatattcagtctcaaacagggctcagtagcaccccaagagatgtttttctgcactgcagatggtgtggactcactctagaaatccagagtactgtattttgattcttctatgaaggcttgccacaaactccacaccaaactacctcttttttcacttttcactcttccaacacaatagagtctatgagatcatatggcccaagaggcagggctgcttgtaccacagcctggtgctgcaaagtcctgctcaggccctattccaagttgccagacttacatgttaactgatacatgggcgaagcaatctttctacagtattcaattcaatgaataaatcacagcttatttgtccattttcttagatataaacaaaagtataactcttaactgtaagttctgagtttagtcttcagctctttctaatatccccttgcaccagatataggccttctcatacagtgttcaattgcttgtcagttgctgtcaactttatctcagcattagctggctgtagtagcttcaaacttaacaaaaatccagctaattccttcatccttgtattcattgctttccttcatcttccttgcctcctcctcaacaacatccctccaacacacacacacacacacacacacacacacacacacatgcatgtgcacttttctaaagcatgaacattgcacaggccaggaaagttctctcacggaactttcttccaagccatcattgattaaagtttttagtaattgggctgccaccctgtgccagagactatctgtgccccctgtgccacccagaatgggatcctcatcaccagcttgcaggaagtgatctgctcccaaaacctcattttacctcctgctttctcagaccaattccagtaccaactgtatcagttcagttattctgggaagcagatgctgagacagcgttaggagtgcaagtggttcattgaaagataacatctgtgaaagataaagggggagagccccagactgtgctacagagctgacaaaatcttggccaaaccaatggggagctctagagcaaagactgcctgttagagggacccacattaggcatagaagccaggctctagcaccactgccatgctcagccctgggctgtgggcttcccgggaagagtagagccttggttaaaacactgtgacagttcctgcaggtgctgcagatggaggctggcagctaactgcctcctgacagttacacagaaagctgtttcctggagggagatctgagtggtgcatctctgtggctgccatacccattttctctttcatcttctctgtttgcacatctgcctttctgtaccagcttctctttcttcctctacctatcatttaaatgatgctggatggttttgaggttcttatctcatgccacacttctccagcctcgcctactcccattcatacatctaatgagattctaatgaatttgaatttcagatctgtaagccaggtctcttttctgagcactaaacttatttcatccaattgctcactaaaatatcatacagtgtccttatatttaacatttccaaaggtgacattattatcttcttggccaaaactatctgtatacccatctcagtgaatggatccatcggttacccggatgctcaaaacagcatagtcatctgcaacaacatggatgaacctggaggatatcatgttaagtgaaattggccagacacagaaagacaagtggtgcatgatctcatgcatatgtggagtctaacaacattgatctcgtagaagcatcatgcatatgtggagtctaacatcatgcatatgtggagtctaatgacattgatctcatagaagcagagagtaggatagtggttaccaaaggctgtgcagagggtagggggaggaagaaatgaggagaggttggtcaacaggtataaagttacagttaggtaggaggaataaattctgatgttctattgcacagtagggtgactatgttaacaataatgtattgtttatttccaaatagctagaagagatgatgttgaatgttctcaccacaaagaaatgataaatgtttgaggtgatggatttgcaaattactctgatttgatcattatacaatgtatacatgtatcaaaacagcataccgtattccaaaaatatgtgctaattaaaaataagagaaaactaaaaacataaaatcagtatttaaagacaaagaaaaacagacacataggattattcttgatactttcttctcactcatccctaatatcaaatccattattaattattactagtctaaatatatcttgaatctgtctccatttcatttgttttcatctgagttctcaccactaacatttttttccacctgaatggaaatggagtttcttttgttcttgctaaacacagcagtgagggtgatcagcctgtactgcggatggggtctcggtctcttgagtaaaatacgctattggcttccattgctcttcagaaaatttcagactcttcacatggtttatgaagtccccgtgatctggccctgcttgcttctctttgcaggcagatcttttactagtttccctccactttagtcacttctattatttcagccactttgaactatttttatattctagaattttatttcagccacttcgaactatttttacatcctagaatgtgtcattcactctgctgctcttattgcttgcacaagctattcatttttgtgggaacattctttatttccactcttttttttctataattaacccttttccatctttaatgcatatgaaagcacaaaaatagcaacacagataactatgtgctaccatcaaaattaaccagaagttaacaattggctttaacttaggtttctcttttattttttaaataaataaaatgttacagcaacaactaaagctctgccactatccactttttccttctctccccacgcagggattaagatagaattttactgttattgtaccctctcttgctgttaagaaatctgccaccagctcagttatccttctcttgatgttttcatctttgacttttatttgcttttaagatctctttgtctttaatgtttaacagttttcctgtaatatgtgtagatattgatgaatttttatttaccctgctttgaattcattgttctattttgaatgagaagttcttagccattatctctttaatattgtctgtcctcattttctctattcttttctcatgtgagtcctattagatgtaagttggatcatccatctttcattcttgccttttaacttctcttttgtgttttctaatatgatatctctctgtgctacattttatctggtttcttagctttacatatatttccaggccactattcttcagctaactactcttctgtctaatccatttctgttatatttcggttgtctgttctgtttcatatatctgttcatttttgtggttttgatcatgtcttttatgtcctgaattagtttttaaaaaaacttattttataatcactttgaaatcattctattctctgtaattcttgggggtgtcagtttgaaaactgtgagatcttaatggctctttcatggtgaattgttacctttttattttataatttaggattataaactcatttatcattgagaaaatggctcaaggggagttccacaattgtttccaacagcaacatcagggatttcactgctcagggatatattttatgatactatctcagcttgggaggtgtctcagccatccagtagtttaaatgccaaccaaaacacacaagtttatgggcaagggcatggttccagattctcaagaaggtttttttaaaaatagaatattgagtttgatgcagtggcgtcaggagcaggacgactctttgccattcagatcatggggaaagcagtgggaatccaagtgaggagcagccagaggacaacagaggagaggatgggaggctgatgacctgggccctgggcgtgtggaggctgtgactcttctctagctagaggactcttcttttgtgggaaggatagcatcttctgaggacccttgctatgtgagcaggctgacataggtggtgatgaggtctgttcctttctaggttcctgtagagatctgtaggtagctgttcactagggagttaactaagaaagagaacaaaaactattcatttggatccaaggtccatcaccgctggtagctgtggtggctttggattgtcggacgaccatcagcttcagcaggtctgcactagggaacaatcattcttccctagcccaagcgtgcctctgccctctgtatcgttgacagaggctgcatgtttggcaagagaacatagtgactgctgaactgaaagttgactctaactctcgctaccaagtttttccctgacacagtgaaagagtattaagacatcagcctaggacaccttgagaaccaaggacaagatggacagggccaagtaactgggcttcaaccatgactgggactaagaataagacaagaggccaggccaaagcggaaaagagtctgctatacaagctaaagctggagaagagagggaggctacgggtgtggttaggcctgtagccaatacctgggccaaagcaaaagacaagccagggtctctgacagatgcagtggcagagatgaaggcagtgtctaagaacaaggtcggtgctgagatgaaggaaggagcccctgtcagagcctaaggctctgggcaaagccactggagatttcagtcccgaggctgggaatgagtccaccagctccacatgtaaaaatggggctggtattgatgcctgggtctgggctgaggaagaggccactatcaattcctggttctgaaatggagaagaggctggtaatcattccggtgctaagaatgataaacctgaaattggtgcccaggtctgtgctgaggagttggagcctgtgactggggccagttgcaaacctaggtctggggctgaggaagaggaggaagagaatgtcattgggaactggttttgggaaggagatgatgctagttttgaccctaatcctcaatctgtgagtaggatagttagatctcagcctgtggatgaaattaatggaaaaaaaaaataggcccaaggactggtctgaggtaactatctggcccaaagcccctgctgtaactccagcagtattcggattagatcccaggcatctaaggcaagccctccttcatatattgttttggcctcagctgaagaaaatgcctattctttgcctgtggcaacagcctgcccttgtaggaacactaactcatgctcacagcccatccctgagtgtccttttggttccgacccttgcatccagaccatagatgagattagacaccaaatcaggattagggaggtaaatgggattaagccatttgcttactcttgcaaaatggaatgctatgtggactctgaggaatttgaacaacttgttaacttacttaagtcaactactgatcctcttgttcataaaagagcacagattgcaatgggtatccataacgttcacccatttgcccaagagtttattaatgaaatggtataatgatgcttattgaaagcttgctcagttttccttccccagaaatgagaaaattactaattttcttatgagtaattactctgaatcctccttctggggatgaaagacaatgcaaaattgaattacatgttaagcatatgtgtaaagacaccatgtcatttcctttgaactcacctggacagcaatctggatcaaagatactagggcaactgactactgattttgtccatcactacattgttgccggtgacttttcagagctttttcatttgccatccttgagaaagtacaaaaccagacatcttgttttgaaagtaattttaaatatatctgaaaatccaactgcagccagagacatgatcaatatgaaggcactggcagcatcaaaactcatctttaaccataaagaggcaaaagccagtcttgttagtggtgtggccatatttattaacataaaggagcatatcagaaagggctcaattgtagttgttgatcacttgagttataatacactcatgggcattctcagggaagttaaagggattattgaagcaatgtaaaatgagccagagatagaacactttgaaccatctccaaactctagcaggctgtacattcccaaagagccttgtatcatatttggttattatggtgtacaagttatacattgcatctttaacacatagttacctgtgacaagctctaggtttgagctaaactattttgggggtatcagatgaatatcatatcactggctgaaaatgtttgttgatttttttcttgtttagattggcatattttttacattttatttaagaaagcgaacgagttcgttgtaagtgagctaacttgttcattagtatctccttagatccatctgtggcttaaaatggcaaaaaagaaaacatccttgaatttgaaatctagttatagaagtaaggcatacacacacacaaagataactaacagtacctagagagagagtgagtgtgtgtgtgtgtgagtgtgcacgtgtatacccatgaccaaatgtgcactctctacataaaggaggcaggggttgctataggctgtttaatgtaagagaaactactctttttctcctattccagccgtatcagatactcattccacaacacagaaagatccagaatttcagacaaatgcattatttgttcaattttaattttgcttctacatttataactcttaaattgtcaggctgtttcatttatgtcaaagtcatctcacaaaagagaaggtggaaacattttgtgagtgcctattctatgtcagacactaagttggcaccatattttgcaagtttatttttttcctgtactcacagtgatcctgtaaactaggtactcgtgtttttattagaactcattagtctgggtaccctccaatgagaattagagagggtaagtactttttcctagattcccacagcaggcaggtggcatagctgttttatctgacaccagaacccatctcaccatactcctttacagttcccctgaaggacattttgaggcgacggccttcaaagctcagagactggttttaatgtttaattttgcatgccaggttacaattcttaacttcctccacatgcatgtgtccatcagacatttgactgcatctggctggaggtcagctgaaaagtctgagatgagtagatggattttatctggcagtgtcagaaaaatagtaggtgccccaaactttgttcagtgagtaagatggagatttggagtcatcagcaaggggaacttgttagatgtcctttgcatctttttctacccatttgtactttatcttccccaaagagctgaaatcatcctgtacattgttttatatcctgaattaaaaaggtaattgcttttggccgggcgcggtggctcaagcctgtaatcctagcactttgggaagccgaggcgggtggatcacgaggtcaggagatcgagaccatcctggctaacatggtgaaaccccgtctctactaaaaatacaaaaaattagccgggtgtggtggcgggcgcctgtagtcccagctactcaggaggctgaggcaggagaatggcgtgaacccgggaggcggagcttgcagtgggcggagatcgcgccactgcactccagcctgggcgacagagcgagactccgtctcaaaaaacaaaccaaaaagaaaaaggtaattgcttttttcctccttgcaaaatcatgccttaattttttttatcatttgtgatttattctcctatgtgtcctatgaaaggccaaagggctttatcttttactagtaggcaagcctgggcatttctgcatttgtaccggctaacacgacagaataaatgtaatcggagaaatttagatccagaattgcagcttcaacaatacaaaacagcaaagctacaagaggctgctgtgccaatctacaagacagtgattcttagtcgttggtatggaccagaaagcatgcccaggacgtttaggttatggctgaattctctaagactcatggtgggaattgtaatccctagtctgagctgaaacggaagtttctatgtgtgaaaatatggggtaatatgctttgaggttttctgacagttaagaaactaagacaagatcatactgtaaatatgtatggaacttgcttccccccagttgtgtattgtaaacatctttgcatgtcaataaatatgcctctataacaacaacaacaacaaaatagaatatatacaaggggtatgcaaactttggtcagtgggaagatctttgctgactcacattttcattaagtgtatagcactttgacatccctcattttgtagcaatatcttaattccaactcttcctgtcacatgtgctgacatctcttcttacctcgtgtcagcattaaaatccaaactctcagcatcctgaggctggcgattccttccccatgatcatctttctacttcttgagcattcacagagcttgttactctgttttcagttctttcataatatctggggagttcctggatttctagagagttcaggtattcatttgaaataattgttatgttttatctaacatttatcagtggtcatagtgggaaggtttggggattatgtagacttccaggaagtcttcatctttcagttcctagattattcattgcccagatatttattgtcttggggactatattgggtattgaagagagctggtaaaaaatacagatagagagagatagatagagatagagatagatcctacactattaactttacaataaaattagacatcagtttctccaggaggctttctctaacttttctcaaatctcaaaattagctattatacgtagctaactcactgtatatttcctcattctgtcattcttttttttgtttgttttttgtttgtttgttttttgagacagagtttcgctcttgttgcctaggctggagtgtaatggcgcagtctcggctcactgtaacctctccctcctgggtccaggcgattctcctgtctcagccttccaagtagctgagattacaggcgcccaccaccacttcctgctaatttttgtatttttagtagagatggggtttcatcgtgttggccaggctggtctcaaacgcttgacctcaggtgatctgcccgccttggcgtcccaaagtgctgggattacaggcgtgagccactgctcccggcctcattctatcattctatcacactattttaattatatattaatttgtctgtatcatcttcaagattataagttctgagaaaatggtaaagcatgtccttctgattcgttattccacagtgtcttgcacaaagtccaccacattgcagaaacaagattattattgctgaacacagttgcttcagaaagtacttgagaattttcagtatcttttaagaaaattcaattggcctgtttttcccaacattcatgcactatcgacccttcctttttcttaagtttgttcttctctgtatgtaaattatctcaagcctcctgtatccttaaaaacaaagaaaaaaaggaaacagtaataccttccctagtttcctggatctaaggattgtattctgtatctccttctgtcaaatattacacagtttaccattcctgcatttataagctcttttaaaagccagccaaagcaatcctggtgcttcccagatgccagttccacaggaatattggtcccccatgaggcaatttgctaaagcactctggctctttcctgatgtctgcacttatgactcatggctgatttgattacttcccggtgactccctgaatcctttgcttgtttctatacttcaacgctagttcaattttcttacattaattatgttttaagcattaattatgttttaggcttgattcaagtcttatgctgcatcccacactttttaaaaaattaaaaaacaaaacatttttattgcatcccatgcttttaattgacagctcaattcacctgggatttctccatcaggtcacgcagctctgaaagctctctattgcccccttctggtagctggcagactagctcctcaattagcttacatcgtcaatgctaaccttgttgcttgatgttgctatgcctcagatactagtatcttcctttctttcctatattcttcactgccgctgtttcttcatcatctatttattcctcattcctttcagactgacttctgctgcctccagccttctaccaaaacttgccatcccattgatacaaggccctctcaagtcttctggatgatctctgtatatgaaaatattgcccttccctttcctacttcgccccaacactttattctaagaacttgaaattctattagaaattatctactctaggagtcttcaaatttgacaacagattaaaattgccaggacaacttaaaaatactgtttcctgggcccccttcctgaaaattctcaccttttaggtctgaagtagaggtctcttttgacctattgtcatcattaaaatcccaactcccatttgaactttaatttaaatgtatttattcagttaggtaaatcatgcattgggtaaaaatttaaacaatacttaaatccacccttcctgtataagtgttcttacaagctatagagaaatacctgagactgggtaattgataaagaaaagaggtgtatttggcacagagttatgcaacctgtacaggaagcatgatgctggcatctacttggcttctggggaagcctcaggaaacttacaattatggcagaaggtgaaggggaagtaggtgtggaggaagggggtggggaagtgccacacacttttaaatgaccagatctcatgagagctcactcactatcatgagaacagcacggcaggggagatctacccaccatgatctaatcacctcccaccaggccccacctccaacattgaggattacaatttgacctgagatttggacagggacacagatccaaaccatatcacttccccttagtttccttacatttcctctcctaaggcaatccttgttaacagtttcttaaggatccatgtaggcacaaattccatattctaaagacatgtctcaactgatttggatgcatttggtccactaagcttgaggagcctctgatttaattcacccctctcatcttccttgaaattctttcatccttcaacatcctttatgctgattgtcgaacatctctgatagtttgattctgtcttcttggtccacacctcctactttttctgactgtttaatgtgggcattcccccaaactactccccttgatcttcttttctgtctatattttctttcttgacacatctctccagacctatgagtcactcacagaatatactcatatcacttgcgccaacatctcaagctagccacacaccagtattttttctaccagttagacatttctgtctagttgtctgggagcacctcaaattcagcacccaaaatgaacttacctttctgttaacaaaactacttatgcttctcttttccccattgtccttacttctgttatcattgactcttcctctgcctcttttatgttaattgcaccttgaaatgacccacacttcttttccctccacttcagtttcgtttgttacagcattttttacactagcttcacttgtggttaccacttccctgcccactgctcataagccccttgaggattcttcagggcagcaactatattttctttatttctatgttctcggcacctcactcattctctcatagtaggtgttccatggatatgttgggtcaatgaatatccgttaaagctcaaatttttaacatggcagtcgacatcttccatttctgatttaccaacctctttaatttagataacttaatttacgccttgccacaaccaaactgaactattcacagctctcctgaatgcacattgcaatcttccttttgcacttctttgtttatgcttttctttctgcttgaaattcccatctgttccctgcctatcaaaatcctacaaatccttcaagtctcagatcaaatgccttattcttcccaaagccttcccaaatccttaagtcctgggttcccacagcgtgtggattgcattttagtctcacttctattcgactaaatttataaaatcatcggattttagttgtggaagacactttagaggtttggattttagttgtggaagacactttagaggttacctaagacaaccctgtattttacagctaagggaactgagacccagaaagagtaaatgtcttgctcaagattaaatatcagccagcgaccaacggagccagacctagaacccaactctcctgaattgttttccagagctatgctgcctatgcaattgttttagcttctcttccggaccattagtgccaaaagtcaaggattaaattttattcagctttaattccttataatatccaatatagcacctttcatatagtaggttcacaaaagctatactggattgaaatgaacatttaacgtactggttaatagatatttttagccagagttccctggaaaacagagtgtgaggcagagattacttgctgatgtgagagtaaggagaaagaaaaggcaggaagggctaagggacaatgcagtgactactgcttcccagcgaacctggaaacccagcagggaatgtggcaagtggtctgtacatccaagcaaggtatctgtggccaggctgtatggacctatgccttggggcagctcataataagcaacttactgtccccatatcgtctcatatcttttttcccaccgatcaaagttactcccctgcacttccagttctgtcatctggcccctttgatggctctttggaaagccagattccatgccctgcgggaaggttcctcggttgagtccagagtggaagaggatgcaaataagatatgtccaataaaaaaagctttgaacctacacctgttacttaaccctgttacttgagattgttcctattttggtttttgaaatccattgatgttggaaacacaaaactggtgatggctttctttaagagacaggctgaaacagaattttttttttttacacggagtttcgctcttgttgcccaggctggagcgcaatggcacagtctcggcttaccgcaacctccgcctcctgggttcaagcgattctcctgcctcagccttcccagtagctgggattacaggtgcccaccaccactcctggctaatttttatatcgttagtagagacggggtttcaccatgttggccaggctggtctcgaactcctgacctcaggtgatccacccacctcggcctcacaaaatgctgagattacaggcatgagccactgcgcctggctgaaacagataatttttaaatgttttgtgcaagttaacagtgacattcatgaagagaatgattaaagtacagcttgaataagttctgatttttctctcttaagaattatgtgcaaatccatatgtgacttttaaaaatcatcagatttcaatgttttctcatatgatgttatgattctacattaaaagaactataaactcttctaattaaattactcaagatagtgcaaaagaatccatgactctttgtcctcagatataactcgtaccctaaatgcaagttgtttaccagtgcacatgacaaaaaacacctaagtagggggaagaattctttctttcagacaagtggttttacctacttaaaaaaaagccttgaaaacttggacacccttcaagagcctctgaatatttttcttcagcagaaattccagcccagatgttcaataactcaggtttgttttaaaagaggaaatagagagacaaatttttgtgaagggcaaaatttgaaagcaattaatggtgacatgtcccagaattttgcttcattttattattaacgcaaccattctttccaaattttattgtcagatattggagaagagagaggaaaaaagtctgggaattggagataaaattcaacattgaaggagacattttaaatcccagtcaagaggaaagaaagagttgatggctaagctgactgccaaaagacattgtaaagttaccagataacaacaagtgataatagaagggcctagggaagttctgctcatagacttcaaacttggaaaggtgtcctgcagaccaaaacctgctgacctagcagtggcaaagttgccttaaatgaattcacaccgacaagcctggagggattgtctcttgatgctaaagtgattcggtcatacatatctgagggcactaggtgaaatttctggagaatcttggaaaataagtgtgggaccagaaagatagaatcactttgttctggtttactttaaaaggataaaaggtgcttttcatttgctggatcacttaaatgctctaagtctctggttctcctataaactggggactatttactagccccatttatttaccagaattgttttgataatttaaaaaaaagatatgcaagctaatcataaattctaaatcaatataaaaatgggctgggcgtggtggctcacgcctgtaatcccagcactttgggaggccgaggcgggcagatcacgaggtcaagagatcaaaaccatcctggccaacatggtgaaaccctgtctctactaaaaatacaaaaattagctgggcatggtggcacatgccagtagtcctagctacttgggaggctgagtcaggagaatcccttgaacccaggaggcagaggttgcagtgagtcgagatcatgccactgcacagagagactggcgacagagagactctatctcaaaaaaaaaaaaaaaaaaaataagctagtgagtgactatttaagtctccttcttctttccattttcattgcactttacacatactactgttgtagatcttactgtgttgcatgatggagaggtttatgtccagtttcccaactggaatgtgagatactcaagaggacagacgtcaacttatttttcatatgacccccccaaacccaaaacaaggattagcatttaatgagtgcttaacaaatgcttgctgaatgcagcaagattaaaaaataatctcagcagactgtgctgcaaaacagaattgcaagatgataacctaactaagataaatataaaccctacatttgactctaaataataaattgcacaattattggattgtaaagtcctagtccagaggtcatggtaaaaacatctgggagctgcagttaactataaaaacaggaaagagaccgatgaagcttctaaaaatattaacttattaatactagcatagaatcatgggaaatgatgggaaccaagagaaatgatagtctcactgcgttccttgtgggtcgaatcacattttaagaggaattgataaactagagtaaattcaggtgactccatctaataggatagacagtaccccatgctataccaaaacgagttaaaagagctcaagtagggctctggggaagagaaaaataaaatatagatttgagctgtcttcagttatttgaaggagatccagtgttgtcccagtaggcaaaacttagaccaaaaaaattgtactcccaaatttgattatcacatatcagatttggattcagtaagaagaactgttctaaagatcacagctgttcaacaatggaatggactcctctggacggtagagagattgtgtcacacaatacctggggcttagacatttcttgtaatcctgtctgtacttagcatagctctggacacacaatccatagtcactaaatattttttcacagattgatactagggaaaataataatatttaactatgagtatatgcctactctgcccagtaatgtttagtattgaaccagagatctagattagtgatctccagatttaattcattatatactcctatcagtaaagtttttgaacaggtactcctaatatatacatttatttataaattctatactatactactctactaatcgtcatatcaaatacatgtttataaaacaaaaataatgtaagggcaaaaatatgagataaagaaaaataaatgttaatgtgttttctttctgcacaccaatggatcatcatggccaccccactttgcagagaactggtctataattaagggacttaacatctgcctcaaatacctggatattttaggcccttctgagtctgaatgatctacatatcaatcttaattttttcatttctcttttcccatgtagacaaaaacaggattaaaaaaaaaaaggttaagcgatgttctaccatttctatacagttgacccttgagcaacacaagtttgaacttcacaggtccacttatatgaggattttttttcaataaaagtaacactgagtatgctgcctcttctgcatccccttgcacatcctccatctcttccatctctgacacagtgagacagcaagaccaacccctcctcttccttttcctccttcttcaacatgaagataacaaggatggggacctttatgatgagtcacttccacttaatgaatagtaaatatagtttctcttccttatgattttcttaataacgttttctttttttttctagcttactttattgtaaaagtacagtttgcaatatatatgcaaaaaaagtcttcactgactgtttatgttatcagtaaggtctctagtcagcagtaggctattagtaatcattttaaaaagccacttatagattcaatgctattcccattaaactacctttgacattcttcacagaactagtgaaaaaaaaaactatttaaaaatttatatgaaaccatagaagagaccaaatagccaaggcaatcctaagcaaaaagaacaaagctggaagcatcacgctacccaacttcaaactatactacagggttacagtaaccaaaacagcctgatactcgtacaagaaccaacacatagaccaatggaacagaataaagaacctagaaataagaccacacacatacaactatttgatctttgacaaaccaagcaaaagcaagcaatgaagaaaggattccctgttcaataaatggtgctgagatatctggctagccatatgcagaagattgaaactgaaccctctccttacaccatatacaaaaattaactcaagatggattaaagacttaaatgtaaaacccaaaactgtaaaaaccttggaagacaacctagccagtaccattcaggacgtaggcacgggcaaagatttcatgacaaacatgccaaaagcaattgcaacaaaagagaaaattgacaaatagaatctaattaaactaatgtgcttcaatttactttgttgagagtataaaaaacactatcaacagagtaaacaggcaacctacagaatgggagaaaaaattcgcaaactatgcatctgacaaagatctaatatccagcatatataatggacttaaatttacaaagaaaaaataaataaccccattaaaaggtgggcaaaggacacgaagacatacatgtggccaaaaatcacatgaaaaaaggtgccatatcactgattattggagaaatgcaaatcaaaaccacaatgaggtaccatctcatgccagtcagaatggctattaaaagttaaaagaaatgcttttaccctgttgggagtgtaaattaatgcagccattgtggaagacaacgtggtgattcctcaaagacctaaagacagaaataccattcaacccagcaatcccattactggatatatacccacaggaatataaataattctattataaagacacatgtgtatgtttatttcagcactattcagaatagcaaagacatggagtcaacctaaatgtccatcagtgatagactggattaggaaaatgtggtacatatacactatggaatactatgcagccataaaaaagaatgagatcatgttctttgcagggacatggatggagctggaggtcattatcctcagcaaaccaacacaggaacagaaaatcaaatcccatatattctcacttataagtgggagttaaattatgagaacacatgggtgcatagagggaacagtacacattggggcattttagaggctgggggatgggaggagggagaggattaggaaaaacgactaatgggtactaggcttcatacctgggtgatgaaataatctgtacaacaaactcccatgacacaagtttacctgtgtaacaaacctgcacttgtacccctgaacttaaaataaaagttaaaaaaaaaaaaaagaataaagggtagcaaacacaccttcttgctacaaaagaaaaaaacagtaggctattggtagttaagttttggggtagtcaaaagttatgtgcaaatttttgattatgccattgtcgacactcctaaacccctccattgtcaagggtgaactgtatctgtttttgtaagtcttttatgaaaatatttttaaatgtcagttttttgttgaccctgcatgattgtgatagaatttttctacctcgtgtctccaaaacagatgttgttcccttataattataatacattttacaaaatcgcaactgcagagtgttttgttgaagtgatcatcttaaatgaatgcatgagccgtaaccggatcaatcattcttactcctgtcaagctttcaattacattccagagtcccagcacaaacctagcagcttgttggaacatctagatgccctttgcttctacatcctccctctttcctcccagatttggattacctttaaatgagctattatctgatatgatgccacagtttccatgattcgtattcatttttttaaaactttcgtctatgatctagtaagtgacgatgactggtttattgcaaaattttctgaatcactttgctctgtcagattaagctttcagctaaccagcagagggagcacaaagagacacactggtttcatctcagtgtacagggagtctagttactaagtggacgaagaactcccgcacattgagatctggtcctcaactggcaagaagcactgttcgagcaatcaggaaaatctgggctttaagcagtggcaccactacgaatttattctcttgcctaagattacttggaattcctatagtagtgggggaggggggactctcttttgtactagttcctccttaaattttaaagaaattgagcccgtggactgaggtgggtgcggatggtgggatgcagaggaaacaaaaatttcttctcatctagcttccactccaaatctgtttctcccagagaaaatacaagacttaggagtgctgtatgaagtctcttgctgctctattctctaggaaacctaatatgaaatcattaagctactgaatgtcagtttcttcaacagtaaagaagacacattattattgctgttattattactactactactaccaccaccaccactaccaccattactatccatttagtgacttctgttttctctacttaatctcacttattcagcatatcagccctaagaggcagattttattgctcccattttacagaagaggaactggaggcttaaagaagttgaagaactcaaccaacgtcaagcaactagaaaggaaactggaagaaggtgtctctgattccaaagctccatgcttttcatctgtgttggtaataaaaagaataataccatatcacagttatattgtacattacaaagcactttaacctttatcatccccacctcgggataattctgtgagctaaacacggacaaatagtaacattcacccctccctatctctctttacctctttagctcctatttttaaaaaacaagcaattaagggaactaaagcttacaaaatgtaaaggatttttctaaggtcacatagatgaaaaatggatttgggattaaatgggttttattcctgtagttgccacatcacactgctttgccacatagagaggaagagacccagctttgcctccaactagctcttttaccctaaaatgatcatttaaaccctggagttcttgcatatataaaatagatgggagtaacaataataattaatacttatgttaacaacctcacggtattcacaaagatcaaatgaaatacggagatagttatgaaataagtaaataatatacagacaaatatagttctattgtaagattatcctgggtgttgaaactaggttatgtctgacttctggcaaaattacaggacagggcaggttagtgtctaatctgcctacttcccaatccccaggtagctgtcgcctgaaaaggcatcggaagatacttaagagataggagattgttcatatttacttaattttttggatgagactgtttgtctgaactgtctcatgagatggtatttacctacttgggaagctcattctctcatttgggacttggaagcattctcattgtacaacagtgagagctggaatgccattacatcattatgaaccacccagtgcccatttgatatagttaataacaaggattaatgaagtaatttaaaaggaagaaatagaatccttgccttgatccaagacaaaaggacaaaaaaaatttctttctgaaatttgagggaaaaaatattggttgcttctattcttttaagaaactgcctgagaaaagtcacagtgtgtgtgttatgtgggaaataagagtattggggcaggcaatcattcatatgttagatttctttgttcagatcaatattgtttgagtgctaacactgtggtaggtgctggaaatcgaatgctgaacagaacagataagttgcccacactttcatggaatttgcattttagacagacagccagcaatgatcaaataattacatgtttggtgggtgttacaaaggagaaaaacagacttccattatgacctcttatgtaatcacactgcaatatcttgaaattattacttataaagatcaagcagaagctactgctgcatactagagaattttaaatgatttccaacatcgagaaacttgaatttcttaaggagtagttattataaaaagaaactggaatggctaatcttggctgtctctctaaagccaatataaagaaaatgagtgatacacaacattatcttgacctcactgacaactagatagcctaagaaacagtgtgtgcaatagagtagaaggaagaatcaaaggacatattttataaggataatgagttctgctttcttttcctcttctgggctataataatttttgtctcttttgtaatcataccctcttggaaagccactggcttggactgatttatgcctactacagatttttccttccaaaagtacatctccatgactaaggaaatgggctgtctcaggttggctggttccatcaagaacacttaaaacttgattgcacaattgtaaaaccaactggggtcttagcatcaacttgcattttctcattggcatccaattttgaggatatcatattgcttggagaagaaagaggcagtagttattataatttccgtggacttacagagttttagagacttggatatcgtgtactttaacctcacacccagtgtaagaatctcctatacctgattcatgatattcatcttttgaatacatagggtaaaaagagcttactatctcatttttgaagaattctgttattcttttttatattggagaaaatctaccaccattagtcttagatatgttcaccagagccatcatggaccaaatcagaagtaatcatttctacttaaagactttcctcctcttcaccactaacaagtcttttctcttctaggctaaacattccaggtttttcctccattctgtataccacatgatcctccaaattgctcccattttggatgatggagcttgaggaggtggaagatcaaaatgttagtgtgtgttatctaacagatttgctctttctctcagttttgtaacattagcaggtttgatcaatatttcacctgtgctgcaattcacatcgataattaaactatacagggttgctttaattataaagctaaaagtggatttttttccattaacattaccagataggatgatttgccaactcgttctctgggtctagaaaatgcccaatgaagtcatattgactctaaaatcaagctctggatgtgaagatgctgccatgctgttgagtcaaaagaatatattatttttcatttctgttagaccagtaattttagtaactttggcaaaaggaatataaaaacaagcaatctccaatttatagggctgcactgtagaagtcatttgtttggaatgtatttcacatgagtattaaatttttggggaagactaccaaattttttttcttttttttcttttttttttttttgagacagactcttgctctgtcacccaggctggagtgcagtggcatgatcttggctcactgcaacttccacctcctgggttcaagcgattctccagcctcagactcccgagtagctgggactacaggcgcatgccaccacacctggctaattttttgtattttagtagagacagggtttcaccatgttgcccaggctggtctcgaactcctgagctcaggcaatccgcccgccttggcctctcaaagtgctgggattacaggcgtgagccaccgcacccggccaaaatttttaactcctaagacaactgacattgtaaaccagaatgtcatttccggttctttaacttaacatgtaccataagcaccacgagaaatattttgacatctagcacgatgtttaacaatgtttttctggattcggatgaccaggatcactgctgggaacaccaggaatattttcatgcttttattctctatccaattgagttaaggatccccggccccacatctgctgaataaagaaaactgggatccttgtggcctgaatctggtggtggctgggaaggttaagatgcagtgatagatgctacagagcttctggaataaagcctgcctaccactggggtatactcctcagtcttcatgggtcgcagtcagactcccattctctctttccctccacgtcagcctgattcatagcctcttcgtactcattctctctctctcctcctattctctcttcctcaggggtcatgacaaaatcttccagttttgtttcacttatcccttaagcactctccaatgctttaacagttttctaaggtttgtttttcccttgctgggtagctaatgaattaattaagaggggaatattgctagttgcaaaagggaagtggggtctatagaggatctctccagtggcagcctctgtctctcaatctctctcccattctgtctcacttacagctggcagggagaggcagaatcacctgcagatgctgcctgtgggctgagtaaaatgcaccaacttttcaaggaaaaacaaggacaggcgattctaggccttaagggaaagatggtgaggtaggtctgacatctggcctttgatgagaacacagaacagtacttctttgtgggagttgggagtgagaagctgagaactaacttttatttttttttaactcttaattgcatttattttatgctgaatttattcccatgccgtaagtttttgtttcttcagtttcttttgagatatcttttttttccttatgtacaacagaaatatcatatgttgcagcaatatcagcacaaaagaaacttactgaatccttactgaaaaggaacagattgttccagattacttctcttcaggtttaggaaaaatttgttccttttcagtaaggatcatcttgatgtggcagggagagtacatgcatgggttaatccgaccatgagctctataaggccagtagcaaatcttaggtgctttatttacctgggtatgctcaatgacctgagaatctacatctacacccttaagttcggcatttctctcagcatttataaacatgtgcagcaaaaattcagcactcattttgggccaccaaccctgtgtccagccccactgcttggcctgggcactaccaactcccccattgtaacgtcagaatggtacacactgtttctgtgaagtgacatctttcagatacttggtggcttttcgtacaggcacacccttgttggcctgggcagtttcacgagtgttcttacaggaaacacaactatttgaaattcttgatttgcctgattttgaggggttttctgggtcgagtgaacagaaaactattttcacagatcacctcaggccacttaggggaagagcgggactaactttcttgatcttgcttttgcctgccttctcttttcacaaaggaacagatgttcctttcaccaatctttcaccgtcattcatttttcttcctccccttctaagacacacttggctattgcagaaacacagttccttaaacacaagtccaaaattcaaacagctctgaacattgaaagtttttggcaacctacattgcagcagaatttggcccaaactgacatgaggtgatatcatctttatttactcacatatttactataaaaatatcaattatcaatgggattgttttaaagtacagccccagttcctgcttgagtataatcaaacatatgtatattacctttctaaaatctgaaaatttttgaattctgaaatacatctggccccaaaagtttctgggtaagggattatagccctttatttcctgttttcctacatctttctctttccagctaagtgtaaaagagtatagactctggtaacccaagctgaattcaaatcctatctctaaatatcagttgtgtgtgattttgctctgtttacttaacccgtctgtgcttcagtttccccatttgtaaaatagggataatagtattacctatctcaatgttgttgtgaagatttaattgagttaatctatgtaaagtgcttacagtaatctctagcacatagtaagcactataggtttgctattatcatcaaccttaatccttcactctacccaaaaatattacctaatgtcccaattataaaatccctgctcttcgccctattccctccatagttaaccctctatccattttcttccactcatgccataaacagaaaaccatttgtcattagttaccattgactactcttcaactggctgaaatctggtttgctatcctatttctcaactccatggtaatttctctcattaaggtccctaatgcctcttttttttttttttttttttttttttatcttttttttttttttctttttttattattattattatactttaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttgctaatgcctcttaactgccagtttaaaagactgctgtttagtttcttttgtgctgttatttctgcaacatataatatttctgtgacaaatagactcagttctccttctacttcattttcattctactgctccggtgactcgctcattaaaggttgacctccccaggtgtttcatcctttgtcctttttgtacagtacacatgctccttagaaaaatctcatccaatttaaagtgtcagctatcacctggataataatgactgccacattttatcattagccctgacctcttccttgtgcttcagactacatttcctatttgcctcctgtgtccagccccaccacttgacctgggcactaccaattcccccattgtaatgtcagaatggtgcacgctgtttttgtgaagtgacatctttcggatacttggtggcttttcatatatgcacacccttgatggcctgggcagtttcacaagtgttcttaaaggaaacacaaatatttgaaactcttgatttgcctgattttgaggggttttctgggtcgagtgaatagcaaaccattttcacagatccatctccacttggatgacctgcaagaatctcaaatgtaatatatcccaacaaattgtatgatcttctccctgacatcctgcccctaacccccattccagcccccaaagtaatctcacaacatgtatgttttttcatttttaatctcagctttaatggctttgcacacttcacctattagcttaggccagaaatgttgaatcttcattcgtctttaacttccacattcaatcagtcactaaatcccgccaatttgtttttagtaacatcgccagaacctgcctactgatttactaagggcttgtactaactatcatgtagaccagtggcttgacctttttgcccataacccatggtataaaatatattttacattgtgccctgggatatagacatgtttatgtacatctgtgctctattttatttcatttcacttttctaaaattatggttatgataccctaaattgattttacaatctaccaatgggttacaatttgcagtttaaaacaccctgacctcaaataatagcactttactcgtctcccctctcccgaccccggtgggtcaatagatagcacttcagaggttgtgtaccaaaacccttaaaggcagggattgtaatctgccaaagaaaatgctcccaagaaggtgattctgatatctcctatatgttctactcagttatcaagacaatactgaatatttcttagacatgtactatacataaagcacacagctgtggctcaaataagcatggttcactgatttggcactcacatttacatgaacttggaaccctcaaaagcccttaatgctccatgtattttcacacctccattgacactgcacatactattccccttgcctggagtgtcctccatactccctttcatcaggcaaatgcccatctgtagcaatgtatacaaaaatctatttatttaccaaagacagttaggtagcagaggggtagtagtggtactgggcccagtttatgtccctctccagttactctgtttcctggtcacaatggtcccagcaaccgccatggtcattgctgccagctcactccacaaagtctgtcacaatagcctgcctgcccctcactctttgatttgctgactcagaaatactggaagtcatattcatggtttatttaaacaaggaaaaacatatgtatgagcaggatgccccacaggtgttaacaaccacatggccttctgattaagaaagtttccatccttggatactcatggttttctcctcatttctctcctacctgggaaatataatatgaggaaggcactgttaggaatccccaccttaagggtgagggaactggggcataaagagattgagtgattattgcaaggcacttaaccaatatgcagcagagcctagagtttgaaaacatctctggagatgaaaatatgttccttttctctcctataatatttaagggaaaaagactacaaatccaatttgtacttgtctatgcactggtcctgtttctcctgccttctcatgaaggggactcaagcctttgtgtgtgtgtgtgtgtgtgtgtgtgtgtgtgtgtgtgtgtgtgcacgcacgcacgtgtatctctgtgtgtgtactctcaatcagcactctaaaatatattggcactctgaaatatatgtgtatttatgcatgttttataggcacatattactgtataatatactatgtaaattataaaacaaacacacaaaaacataaattcaaaaagcatgaatttttaaaattataagagaaagttctaatatttttctgcactccccagtatattaccttggatactgtattttggagacctgccataaagtatcatacttagtagaaaaacatattttctttcatatacaggaaaaatattgatccacaatcaatattgttcacagggttgcttctcaagctgtggtgttgtctgaatgtcatatcccccaggatgccattcaagacaagcatttgcagttttgagatggctaattctaattaggaaagcagactgccaccacaggttataatctgactaatgtgttcttggaaccgcggagctactgaagttttcgggtatgacgtcagtaaggagtgatgaaaggaggactggattaacagcagataaaagttctaaataatttgacctctgcttaaaatagcgatgggccttgaacaaaacatttaatagtaacgggtcctttgattaaattgcttttgcatgtatttaatattaattccactgatatgatactaaccctaagaaataagcatggctgatactagcccttaattttatatcataaatgagcaaaatcttaaagagagtaaatgacttgcccacacagtaaaaggcataactgggcttcacaatggtatttttgactcatgtattatcttaccttgcttaacctctttgggcttcatgcctttaaaataaactttctgttttagaacagttttaggttttaaaaaaagttgtgaagatggtccaggtagttcccatatactttacacgcattttcccctatgtattcgcttgctagtgctgctgtcacaaagccccacagactgggtggcttaaacaacaacagtttattttctctcagttctggaggctataagtccaagatcaaggtgtagaccaagatcaagaggcttttctggggcatctctccttgtcttgcccatggcctccttcttgctgtgttctcacatggttttgtctctgtcctgatctcctcttcttatcaaggacaccagtcaatttggattagggcccaccccaatgacctcattttaactaaactacctctttcagggccctatttccaaatatagtcaatttttttttttttaatctgagtcttgctctgtcaccaggcgagagcgcagtggtgcaatcttggctcactgcaacctccaactccctggttcaagcaattctcctgcctcagcctcccgaatagctgggattacaggcacacaccaccatgcccagctaatttttgtatttttttagtagaaatggggtttcaccatgttgcccaggatggtctgcatctcctgacctcgtgatctccccgcctcggtctcccaaggtgctgggattacaggcgtgagttaacattcctggccccaaatatagtcactttctgaggtactggggttaggactccaatatataaatttggatggggacacaagttagcccctaacaccttattattaatgctttacattagtatatttatcacaatcaataaacaaatattgatacattattattaactgaagtccatatcttatttagatttccttcattttcacctaacaaactttttcagtcccagatgctatccaggataccacattacattttgtcactgttatgtatttaaatgtttgcgtcctctcaaaattcacgttgaagttctaaccctaatgtgatgctatctggagatggggtctttggagggaattagatttatatgaggtcatgaggattagtgtcctataagaagaggaagagaaaccagagcttgatttatactgacaccttgatcttagactatccaacctccaaaactgtaagaaacaaatatctgctgcttaagccattcagtctgtggtattttgctgtgccagtagactaagatagtcatcaggtctccctgagcaactcttgactctgacggtcttacagttttcttgtttttgatggccctgagagttttgagagtactggccagatattttgtagaatgtccctcaattgggatttgtctctttttttctcattaatagactggggttatgagttttagagaggaagaccagcaaggtgaaatgtcattctcatcacttcgtatcaagggttcatgctatccacatgtcctatcactgatgttgttgacattgatcacctggctgagatgctgtttatcaggtttctccactttctcccataatattactcttttctccttctttccatactgtattctcacttacagaatgggaagtttaggacttcacatgttatttgtaaaacagcaggactggattagtccatttctaagtcatctctagtttgttccttataatcaatgagaagtactgtcctgattgaaaaggaaatctgtattcacagaacagggtgagagagcaggatcacttaggttcaaacccttagttttaaccgtcttagcgttctttctgaacagagggactacaaaaaaccattgtgaatgtagcaatttaatgatctacttttttgcaagttggcaccatattatgtattgatcagccttggacagatcactgtgtccagactcaattctgaaaacttgtggagggttggagagtaggggtatgtctattcttcacctaacaacactgatgatgatgacactgttggtcataaagcaatactcaataattttgttgattgctgatcagttacttcaaacacaaacttgtagaccattttctttctttctttttttttttttttgagatggagtctcgctctgtcacccaggctggagtgcagtggcatgatctcggctcactgcaagctccgcttcccgggttcacgccattcttctgcctcagcctcccaattagctgggactacaggcgccccccaccacgcccggctaattttttgtatttttagtagagacggagtttcaccttgttagccaggatggtctccatctcctgacttcatgatctgcccaccttggcctcccaaagtgctgggattacaggcgtgagccactgcacctggctttgtagaccattttctagaaccaacaggtaaaatttactagagattttatcttggacgtgaactctaggtagtttacatttcttattctagcatatagtgcatgcattgagattctaccaatataaatatgtaaaataaggcaaaataaatgaatttcaaaaggaaattaaggtctttaagctttatctatgtgaattatccttaaaatgtgaagaattgctagctgttttttatccaacttcttatttcctgcaccagtttgaaacatactctccttaagaaattcttaaaagtttccaattactgtaagaataatggaaatttttctctttaaataacccgaacattaatttgttgttctttaacaggatttcctttttaatgattataaaagctcatctgtccatgatatatagcaatgtacccatacaatatgaaattgtattttacccataaacagtcttcaaacaagacacacaattttcttgcttactggctaattaaaataaaatttaaacccacattaaacttgattacattgtcaaaacacccacatttttaaaggagaggcctacagtgttaattcagagagagtgattctttactcttcagctaataatcgcttcagtattaataataacttcagctaaaaatagcttcggtagtctcagatttttaaaatcatgtcaatgtaatcatgcttttatgtcctcttcatttgtggaaaaggaaacaaatgatttgtcctatgtatgagaagatcttttaaaatgaagtttctagggtttccaagttggcaaaacgtttgtcagtatcatcatttggtttgtagaccacattgattcatatactggctacactgcatattaattgcagtttctttattatggaatatttaaaatgcacaaagatacacagtgaactataataaatacccctatgcgcccacctccaggaaaagtaatcattgtgtttttaaaaaataaaacatcatactggagttcctctttgtttcatgttcattctctttcttcctcaggagttatcagtgtgctgcagttgatgtgcattttactcttcgttttatcatatctgcccacaaccacaaatgccataggactgtgttttgtatttcaacattttatttaaactgtatcatattttctgtatcattctatagcttactttcttgactccatatgtgaattcaagagaaattaatgttgatgcatgtagtctagtttatatttttggctatctagtattttgtcatgtaaataaatcacaatttgtttatccatttcccctatgatgagctttaagttgttccacaaagttgagtcttgcaaaggttgctagactgaacatccttgtgtattcttgtgtacgtcaactgtgccagttgtggggggagaatatacctagatgaggacttgttgggttggaagacaagttaacttcaattttaccagatagttccaaattactctttggagtgattgtagcagaattcactcccgagtaaatgaaaatttctatttccaaatatcctcaccatatcctcagacattttaaatatttaccaatctgataagtattcttcttgctctcattttcctgatgactactgagattgagcatttttcatgctttttcttgtttcactttaccttctttttctgtaaattatttattgccttatctttttattgcttcataagagttctttatatatcttgggtattaatgctttggtatgcaactagtaaatatctcttcccagtttataacttgccttttaatttaactttttaaatatgtattgactaagaagttagatactagtcatttaactttatgtaattttttattctatagataatttaaatttcggaacagccatatatatgtctagtttcttttcattttgtctttcaatcagctctaataattttctcaactgagatcttgtatgagtttcatttatttttaactatattatagtttttgtttttcttttttaatgagctttttaaatttacattttctaaatgattttttgctggtatatatgagcactatggatggttgtacattaatctttatatgcaacaacattgcttaactctcttgcttttccctacaggaaaatatattaaaataaccatttttttctcccttttcaaaattaattcctattttttgtcttattgcattcattagaaaccccagtacaatgttgaatagcaacattctgtcttcttaaccttaaagacaatacttctagagtttccctattaaatatgaaatttgctatatttttggtatatggccaaaagatgtacatgtaagatgtatcagtcaatatttagatttggaggtaacagaaactcaccccaactatcttaaactgaagttgggtaaatctgattctttaggtcgctgctgagaactccattacggacatcactgcttcttggtactcagcactaattccatcatgttctcattttcatagctaccagaaaaacttctccactgttcttgtatcttactgtcgctctcttgagagtcaaaggcctagatgacagcattcaattagctggagctaggaactaacatgactgagttgggtttttcctttcttgtacgatccaggcccagttttggtgtcaagattgtactagcttcataaaatgaattgaaacacttttctttttccttcccttccttcctttcttttcttctttctttttttttctgaaattgattaagaaaaaaagtatcaggtttttgaaagtttggtaaattgtaaaaccattctggttagtgcatttttagggacagggaaaatagatagacaaaaataataatttattcagttattagttgtctgttcaggctttgctatttctattttggtcatttatattttttggatacatcagtttcttttaatttttaaaagctttgaagataaagctattcacagtattcttttaagttattttttcaaatttgtacagtatttatagttgtcgcttctttttcattcccagtacaattatgtatcgtgctttctcttttcttttgcttgaccaattttgctacatgtttatctattttattagttttttcaaaccagtttttatactagttcatcaggttctaaaaattatgctgcaatacttatggcctaaaaggaatagtaattataatttttagtcatatgtagtaactactaggaaaaactttatttttctgttttaattacattaaaaagtcccctggaaaatatgagttaagtgttttctcctgcggagattgcagtgagccgagatcgcgccactgcactccagactggcgacagagggagactctgtctcaaaataaataaataaataaataaataaaagctttttcctatctagtttttacaaggaaaatcttttttatttatttattgattgatttgttatcataatactttaagttttagggcacatgtgcacaatgtgcaggttagttacatatgtatacatgtgccatgctgctgcgctgcacccactaactcgtcatctagcattaggtatatctcccaatgctatccctcccccttccccccaccccacaacagtccccagagtgtgatgttccccttcctgtgtccatatgttctcattgttcaattcccacctatgagtgagaatatgcggtgtttggttttttgttcttgcgatagtttactaagaatgatgatttccaatttcatccatgtccctacaaaggacatgaactcatcattttttatggctgcatagtattccatggtgtatatgtgccacattttcttaatccagtctatcattgttggacatttggcttggttccaagtctttgctattgtgaataatgccgcaataaacatacgtgtgcatgtgtctttatagcagcgtgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccaggacttgttgtttcctgactttttaatgattgccattctaactggtgtgagatggtatctcattgtggttttgatttgcatttctctggtggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgactaggttgcgaaaattttctcccattttgtaggttgcctgttcactctgatggtagtttcttttgctgtgcagaagttctttagtttaattagatcccatttgtcaattttggcttttgttgctattgcttttggtgttttagacatgaagtccttgcccatgcctatgtcctgaatggtagtgcctaggttttcttctagggtttttatggttttaggtctaacgtttaagtctttaatccatcttgaattgatttttgtataaggtgtaaggaagggatccagtttcagctttctacatatggctagcccgttttcccagcaccatttattaaatagggaatcctttcctcattgcttgtttttctcaggtttgtcaaagatcagatagttgtagatatgcggcgttatttctgagggctctgttctgttccattgatctatgtctctgttttggtgccagtaccatgctgttttggttactgtagccttgtagtatagtttgaagtcaggtagtgtgatgcctccagctttgttcttttggcttaggattgacttggcaatacaaggaaagtcttaacagatgtacacaatttttgagacatataagtaggttttttctccaataaacagatgtttataaaggatttgtacgtgccattatgataaactacaaagataaatacacatgctctgttctctaagagttttccagccaataaaaatttacagctactctttattgtccaccatactctgttatgagccatgggctttagtaagttctcatgacattgggcactgacttcctgggagtgtaagtgactcacctggaccccacagccagtgagcattagtgcttatattccatcctccaaagctctttcttcataccagaccacacatgtggcccaaggagggatatttactctgcacttttagagttctagaaaacattgtttagtggtctggcatcatctatatttacttggcttgatttgggatagagtataatcctagtcctcgatgaaaggattttgatgagttaaccttatggggtgatgggatttatgggattatttccacacttaaaatgatttgtgggaaaaaaaagtgtactaatccctaatttaggattaagacagatatacctatgagatatgggtctataaaattcatcataatttgagaaatgcaacaaataatcacctctaaaatatcttgttggttcagttattttagtccaaaagccagttggagatctgttctgtatcaagggctccagccctcttgtgagaggtagctgtttttcattcgcttgtagtcttgaagtaaaaacaatgtcagggacggtctcctcagaaccccagagggtctgccttttaggaagtgtttgtcccctcagaaacgagaaaccagatgagctgagtttaggggtcagaccagaggaaatggctggaaattagaggtctcctggctaattcacatgatgccaaataacagtctttctgttgggtgtcagaatccagaatggtgggaaatttgtatctaggggatataaaagaaaatgaatgagataatatatgcaaacagatgagtagagtgcctgaaatgtactaatagccttcagtagattccttctccaatttcaccccttctccatctcaggtttggctttcccctggacctgtcaataaaaaccctgagagtttgattgaacaatggcactgtatggtcaatgctaccagactctttaacatgccttgtttgccacaatttcattgaatgggagcagaatggcaaccaaaccaaggctaacagactttgtcctagaattcccacaccaagtaggaagcataaaataacttagagacttgactatagttcctgcagctattagtcatggtgtgttagcagaacacaatctcagaaagttatttcctaaatgccttccaaagccttggttcttcatgcagatagttttggccaactgtaatggcagtgagaaacttcacgagtgtccagaagaacagaatttatactttaagtttaactttgttttggattgaatgttccttaaaaataaaccttcacctgattcttattttcatttcaattccatgggctggtgatttgagtgtcagggatagagttcttagaatctgtttatgtggtgtgaatacagaaatggtctgattctgagtattaggatcatgatcagagttttgatataaactcaaaacctcactaagccacatgttattttttgaagcatagaaattggactttgcaaacaaccaaaatccttttgtttgagaaactctaaataagcattgagttttcttgccatgaagttttacactgtatctagaaagtttctttgaaaaattcctctgtaaacctaaggctgacaaagaagttggctagttgaagggaaaatgatacttatgttttgtggcaagggggaacaaaaggagggggaaaagtaattactgtccacttaacattttatattaaatttctaatgcataattttcaagacgggcaagagttttggtttgttttaaccaaatatagttacaatattaaatacgtgttctaaatccagcatgtgaatatcacttcttcaaaaaatttttaattttttaaattgaaaaataaatatatgtatttatggtgtacaacgtgatgctttgaaatatgtatatatcgtagaatagctaaatgatgctaatttacatatgcattaccttacatattcatcatttttttgtggtgagagcacttaaaatctgctgccttagaaatttacaagtacacaatgttattaactacagttaccatgttgtacaatagatatcttaaacttattcctcctgtctaaccgaaattttgtatcctttcaccaacatttccccaacccctcatccccccactcctcaccagtaaccatcattctactctctgcttctgtagttcaatttttttagattctacatataagtgagatcatgcggtatttgtctttgtgtacctggccaatttcacttaacataacgtcctctagtttcatccatgttgttgcaaatgacaggatttctttcttttttaagactgagtagtattctattgtgtatatgtgccacttaaaaaaaatccattcatgtgtagatggacactttggctgattccaaatcttgactattgtgaataatgctgcaatgaacatgggaatgcagatatctctttgacatactgatttcatttctttgaatatatgcccataagagggattgctgaatcatatggtggctctatttttaagtttttcaggggcttccatgctgctttccacagtggctgtaccaatttgcaatcctaccaacagtccacaagtgatccattttctccacaccttcaccaacatttatctcgtctttgtgttgataaccatcctaacagatgtgaggtgatctctcactacggttttgatttgtgtttccctgttgattaatgatgttgagcatttttaaatgtttctgttggctatttgtatttctgtatgtcttcttttgaggagtgtttccaggtcctttgaccatttttaatgggttatttgttttcttgctattgagttgagtttcttatatatactggatattagcccctcaccagatatatagttcacaaatattttctccttgtccatgagctgccttttcattgtgttgtttcccttgctatgcagaagctttttaatttgatgtaattccaccttttgtttgcttccttttattgcctgtgctttgggggtcatatctaaaatatcattaatgagcagcttttccccattgttttcttcaagatcaatgtcaaagaggttttcctttctgttttcttctagtttgaggacttatgtttggatttttaatccattttgagttgatttttgtgtctagtataggggtctagtttcattttttggtatgtggatatacagttttcctaacaccacttattgaaaagactatcaatttattaaagaaaagttttgatttgttttatccaaacacagttacaatgttagatgtgtgttggaaaccagcatgtgaatgtcacctcaacaaattttaacaacagaaggaatgggaacagcaaggggatgaggaaataaacagaacataggatttaacaatcaatgggatattaacacatttatgcctgaggttgcaattttttgcatttttgcaatcagaccttgcaatgaccttgagcagtaagatataataactcccatgcttagcgttccaataatggaacactaggcataaatgggtttaagggcacttggggtcacagatgtaagcttagaaggggattaaatgtggccaatgccttgcttttgcccatttaaaaaatttcaactaattctgatgttgttctaacattctgtgattacaggatggtaagtttgcatggtggaagatcagattgggcaccaggataatggccacagggacctcagtagagctcccagtaactcaagggcaccaggagtatgtaaggagtggagagagtgcacaaagaaaaacttgacccacttcataatttaagctaatgtcaatccgcctggcacttcagagtcttatttctcaaaacgtggccccagaacagctggtacccaaatgccctgtgggtctgttaaaaatttaagttcccagaagacactctaaaccagtggaatcagaacactgggaatggggtctgagaagatacattccaaacaaatagcctaggcaattcttaggtactctcgtgattgaacctctgcaccaaagagggaaaagtataagttagaaaggaatttataagcaccatacacaaaaatagccatgactcaggcctccacatctcatttgtgctgtcacttcccctgggaagcctgatcaccccaaatgccgcattgtataatcttttttttttttttttttgaaatggagtgtcactctgtcgcccaggctggagtacaatgacatgatctcggctcattgcaagctccgcctcctgggttaaagtgattctcctgcctcagcctcctgagtagctgggattacaggtacctaccaccacacctggccaattttttgtattgttagtagagatgaggtttcatcatgttggccaggctggtctcgaactcctgacctcaaatgatccacctacctcggcatcccaaagtgcaggaattacaatagtacctaacatactctattgaattgctggcttttctttctctttagcccatgtaatccagtgtcattcatctcctctgcttaacaaagagcttagttcatgaaagccgcccaataaatgttctttaaattaataaatgacttcatgtcttgctgttccaaaatatactccttaacctgcctgaatactttcacttcactttgccaattatttcatttggtatatctgagaattttagtttaaataatgaaatcagtcagttatccagtagggtcaattaattccactttcgctttcccaaagattgtagagcaaccacacacagcgaatgaggaagcagtgatgcaagtaattttgaaacacagttttagagttaaattgtttctggatgcaggcatacaataaatgggtaagtgctgtgtgggggacactgagcaccgaagagttggagggaaagccccagggagttatgaaagggagtacagggaacagggaagaaaaggaagatgtaacctacttatctaaaacttttacctagaaatgaacctgcattcagggtcatggtgggagaaaacactcctcctcctttgatggctgtgacctcctcatagttcctgaacatagcactcaagctggtcctaatcccactacatgaataagtgaaataggctttgagaaactagtctgaaaagttggtcaccctatgaaaaaatgcatgcaaaatcccagaaaacatttcaaaacttttgaaatctaaccaactcagaaattgagcaaagccaagattagatgtgtcttgcagatcaacttagtgaaagcagatgttactcgtgaagacaaaggtcaggaccctagagacataacaagaaatattttatgagaaggaaacttgatgtggattgaaaggcagaagaaatgaaaagaaaaaggcacatgaacatttttaagcaattgtaacagaatgaccaaattgcctgaaccccagacatatgataaatcatataacatgaataggcccccttcaaattggtggcatgcaacatggcaaaacccatctctactaaaaatacaaaaatcagctgggcttggtggcgggcacctgtagtcccaactactcaggaggcagagacaggagaatcgcttgaacccaggaggcagaggttgcagtgagccaagatcatgtcactgcacttcagcctgggtgacacagcaagactttatctcaaaaaaaaaaaaaaatggttgcatgagcaattatagtgatggtgactccagttttgccaagatataagcaagattgaacaggccagaaaatgtggatatgttagtgcaagcaaatcatcaattctttttttttttttttttttgtatttaagttctgaggtacatgtgcagaatgtggaggtttgttacataggtatacatgtgccatggctgtttgctgcacccatcaacccgtcatctacattaggtatttctcctaatgctatccctcccctagcctcccaccccccaacaggccccggtgtgtgatgttcccctccctgtgtccatgtgttcttattgttcaactcccacttacgagtgagaacatgcagtgtttggttttctgttctggtgttagtttgctgagaatgatggtttccagcttcacccatgtccccacaaaggacatgaactcatccttttttatggatgcatagtattctatagtgtatgtgcgccacattttctttattcagtctatcattgatgggcatttgggttggttccaagtctttactcttgtgaacagtgctgcaataaacatacatgtgcatgtgtctttatagtagaatgacttataatcctttgggtatatacccagtaatgggattgctgggtcaaatggtatttctagttctagatccttgaggaatcgccacactgtcttccacaatggttgaactaatttacactcctaccaacagtgtaaaacaaaacaacatatatttattaaacatatgtgtctctgtctgtgtgtgttacacttaggcacataaaagatatttaacaaacattgttgaatggataaatgactgaatgagcagctactatgtgtcaggtgctagaaatagccaaaatgttctaaaagactgtggggaattagcaattccttttagaacaggagtccccaaccctggggccatgaaccagtacctgtccgtggtctgttagaaaccaggccacatagaggaagtgagtggcaggtgagtgagcaaagcttcatctgtattttacagctgctccccatccctcacattaccacctgagctctgcctcctgtcagatcagcagtggcattagattcttataggaaagtgaaccctattgtgaactgcacatgcgagggacctagactgcgtgttccttaagagaatctaatgcctgatgacctgaggtggaactgaggcagcgatgctagcactcagcagcagctgcaaatacaggttaacatcagcagagaggcttgactgcatagaaaccataataaatcaattgcttgcagactcatatcaaaaccctaaaagtgagtgacatgtgacaagtaagctgcatctggtggcaagctttatagtggcaagtgagttgatgtacttcaattgtacagctgtatctggtatccttaaaagtatgtttcagacaatttcaaatctccatatgttctggattgaagtcaaggcagaatatcctgagattgctacaaaagctctgaaaagcctgcttccatttccaacatcctatctttgtgaagcagggttttctgcagtgacagcaaccaaaatgagattacagagtagactggacataagcaacacactttgggtgtcactgtctcccatcacccacagatgggaccatctagttgcaggaaaacaagctcggggctcccactgactccacattatggtgagttgcataattatttcattatatattaccatgtaataataatagaaataacatgcacaatacatgtaatatgcttgattcatcccagaaccatgcccccgaccctgccagtctatggaaaaattgtcttccatgaaactggtccctggtaccaaaaaggttgggaaccgctgctctagaatgtcccccttggctgaggagtccctgatcaaccactgaggctctgcttaagtgttccctcccctgcaaagtctactatcaccctaattaattactattccactgaaaagctcatcccaccatcttacactggttagatgttttacctgcttgtcttcattactaggataaggggaaaaaagattctgggtttgttccatatttgttttccccaaatctactgtttgtaatagggaaagggagaaaggaaaggcataagaaagagaagagaggacagtaggcagggaaagaaggagagcaaggtgaagtaaatcatgttcttttgcccctaaggaaattatgttacatggtaggtttgttgttagatactgagaccctgattctaccttatattcaatggacattgtttaattgcatttattgctttaccactctggaaagaaatgtattaatttaaaatgttttggatcaattatttctttttattacagttcttacggcttattgaaaccactcagcacacttttaaatatgtaaaatgtatgatctgagtcatgataaaaaagaaatttcataggtaacagcatcagtaaatatgtggctgcactttcagtgctgacctacctatattcttttctgagtttacaacctcagttatcaacaactgacattactcaatagttggcacatggcatccaatgcatggacttgaaagtaggcttttaaaattacagtaatcggccgcgtgcggtggctcacgcctgtaatcccagcactttgggaggcggaagtgggcagatcacgaggtcaggagatcaaaaccatcctggctaacatggtgaaaccccgtctctactaaaaatacaaaaaaaaaaaaaaaaagccaggcgtggtggtgggtgcctgtagtcccagctacttgggaggctgaggcaagagaatggcgtgaacacgagaggcggagcttgcagtgagccgagatagtgccactgcactccagcctgggcaacagagcgagactccgtctcaaaaacaaaaacaaaacaaacaacaaaaaaattacagtaattactgtgggcatgataattgtatgtgtcaacttgtgttgtgtgccacagtgtttccagatatttggtcaaagagttttctggctgtggctgagggggtgtcttcgatgagattaacatttgcatcagcagactgagtgctatgatttgaatgtttgtgtcctcctctccccagaattcatttattgaaactaacccttaatatggtggtattaagatgtggggtgtttggggccgggcacggtggctcacacctgtaataccagcactttgggaggctgaggcaggtggattacaaggtcaggagatcgagaccatcctggccaacatggtgaaaccccatctctactaaaaatacaaaaattagccgggcatggtggcacatacctgtagtcccagctacttgggaggctgaggcacaagaatcgcttgaacccgggaggcagaggttgcagggagccaagatcatgccactgcactccagcccgggcgacaaagcgagacttcatctcaaaagaacaaaaaaaaagatgtggggcgtttgggaggtgattgggtcatgaaggtggagcgctcattaatgagcttattaaggagattactgcccttagaaaagagcccaagaagtctatgtgctccttctgccatctaaggacacagctagaaggcaccaaagagcaagtccccaccagacactcagtttgctgtgtgcatgtggagatctcttggtgccttgatcttgggcttcccagtttctagaaggtgagaaataaatttctattgtccataaattactcagtttaacatattctgttatagcagcccaatggcctaagacactgagtaaagcagattgacctgaataggctataaatggaaaggaaaactcttcctgcctgactgcttgatctgggacatcagtctttatctgtcttctgactcaaactaaaacatcagccctttggggagtctcaagcctactggcttgagataaggggaaagacccacccccatgattcaattaccttccactgagtccctcccacagcacatgggaattcaagataaatttgggtggggacacagccaaaccacatcatcagggttttcttacatagtgttgataatcctttccagggtactgggtgtaatgagccttaaaggtctttaggaccctgatgtaaagactaaattaaagatgtgtgtttgggggcaagtagaccacttcagcacctccagtgttgaactcatggagttctgggtggccaggggcattgttcaatatcaaaagaaccttaaatggcagtcccttactggcaaggtacctcctgacttgagggacaaagcataaatggagtcaatccagaaaaagagttctcattgtacaggccttcttgtacaaccaaaagattggcaggtggtgtttaacttttcccttcaaggctcaggggttagctgctttatagataagggcagtccttatcataaaccgaactgcatttgcacaaaacagtagaggtagcccatctcttcctgccttaaatcctggtgctgacttctttttcttactaataaatgtccttcatggcatttttttgcagaacagggcacctttatttgcattaaaaacctatttagtacacctactatgtaccccctaaaattttaaaaaattaaaatctatttaggcagatattcttctcagtgattgtcttaatggtgcctgggaactcatctgctgcctattggttggcaaaacctgattctcctgttatcgtcacatttttaaaaccaaacatctttctaaaactatcacaccatcttttgctggcattaaattcttcagctttagttcctttaacttccttttactttaagttgttatatgacttcactttttttcaaataataatagagtatttaggcatggtttttttttgtttgtttgtttgtttgttttagatggagtcttgctctgtcaccagtctggagtgcagtggcgcaatctcggctcactgcaacctccaccttccgggttcaagcgattcttctgcctcagcctcccgagtagctgggactacaggtgcacgccaccatgcctggctaattttttgtattttagtagagacagggtttcaccattttggccaggatggtctcgatctcctgacctcatgatctgcccaccttggcctcccaaagtgctgggattacaggcttgggccaccgtgcctggccaggtatgcctttcttatagcaattctgcaccgacataaaagctccattttcaatatgagataaaaaggtattttgcaaaaagtataagtttttatacctgctggtgtagctgcagtgacagcctcatgaattttctttcttttttaacaatgggccttgcactagattcatttatcttgaaatggcaggcaatcgcagctgcagacctccatctatggtaaacatcaagcagttcaactttttcctgtcatgatttttctctgcttcttgggagcactttcagcaacactaatggcactttgtatagatcccatggtgttattcaaggtttacagtattgcactaaatataatgaaaaatatgtgagaacagtgagaggtcactttttactgtcatatggaatttactggagacacaaactgcttatacagagataattagtgacatgaaattttaagcagatacttgcaacacctgagcttagcacaaaagcaacaggagctggctatgacatttttgcagtaatacagtatgtacagttaattgtatgcagtaatgatttaatactttatgtttgctcacatttctcttgactgtgaatggtacatgtgcagtctgtatttgggtttgaaagttttgagaaattttaactttttataatagatttgtatgtattttatcataatgtatgataaaacagatgagtatatccctagcttttttcttaatttctttttatatttccaggccatatggttcaactgcaagtttttaaaaattgttgcaaatctccaaaaaaggattcaatatgtttattttttaaaattgtatataattaaacttgcagttcaaagatagacttgaaccctaattattccaatggataaatcagtataaatatgtagttattttttttttaacatgagaagagatgggaagttggttttggacaaatctgaagctgtttctatgatattctataatattggtttgtttccttgatatttatgtatctttcacataaaaataaaatataatagacaatacattaaactgggagcccagaaactttggttctaggattgaattatatgtgagacattcaataaatcactgaaccttctaggcttgagttccctcactttgaaagtgaaaggatgaaatatttagtttcaggatactaaagacatcttgatccctaaactgctttctggaaaaaagccaaaagcaacaaggaaatttagcagtacacactcccatctgtcattattagaaaatcttcattaacttcaaccataatatatatgaagaaaggctggcaagtatagtgaatttggaccagagagaggcaagaaactgaaagaagatggttactggacctcaaaggatgacagtgcagaggtctttgaagtaagtgatacacatcaaggggtaagacatgatagaacaagatggatggcctcaaggagctcctgaaaccccacaagaaacccctccaatgcaggggatgtgatgacaaatgaagacacatgcagacaagctaactctacaagaaactatctgtttggaagaccagatgagaaactgaatgataagcagcttgaggctgtcaatctttatccgccattgaatgtaaactccagggaggcagaaattttttttctgatttatctattgctgtattctccaaacctagagcagtacctggcacaaagcaggtgcacaataaatatttgtatgatggatggatgagtaaagaaagattacagctaaaccacacaatcgacatacttgtgtgtatgtgtgtgtgtatatgcacacgcatgcaaacatgcaaacattaccctgtcacctctagagaaaaatcccttcattattgaaaaggaattaacataggatttatgcaaaaataaccctatttacataaagaagcaaggcaacaaaacaaataaaaatcataaaaagggcaaccaccaaaaatatttttattgccctagagaaggtaaaacttgtgaccaaagttatctgtgagttcataaaacttaatgaataaggtgacctttctgtgttaggactccagagtgaagataagaagtctcaaatttaaaaaaagataaggcaataaaaaatgttaaaaaaggtatttggtagatcttgggatagaagtaaaagagcaaaataaaaacatcaaagaaataaaagctttgggccaggcacagtggctcacacctgtaatcccagcactttggaaggtagaggcaggcagatcacctgaggtcaggagttcaagaccagcctggccaacacagtgaaacctcgtctctactaaaaatacaaaaattagctgggtgtggtggcgggcacctataatcccagctatttgggaggctgaggcaggggaatcacttgaacctgggaggcggaggttgcagtgagccaagatcacgccactgcactccagcctgggcaacaagagtgaaactccatctcaaaaaaaaaaaaaaaagaaaggccttaatgggaacagcaatgttgcccatgttgaaaatataagtgaagacattcatgacatcttgagaaagtggagcaaaatgaaatagaaaagaaaaaagactagagtaggaaaaaattgtagatcgagaacacaggggaaattgacaggtacaacacattggatttttattagaaattatatgtaaaacattcaatattcttgtttttaaagacaaaatcagaaaaaaatggagaacaaaaatatccaaagttatatcaaaaaactcctgaaataagagatttgaatctgtagaattaaaggacacacaatattccagcaaacataaatatctattaatttccatgcataatctagtaaagttaaggaacttcaaagaaaaataaagaacccaagagtatctaaaaaaggtgagggcataaatatcttatctgaaaagcaaaagaataaagctagcttcaaatttctctccattcagtgctaggaataatgaaatcatcaagttctcagggtaacaaagtatgacccctaaattatatacccagacacaccaggcttgtttcttctgtccatctgtgcaataactttttcaaatgtgtaaaacgtaggggaaaaaaacctacatgagctttaaaaaagctgttagccaactaggtcaaccaagatataaatgatgagctatgagcattaagtcattttaaatttaaaactaaggttaaaatgacttcaggaaattagggtgtgcagaacagaatagaaatgtaataagttatccctttataaaaataatataactaacaaaaatcaggagcgagagggaaatgaaaatgggagataatttaagtaccaatcttctcatttttaaatatattgtttaaggctgatctgagactaaggctgatctaagattaagcacataactaaccaaaatgagtgtagcagaaaagaaaagcaagaagatggaagtaactggacatattctaaaagcatcattcatagtgagaaattaataggtactgtttaaaggaagagagaccttacgatacataaagttatatcttacaaagtaacaaattactagaggaactcaagtagatcataagcctttcatattatgaaaaattgaccttagaaatcacagaccaatggtaaaatattaaaaacaaagtgtaatgaacttatccttccaggaatgctggtttacatcacataaaccactcctggtaagaaaaattagcaaagcaggattcaaaaaaatttaatcgcaaaatagtaaacaattatgaaacaaagaggagaaaaagggaaatcagagaggtaaatcctaggaacgtgattcaaggaatagttgagcagaggtttggcagcactatagggctagacagtaagaaaaaaaaatctatcaagaaaggatctctgataaaccccctacattgagttgggatcccaaagggctccatctagtagtaaggggtagctggaaaaaaaacttgggacagaagtccagttttcaaccatcttagttcctctaattggattacggtaatataagattgctagttcccctaaccaactgccatgagcaaatggaaatcctaccaggaaatacaattttaggcttcaaatgatttcaacactttttgtatacaacatcttgcacacaataaaaagtaaccagacaaatgagaagagaagatgatgtaataaaaaattgagagaaataccagcaacagaaatgaatgcacaggagattcagaatatgaataatcagacattttacaatttttaatagagaaaatttttttaaacccaaaatggattctttgaaaagactaataaaattgataaacctttggtaaggttgattgaggaaataaagaatcagaaataaaaaaggagtctattatcacagagcctatagatatttttaaattatattatttaaatatattaactttatgtctctaaatttgaaatttttaataaaatggatatatttctataaaaaacaatttaccaaaactgacatatgaagaaatagaaaatatgaatcattctgtaacctttaaaagaattaaaaaccataacaaaggccatcatgatttccccagagttatttaactcccttttcccatgtaaaatttacttccaaatctttgagaaggcattccttacttcagcaataggaatcttcagggttttttttaattatgaggacatattttcccttcctcatcttatttaactcagtgttataaaactgttctatgatttacttttgaggattatatatattagcttctcatatatttcataccctaggagtttagatcatatagcatgatagtgaagggagaaagggagaaaagtgggagacatggaaggggagcgaaaagagagctgtcctgatttggattgttacagttccatatctgcacccccagcagtttatttatgatggagagaaaataagtaaaaatatatgtgacttgattttcagtttgaaaatgtgttaatgagaaaaaaacccaaatcaatctaattctttatgcttactttatggaaataaaaaatttctgtactatgtggtagaaatgagtgtgtgccattctgggaaactgttcttcagaccacctggtgacctatcagttaatcaaagcatttgacattttttctaaagaaaagagggtgaaataataacttggcctttcttaaaaaaatatacccatggattctgtatccttgccagttgtctattacatagtttgttgagactgcccaacgttgtctggaatttccaagcctcagcgctataaaaataattcactagaactgcctcaaaataatttatattgtgtaattacttaacactgcactttggactacagtatgggatggatatgctaggaattatgctgggttcagtgagagttctgcacaaaggcctcttttgccgtaactaccaggttcttgatgtttaaggaattgtgttgataggccctagaaacttaggacctacaattactggagcatatttattgcagcacagaagagagttgatggtggctgatacaatattggtataaacaaggtcactagtgttccagtatgaacattcaagagcccttagggaaaacaaagaagtcactttcacaaagaactttcaattgcctgctctctgatactaaaacagaatttaaaaatgaacctagttcattttttttcttgtctcttggcgaaaagaccacagaaaactgatccttcacttaatttcaagcaaaaattgtattgtttttggtgaaatccattttttacctcaaggattcagcctaaggttatcacatcaaaatatattttctttaaaaatctgaagtttggccttgaattttaaaggaaattctgcttgaattattatataggatgaaatatttaagtattaatctttttttctctctttcaatgaattaagacaaatacaagcaccttttaaaaatcaggcagggaaataaatgctaattaaattctcttaccagtagtttttcattttgtgaaacaaacttttctagatcggatagactttactgacgagtgtttttgataatgctgaatggaattgagtatgacctcccagatacagatgcatttggacttctcatccacttagtctttttcattcaaactggaaaatcatgtggtttcatttttattatttttttaattgagaggattgtcaggagaaaatatgtatgtggctttatttttattttaaccaataagattgtcagtaggaaatgcattctgaatatagcacacatggggcaaatgttcctttttggtcatgacattttttcattataatggaggtttgccagggcatataccatgttttaatgccttttacatataaaatcacaacaagataagactttagacctctctgtaaaagctgcggtataatgggaactagcatgctctgactggttgcctcaattaataaaacagtcaggaaatctcgagggtttccttccacagatttgagtatcccttgatgacctgcataaaccctagttcttataaatctgttcactctcctgcaccggaggaaggggagatggaaagctggcctgttggtgacatacacagcattatgcttagaaaagtatgggtttcttccatgctaccatcctactcttggcatgaaattatactttgtgatcctacagtcatacatatgaaggaactacacacataggagacagcgtgaccctaggctctgactgggtatctttgtttatattttgataaagaagtttatggaaaaagttatttttaattgaacaataatttgaggcatggtaaaaaaaatatgtattgtctaggaattattatttaatatttagaaaaaaacatgaggctttaacttgaagaaataaatatattttcagggaaaatctatgttgtttcttatttatttgcactttggtactctagaacaccattaggatgtcttgtttcagattttaaaggtaggtattatccctgtgatccttcgtgtgcaaactagcttagcaacctgcgcccaggagagtaaccacagaggcagtggatctatcccatgctcccttgcatgaaccagcctggcactttgcccacagggaagcagcgccagaaccagcaaactagccacacaaactctagcagcctaggtcacagaggcacttacaggcatcactgacattgactatagaaacttcagagaggctacactactgtcctcacccagaaccaaagccaatgcactctacccaactgactccctaggacacaccttcaggtgaaagtcttcccctctggaagctactgtataaaactggaagaggcaattcttccaccagatgcataggtatcaacagagggacacaagaaacacgacactgccaaataagcacagtgattccccagttacttaacacaaagaaatagaaatttatgaatcttaaggaaactcagatacaagagaacatagatagacatttcaaatacattgggaagataatttatgatctgtatgagaaattgaacaaagagatagatatcattaaaaagaaccaaacaaacttccacttgagcagcctgagacatccatgggtgggggtattttctccctcaactgttcctaccacaggcttcctgaggtttttcctagtgaggccaagagggtctttgaggaaaactgcatccagacatgccttgagggaaggtgtcaaatgcaggagcatggaaaagagttacaatttggatatgaaaccatttttctagcccaccttagagaagactgttgacacactggtcaaaatggttccaatcgcctaccttgcaagacacttcaggttcaaagaatttcccttgtaaaagcaacaagggagttgtcagagttttccatttagatcaacaaattcaagttcttaccatggaaaattcagagaagactgtagtggttctccttgcttgtggctccttcaatcctgtcaccaacatgcacctcaggttgtttgaactagccaaggactgcatgaattgaacaggaagatagagagttgtcgaaggcataatctctcctgttggtgatgcatacaagaagaagggactcatgcctgcccatcaccaggtcatcatggcagaacttgccaccaagaattccaaattggtggaagttgatacatggaaaaattttcagaaggagtggatagaggctgttaagatgctaagatactatcaagataaactggaggctagtgactgtgatcaacagcagaactcacctacactagaaaggcctggacgaaagaggaattccatgagctgaacaaagacaagcttctagtcaaaagagatccctagagccaaaaacaaaaggtgcaccaaaagtcaagctgctgtgtggggcagatttactggagtcctttggtgttcccaatttctggaagagtgaagacatcacccaaatcatggcagactatgggctcatatgcattactcaagctggaaatgctgctcagaaattcatctatgaatctgatgtgctatggaaacactggagcaacattcatgtggtgaatgaatggatcactaatgatatctcatccacaaaaatctgaagagccctcagaaggggccagagcatccactacttggtactagatcttgtccaagaatacatcgaaaagcataatttgtacagctccaagagtgaagacactccgagagtgaagacagtgaagacagctccgaaagtgaatgacaggggccatcctggccactttacagagaaacactgcagaagctaaggcatagaaattctgcagcatgatgttttgcactttcctttcagggtttgaaacaatctgggtgttaataactgggaaaagaaattgtggtcctgttgcataaactaaagattaaaagtttagtaaaaatcagtggtaagttaaaatcagggtttttttttttttctttttatcagaagttgctaagatgaatgttttccatatggtctttttctaaaaaaaaaaaaaaaatgtacaattctctttatctttaaaccaagagcttagcagcacacaaaaaccagaagaattttcagtgaaactagctacaaataagaaatcaaaaagtacagcctagctctaccacataaaagaagcaaagtgtgaaaagcaaaagttcacttaaaattctaatttaggttatgaagagaattgacattttatgcatgcctgctgtgggtaatctgcagctagggtagacaaaggaaggaattcttatagtggtgatcttgtaaaatgcaccattgataaatcatctccagttatgcaaaataaaggttgtgcatatgcctggcagaaacattgtaccaatagttagttctctgtggcacacatcacaattgctgactaaagtttggcaagacctatcggcctggagcttcctctttagaagtaggaagtgaagtccaagccctcatatgtttagaaaagtatgcaagttttctgatgcctaccagaggtagagacctgctgccttatactttatacacagttacttttccttgttatgggtcatgctctagccttggtcatccaccctctctttatcttcagaaacaatttcagagttgacatcatgttaccttgaagtgagagaaccacagagaatgagaagtctattcaaggattttatgtctgaatgctcttagcctttattgatagcttaatcagaagatctaagtggggtgcagtggcacatgctctgtagtcccatctacctgagaggctggagcagaaggatcgcttgagcccaggagtttgacaccagcctgggcaaaatagtgagaactcattttttaaaactgtgaagtttctgaagggccctgctgtttctgttccagccaactgtgaatctgccatttgtgaatttaagcagaaaaagggtctgttttctcatatttttttcttcttgcccttttgtatgaagtttaacctaaagtagtattctcaaataattagtcatagcttcatgttaaaaacacatgcttgttacatggttttccactgattaaaattttgtggaaatttcaccaattgctaaagcagaaagaccagaaatagctttttatagaatcgttttggggtttgcgaaaattgtcctatgacagaaacaggactaaagttaaatttctaatgaaaacataataatttgcctttttgcaatttctatttcattcctacacaaacccagatgaagggtttgtaactccagaagaaaaaaaatacttagatatgtgcaattgtatagtcagatctgaatctacagtttaaaaaataaaaatgttaaataaagttaagcaaacatatgtgcttcagctcccaacttactcttactaaagccttcgggccaattcccaaaaaacagggagggtgcaaagcctgacacctagcagctttcaggatccatctgccaagtgaatgaaaggttggaatctcaaatcctacagataagagtcatttttctcctcctcagcttcttggagtttaagagttgaagcggccctgaaaagtaatgattgagcatgaagaagctataagaattgaactttgataccttctgggaaataatacacagtttatctgaagtgttgtgtaaactgcagaaaggttccaatgctagaaaattctctcatactgtcatgccttcccacttagaagtgcccatgccctgctcagctgtgactctactgacctcaggacctcactggacaagtcatgtggtaacccttgcaggagacctgataatggtgaaatgattctattgttatattatttatggagcaacaactttgtacagagaacgagctgcttggctttttcttccaatgccgaggatgctgctgatgctgccatgtaacagcatacttttgggtgtcctcaaggatagaacttcccctctgaataatggaaattagaacaatgaacttcacaggggaataaatattaattactgatgtgaagaaaatattccattgtttattccctaccacatcatttccataattggctgttgtactgtgaatttagaggaaatgggtaatgcttgtgttttgttttgcttctttgtttgatgctgggggttttatgtgttgtacactttaccccttacattgcataatttgaatgcagcaaacaaacccgcaataaaagtcatttattggcatcttcattcagatgaatggagagcctttgtggtagtgtcaaaaaaaataaaaataaataaaaataaaaagaaccaaacagaaattttggagctgaaaaatttaaccaataaaatgaagaaatacaattcagagcttcaatagcagactaaattaagcagaagacaaaaatttgtgaacttaaagacaggtcttttcaaataacctagtcagagatccaaaagaaaaaagaataaaaagaacaaccaaggccagctggacttctgggacaccaactaagcaaacaaatatttgcattatgggatttccataggacaaagatgaagagagacacagaaaggttacttaaaaaaacaacagttaaaaacttcccacgtctttggagagatatgtacatccagctccatgaagcacaaaggatcccaaacagattcaacccaaagaggttctctccaaagcacattttaatcaaatcatcaaaagttaaagacagaattccaaaagcagtgagagaagagaatcaagttacatataagggaatccccactagactatcagcagatttctcaacaaaaactgcaggccaagaaagaaccagataataaatttgaagtgcttaaagaggtgaggtgggggtgcgggggaactgtctacctagaatactacacccagaaaatttatacttcagaaatgaaggagaaatagtgtttctaggcaagagaaagctgaggtaatccatcactgctagaccagccatataagaaatgctagagagaatgcttcaactggatgtattaggaaaataattactagtatgaaaaaaagaaagtataatctcattggtaggagtaaatttattatcaaatttagaatactccattactgtagtggtggtatataaactttcagttgtctagtttgaagattaaaagtcaaaatggtcaatgattactatagctacaacaagttgttaaaatacgtacaggatatgaaaggatacaaagtaagcaacaaagttataaatttggtgggggaggccaggtgcagtagctcatgcctgtaatcccaacactttgggaggccgaggtgggtggatcacctgaggtcagaagtttgagaccagcctggccaaaatggtgaaaccccatctctactaaaaatacaaaaattagctgggtgtggtggtgtgtgcctgcagtcccaggtactcaggaggctgaggcaggagaattgcttgaacccgggagacgaggttgcagtgagccaagattgcaccattgtactctagcccaggcaacaaagcaagactcagtctcaaaaaaaaaatgtttttaataaaaaataaacaaatttgggaggtagaaggtaagtctagaatacttgcatgtagccaaagttaagttattatcaacttaaattgcctattataactacacagtttttaaaatgtaagccccatggtaaccacaaagaaaaaaattacggcagatacacaatgaaaaagaaaaaaaaaatcaaagtttatcactacaaaaaaaatcaccaaaccacacaggtaaactataagagagggaaaaaggaacaaaggaaatacaaaacaaacaaacaaacaaacaaacaaaaaacagaaaatgatctaacaaaatgtcaagagtaagttcttacctatcaataataaccttgaatgtaaatgaattaaattttccaattaaaagatatagagtggctgaatgggtagaagacaaaacccaactatatgctacctacaagagatttgctttacccataaggacacacgtagactgaaagcgaagggatgaaaaatgatattcaatgcaaatggaagccaaaagactacaagagtagctatacttagataacagataattcaaaaattgaaaggggagacaaagaaggtaaatctatactaaaggggtcaattagcaaccaattaaaacaattctaaatagatatgcacccaacactagagcatatataaagcaaatattataacatctaaagagtgatacagactgcaatacaataatagtaggagatttcaacaccctactttcagcaatagatagatcatccaaactgaaaatcagcaaaaaaaaaaacactggatttatactgcactctagaccaaatggacctaacagatatttgcagaacatttcacccaccagcaacctacagaatacacatttttctcaaaagtacattgaattttctccagaatagattatatgttaggccacaaaacaagtctcaacaaatttttaaaaatcaaaagcatattaagtatttttctgatcacaatggaataaaattagaaactgataagaggaagaattttggaaatcgtgcaaatacatggaaattaaacaacatgctcctggaacaaccaatgggccaatcaaaatatttaaaatgaaaatttaaaatttcttgaaacaaatgaaaatggaaacacaacacacctcaatctatgggatatagcaacagcagttctaagagggaagtttatagcaataaacacctacatcaaaaaaatagaaagatatcaaataaacaacctaacattgtacctcaaggaagtaaaaaaagaaaaaaaaaagaacaagctaaatttaaaattaagaatgaagggaataataaagatcagagcagaaataagtgaaatagaggctaaaaaatagaaaacatcaatgaaacaaagaattattttttaaaaagataaactaaattgacaaacctttcgctagacaaagaaaaaagagataatacacagataaataaaatcagagattaaaaagaagccattatacctgataccacagaaatacagagaatcataagagacaattatgttgtgcacatgtaccctagaacttaaagtataataaaaaataaatatatatatattaaaaataaataaaaagaaatagaaaaaataaaaaaaagaaaatctagaagacatggatattttcctggacacatataacctaccaaaattgataatagaaaatatgaacagatcaataatgagtaacaagattcaatcagtaataaaaatttccgatcacagaaaaccatgggacctgatggcttcattgctgaattctactgaatatttaaagaataattaataccaattcttttgaaactattccaaaaaactgaagaggagataagttcatctaaattcattctatgaggccagcattaccctgatacaaaaacaagacaaggacacaacaaagaaagaaaactacaggcaaaaatcctcaacaaaatacaagcaaacaaaattcaacagcaaattaaaaagagagttcaccatgaccaactgggagatggaaggatgattcatcatatacaaatcaataagcatcatacatcacattaataaaatcaatgacaaaactgatgcaaaaaaagcatttgataaaatttaaaattccttcaggataaaatctctcaacaaattaggtatagaaggaacataccttaacatgataaaggccaaatatgataattccacagctaacatcatactgaacacggaaaagttcaaatcttctcctctaagatctggaacaagacaagcatgcccactttcaacactttcatctacccagagcaattaggaaagagaaagaaataaagggtatccaaatggaaaaggaggaactcaaactgtccctgttttcatataacataattttatatattaaaaaaaccctaaagactccaccataaaactattagaactaataaacaaatttagtaaagttgcaggatacaaaatcaacatacaaaaatcagtagcacttctatgtgccaataaaaaactatctgaaaaataaaccaaaaaagcaatcccacttacaacagttacaaaaaaaagatacttagcaataaatttaaccaagaaggtgaaaaatttctacaatgggaattataaaatgttgatgatgaaattgaagaggacacaagtaaatggataaagatatcttgagttcattgattagaaaaattaatattaaaatgtccatactactcccaaaagatctacagattcaatgaaatccttatcaaaattccaatgacagtttttcaaagaaatagaaaaaaccctaaattcgtatgaagccacaaaacatcttgaatatccaaagcaattttgagtaaaaagaacaaagctgacggcattgtactagctgacttcaagataaactacaaagctatagtaaccaaaacagcatggtactggcattaaaatagacacatagaccaatggaacagaagagagatcacagaaataaatccacgcacttaaagccaattgattttcaacaaacatgccatgaatacacattggggaaagaagagtctcttcaaaaaatggttctgggaaaactggatatccacaagcagaagaatgaaagtagaccccgtctttcatcatatacaaaaaatcaaatcaatattgactagaagcttaaatcaacactaatgataaaattactagaataaaacatagggaaatccctttatgacactggcctaggcaaagatttttttgataacatctgaaaagcataggcaacaaaagcaaaaattgataaatgggattacatcaaactaaaaacttctgcacagcaaagtcaacaattaacaaagtggagagacgacatacagaatgggagaaaatatttgcaaagcatacatctgataaagggttaatatacagaatacaaaagaaacccaaacaactcagcaaaaaaacaaatacagtcatgttccacataacattttggtcaatgataaatgggatctaagtaaactaaagagctttggcacagcaaaagtaactatcaacagagtaaacagacaacctacagaatgggagaaaatttttgcaaattatgtatctgacaaaggtctaatatccagcatctataaggaacttaaacaaatttacaggaaaacaacaaacaacctcattaaaaagtgggcaaaggacatggacaaacacttctcaaaataagatacatccagccaatgatcatatgaaaaaaggctcaacatcactgatcattaaagaaatggaaattaaaaccacaatgagataccatctcagaccagtcagaatagctattattaaaaagtaaaaaaataacagatgctggtgaggttgtagagaaaaaggaatgcttttacactgttggtgggggtgtaaattagttcagccattgtggaagaaggcgtggcgatttctcaaaaacctaaagacagaaataccattcaacccagcaatcccattactcattactaggtatatacccaaagtaatataaattattctcttataaagacatggcacacatatgttcattgcagcactattcacaataccaaagacatggaatcaacctaaatgttcatcaatgatagaatggataaaaaaatgtgttacatatacaccatggaatactatgcagccataaaaaagaacgagatcatgtcctttgcagggacatggatgaagctaggggcaattatccttagcaaacaaatgcaggtacagaaaaccaaatacagcatgtcctcagttataagtgggaactaaataatgagaacacatggacacacagaggggaacaaaacacactggggcctattgaagggtggaaggtgggaggagggagaggatcaggaaaaacaactaatggatattaggcctaataactgggtgatgaaataatctgtacaacaaacccccaggacacaagtttacctatggaacaaacctgcacttgtacccctgaacttaaaagttaaagaaaaattttggtcaatgatagcatatataaaagtgattcaataagatcataatattgtattttttgtgccttttctatggttagatatgcttaggtacacagatatttaccatcatgttacaactgtctacagttttcagtacagtaatatactatacaggtttctagcctaggagcaataagctatacaatctaggtctatgtaagtacattctgtgatgttcacacaataacaacattgcgttgtaatgcatttttcagaatatattccaacccttaaatgatgcatgactgtaatctgattttaaaatgggcaaaagacctaaatagacatttctgaaatggccaacaggtatatgaaaatatgcttaacattaccaatcatcagaggaatataaataaaagtcacaatgagatatcaccttgccccaattagaatgggtattctcaaaataccaaaaaatgacaaatgctagtatagatgtggagaaaagagaactctcatacacttttggtggtaaattaggacagccattatggaaaacagtatgaagtttcctcaaaaaattaaaactagaactattatgtgatccagcaagctcactattgtgtatatgttcaaaggaaatgaaatcagtatgtcaaagagatatctgcactctcatgtttattgcagcactattcacaaaagccaagatatggaatcagcctaagtgttcatcaagagatgaataaagaaaatgtcacaaatatacacaatggaattatatttagccataaaaaatgaaggaaatcttgtcatttggggtaatatggattaatctagaggatgtgatgttaagtgaaataagacagaaagagaaaaacaaatactgtatgatcttactcatatgtgaaatctaaaaaagttgacatcatagaagtagagtgtagggaagtggtgaccacaggcagaagagtgtaggggtaagaggaggatggggagagattagtcaatgggtacaaagttacagttagataagagaaataagttctgtgttctgttgtacagtagggtgactatagttaacgacattgcattgtatatttcaaaatagctaggatagagtgttttcaatgttctcacaacaaagaaatgataaatgtataaggtaattgatatgctaaatgccctgatttggtcattacacaactatacatgtactgaaacttcaccctgtacctgataaatatgtacaattataatgtgtcagtaaaaaacaaaacaaacataagagccgtatataaaaaacccacagccaatatcatactgaatgggcaaaagctggaaataattcccttgaaaactggcacaagacaaggatgccctctctcaccactcctattcaacatagcattggaagttctagggcacgcaggcaagagaaagaaataaagagtattcagattcaaagagaagaagtcaaattatctttgtttgtagataacatgatcctatatctagaaaaccccatagtttcagcccaaaagcttcttaagctgataagcaacttcagcaaattctcaggatataaaatcaatattcaaaaatcactagcattcctgtacacaaacaacaggcaagcagagagccaaatcacgaatgaactcccattcacaactgctacaaaaagaataaaatacctaagaatacagctaaccagggaggtgtaaagtctctacaaggagaactacaaaccactgctcaaagaaatcagaggacataaacaaatggaaaaacattccatgctcatggatagaaagaatcaatattgtgaaaatggtcatactgcccaaagtaatttatagattcaatgctattcccattaaactaccattgacatgctacacagaattagaaaaaactattttaaaattaatatgaaaccaaacagagcccaaatagccaagacaatcctaagcaaaaagaacaaagctggaggcatcatgctacctaacttcaaactacacaacaaggctacagtaatgaaaacagcatggtactgggacaagaacagacacatagaccaatggaacagaaaaaaagaactcggaaacaagtccacacacttacaaacatctgatcttcaacaaacttggcaaaaacaagcaatggggaaatgattccctatttaataaatggtgctgagagtcctggctagccatatgcagaaaactgaaactggaccccttccttacaccatatacaaaaattaactcgagatggattaaagacttaaatgtaaaatccaaaactataaaaatcctagaagaaaatctaggcaataccattcaggacatatgcacaggcaaagatttcatgataaaaacaccgaaagcaattacaacaaaagcaaaaattgacaaatgggatctaattaaagtaaagagcttctgcacagcaaaagaaactatcatcagagtgaacagacaaccaacagaatgggagaaaagttttggaatgtattcatctgacaaaggtctaatatccagaatctacaaggaacttaaatttacaaaaaacaaacaacctcattaaaaaatgggcaaaggacaggaatggacacttcataaaagaagacatacatgggaccaacaatcatacgaaaaaaaggtcaacatcactgatcattagaaaaacccaaatcaaaaccactatgaggccgggacagtggctcatgcctgtaatcccaaaactttgggaggccaaggtgggcggatcacgaggtcaggagattgagactatcctggctaacacggtgaaaccccttctctactaaaaacacaaaaaattatccaggtgtggtggcatgtgcctgcagtcccagctacttgggaggctgaggcaggagacttgcttgaacctgggaggcggaggttgcagtgagccgagattgcgccactgcactccagcctgggcgacagagcaagactctgtctcaaaaaaaaaaaaaaaaacacacacacacatgcacaatgagataccatcttacaccagttcagaatggctattactaaaaagtcaaaaaacaacagatgctggcgagattgcagagaaaaaaagaatgctatacactgtcggtgagagtgtaagttagttcaactattgtggaagactgtgtggtgattcctcaacaatgtagaggcagaaacactatttgacccagcaatcccattacttagcatatacccaaagtagtataaatcattctattacaaagatatgcacacatatattcactacagcactattcacaatagcaaagacgtagaatcaacctaaatgcccatcaatgacagactgaataaagaaaatgtggtacatacacaccatggaatactatgcggccataaaaaggaatgagatcatgtcctttgcagggacatggatggagttggaagatactatcctcatcaaactgatgcaggaagagaaaaccaaacaccacatgttctcacttataagtaggagctgaaagatgaaaaaagagctgggcttatgtccatgtctggttttggtaacagagtaatgttggccttgtacaatgcattagggagaattgccacctcttcaatttttagaaacactttgggaagattggtattagttctttatacatttggtagaattccacagtgaacccatctgatcctgggcttttcttcaatgaaagaattattatttattttaagttctgggatacacgtgtagaacgtgcaggtttgttgcataggtaaatgggtgccatggtggtttgctgcacctatcaacccgtcagctaggtattaagcccagcatcaattagctattcttcctcatgctctccctcccatggcccccaacaggctccagtgtacatcgttccccctcacgtgtccatgtgttctcatcattcagctcccacttggttttttttcatcatcactgctgtttcaatgaaaacataaattcaaaccaatttcacatttactgaataattatggaagctagaaacccacagggtaattacacaaatacaaaatacctacctaaataatatcggacatatactgggtattttggttacctacagctacataagtatttactgtaaaatataaaagtttaaaacaactaccaatttaacatctctaatgatagtgtatatcaggaattggggtaagagatagctgaatcattctcatggcatcatcagagtttactcactggtattcagatgacaaatgggcttttctggagagtccaagatggcattattcacttgtctgctgccttgataaggatggctgaatgctagtctcaggtggaactttgctgcaaggcttcctctaatgtaacctcaaaatttcagaacacacttctgccacattctataatcaagcaaatgatcaaagccagcccagattcccaaagagggaaattggtggccatgtttttacttccataatcagggagaagggcaggaaatatgatccagaacaaacagaaaaatgagttagtagcagcagacacagaatgacagagatgatggaattaacaagaaatgacattaaaacatctattataagtcttctaaacaacctcaaaaaaataaaagaatgcataatcatagtgagaaaaatggaagacataaagaagacctgaaaggaacttctaaagttaaaaatatataaaatgaaaataactggatgagattaacatcagtgaatactacagaagaggaaaaaaatagaacttaaagacttaacaatagaaactagccaaaattaagcccagagaggggaaaaaaatataaaaaaaaaacaaaaaaattgagtgcatcaattacccatatgacaatatcaagtgatctatcttgtgatctatcttatacgtaattggagttccagaaggaaatgagagagaaaaaaacataaagaaaaattttaatgcaacaataatcatatattttccaaatttgataaaaactctaaccccataaattcaagaacctctcaatgaatctcaggaagaataaatataaagaaaatgataccaggacatatcataatcaaactgctgaaaacaagtgataaagagagtatcttaaaagtagccagatttaaaaaatacaaattacctacaaaggaatgaaggttaaaagggaaacaggcttattgtcagaaacttcacaggctggaatacaacagaataacatcattaaagtattggaaaaaacctgtctacatataatggtatatccagtaaaagtgtcttcccatattaaaagtaaaaatacttcctcagataagcaaaagttgagcgaagtcatttccaccagacctgtactaaaaacaaaacacattaaaggaagttcttcaagacagaaagaaaatagaaatttggatctacataaatgaaagaaagaaacaggcatagtgggtagaaaatatgtggttttaaatcaatgtataataattgaaacacacatactgaaaggaaaattaatgcaggagtgttgacacctgaaatgcaaatcaagaatgggaagaactcgctttttggccgtttttcaaataaaattatttttttcctcataaacaacagcacaaacaacggacaccaatacacacacacacacccctcccccaaaatgtttgactatggtattccatatgtctgagtagaatatataggtgataaacatatacatactatttttgaatgcctagcccattgctctgactggattgaaaatgccttaagacaattaggtgttttctccttgaataaaattcactgacaacactttgaaattgtaacgatagatggtgaatttatgaactgccaaaaggcatgtgaaaaccaagaaaaacagttaccctgtgctaaagcccacattgccatttgttaaggacagctcctttccagaacactggacagatgacacatgtttgttcattggctctttttttttttttttttgagacagtcttgctctgtcgcccaggctggagtgcagtggcacgatctcagctcattgcaagctctgccattctcctgcctcagcctcccgagtagctgggactacaggtgcccaccaccatgccctgctaatttttcgtatttttagttgagaccgggtttcaccgtgttagccaggatggtctcgatctcctgacctcatgatccacccacctcagcctcccaaagtgctgggattacaggtgtgagccaccgcgcccggcctgttcattggcttttatatagaagtattaactgaatgcctgctatgtttatggacaacattgtagctaagaccccatatattataattcctgacattcactcaggactttgcaatagatagctcgcttttatatctaccttgctttctcttcataacaataaatgaggagggtggatattattatccctttttcagttgaggttaagaaagccctgactcccaactcatcaccctacttccttcactaaagctgtaatatcctttagactctgtcataaacagaagccttcaggtctcagctgaattcagttttttcatggggacttctcatatacagcagatcttccaataaggtcgttttgttataatgttgatgaaaaaaaacattgattcctggccgggatcactgtccatgggaagttcacacattcttcctatatctacatgggctttcttctgttattattaatatggtttccttccacatcccaaagatgggcatactaggttcgttggcctgtctaaatggtctcaatctgatgagtgcaggggtgtatgtgcgagtgtgtcctgtaatggaatgatgtcaaaggctggttcctactttgctccaagctgccaggatgggctctggccaccagtgaccctgagctggaataagcaggttggaaaatgaatgaatgaataaatacaagttattataaaataaaaaatttttaagtacatgataatcatacaataaacaatgcagtatgaaagcgcttagtgagattactatatttgttgtttgtttctgaactgcgtgatggtaggaggtgcttctgacaatgttcattttgcaaacatttattctttgattgaatctaccaccatgattgccctcactctctgattcaccgaaaattgagtaaatcattatcttgtttttatttttctttcttaaatgtatatatagttcacatttatttcaatgtttaatagtataagtgttttggtctttatttagaagtttggtgatgtttttgtgaccagaaatatgccacaggaatttaactcttgtttatatccattatcctatgataaaattggttttgttatacatcattttcttaaaattgtagtttccaagaacctaaccaggacattaagtgagaatgtactgtactcacgtaggtcttgtattatttcttcatagcatatagttattaaagtgagattttaaaaaaaatgtttggctcccacattggtctcagcttcaggcaggcagaagctttgactctaccatagcaaccccagcactctgaataatgcctggagcatggtaggcactcaatatatgtggtctactaaatgtgtgttggttcctgaaatgcttctagatcaaaactgcatagcaaaggaaggaatctgtctatggttatgtagtttcagaataccatatctatatgtactttataatgaaaagcttgcaggaaaattggctattattactttattaaatgaatttgagtcactcatcctttcttcagattattcatccataaaataacaatgtttgaaaaccatataggtattaaacagtgctcctcaaagcccagatggttctgtgagggttgaggaagagcaaagagatacatttaagtttttttcttttatttacataccaagtaaaagcactacacatattaaatggcagtccaaggctaggtttggttctgtgtccctacccaagtctcatcttgaattgtaatccccacgtgtcaagggagagatctggtgtgaggtgattggatcacagggacggtttcccccatgctattcttggtatagtgagttctcacaagagctgttggtttttaaagtattcggcagttcaccctttgctctctctctcctgccgccatgaagaaggtgcttgtttgcccttcaccttctgctaccttctgccatgattgtgtttcctgaggcctcccaagccatgcagaactgtgagtcaattacccagtctcaggtatttatttatagcagtacaaaaacagactaacacagtttataataaaatgttcccagtaatattgaaggagcactataatgctccctaagaacttagaaacaaatgaaatcaagtaaatttttaaagtaacatacaatggatcataataaagacatataaaatctcttaagggaaacagaataacaccctacaatacgaagaaaacatccatcaggcaggagattgatcagcaataaagccaaaggaaaagtggagtcagagatgagaactctggaaattcccaaccggtctatgtccaggagaaaggaaagttaaatcagtgttcagaccttcaggcaaggtcattttttgtatgaaacaacaatactatgctctcttagcctgagaacattttttaaaatggattcatctcctgttttgattgatttcatgatttcaggcaaacttctgaatatttcatggttccctaaaatagtctgctgagaagaaaaattgctcataccatcacgaatattcagacccatgtgacagttgtatttctcatcatcaataaattggcaaactgatttatgtttttgtttaaaacacctagttagtgttcactatgttcctaacattgttataagtgcttcaaataataatttattacatcttcatagcaactccatgtggtaggtacaatcctataaagataataatagtaaagtaatgcactttttctgttaaaaactatttttaattgacaaataattatatctatttatggggtacagtaggatattttgatatatgcatacattgtgggatgatcaaatcaggctaattaacatgtacaccaccttacgtatttctttgtgatgagaacacttaaaatccacccttttttcaattttgaaagatttgggagattttatgggtcctttccaaaccatcacaataaagtaagtcgcacaattttattttgttttctggtgcatataaaattatgtttacactacatggtgtagtctaccagtgctaagatttctctgtagcatgcaatgctgtttgatagcattttacatgcagtggaatttctttcaaaattggagtcaatcttctcataccctgcttctgctttatcaactaagtttatgtaatattctaaatttctttgttgtcatttaaacaatacgcacagcatcttcacctggactagattccatttcaagaaaccactttctttgctcattcataagaagcaactccttatcgaataaagtttcatgatgagattgcagcaattcagtcacatttcaggctctacttctaactctagttctcttgctattttcaccacatccgtagttacttcctccactgaagtttttaacccctcaaaattatccatagaagttggaattaacttcctccaaactcctgttaatgttgaaattttgaccttctcccatggattacaaatgttcttaatggtatctagaatgatgactcttttccagaaagctttaaatttaccttgtcttggtaactgtgaatactgctgcagtgaatgtggagtgcagacgtttcttcagcttactgatttttattcctttgggtggcatagctggatcatatggtatttctacttttagttttttaaataaccttcatactttttccaaaatagttgtactaattcacatttccacaacacagtgtgtgatggttcccttttctctacatccttgccaacactagctagcattcacctttttgatgacagccatacttacaggtgcagggtgatgtctcattgtggtttaatttgcatttccctgttgagtagtgatgttgagcatttttaactatatctgttggccatttatatgtcttcttctgagaagtgtctatccatgtcatttgcccatttttaatacgagtatatgttttattgagtcatttgagttccttatatatttttgatatgagtcccttatcaaaatgaggccctttgacaatatatttgcaaatattttctcccaatctgcaggttttcttttcactctgttgatggcttcctttgccatgcaaaagattttttagtttgatgcaatcccaattgtctaattttgcttttgttgcctctgctttgggggacatacccatgaaataattgcccagaccaatgtcaaggagcttttctcctagtcttctcttatgagttttacagtttcagatcttacatttaagagtctcacccatcttgagttgattctactatcaagggagagataaagttccaattttatttttctgcatgtggatagccactttttctaacaccatttattgaagagactgttctttcctcattgtgtgttcttggcacctttgttgaaaatcaattgaccacagatatgtgcgtttatctggggactctctaccctattcgattcattgatgtgtctgtttttatggcagtaccctgcagttttggttactataactttgtgatgtattttgcaatcaggtagtttaacgccttaacctttgttatttttgctcgagattgctttggttattcagggtctattgtggctccatacaaattttaaggttgttctatttctgtgaaaaatgacattggaattttgataggattgcactgaatctggagatcactttgggtagtatagacattttaacaatattaattcttccaattcatgaacacagaatatctttccatttctttgtgtcttcaatttcttttatcaatgttttatagttttcagtgtataggttcttctcctccttggttaaatttactccagagtatcttattttttatagctattgcaaatggaattgttttcttaatttttttcagatagttcattgttaccatatagaaacactattaaattttgtatgttgattttgtaacctactttactgaattttattcatcagttctaacaaatttagggggctgagggaggggagagggagagggagagagatttgtactgtactgtaaagaattggttcacatgattatggaggctaagaggctcaagagaagcagttggaaaactgaagacccaggagagccaaaggtatagtatcagtcaaagttgaaagtcctgagaaccaagagagctgatggtataaattctggtttgaatccaatggcctgagaaccaggagagcctgtggtgtagaatttagtccaagtctgaaagcaaagaaaattgatatcccagcttaaagacaagcagagataaataatttttcttactgagccttcaattgattggatgaggcccattcacattgggaagggcaagctgctttattgagtttaccaattcaaatgtcaatctcatccagaaacatcctcacagacacaacacgaaataatgtttaagcaaatatcttcatatcccatgacccaatcaagctaacacataaaattaagcattatacttgtgtacacaaatagacatttttaacttagctgtgcatttctccaaatcctttagcaaattacaaataccaatcaagaatgctgacggaaacatacctacttgtgtgactacaagttaaaacactgataacaccaggtgttggtgaggatgtagagttgactggaactcctatagatcactggtatgagtgaacatgttacaatcactttggaaactggaagtttttgtgatagttaagtatacacttacctatgatccataaatcatattcctagatatttacccaagagcaatgagtatgtgtgtccataaaatgatttgtacatggatgttcttcatagcagctttcttcataatagccccaaactagaaacaaccatcaactggagaatgaacaaaaaaatgcatattcataattagcaataaaaatcactactgatacatgtaataacatagatttgtctcagaaacattatgttgaataaaagaagcaaggcagaaaagtggctaatttttgattatttatgtgaagttaataaacaagaaatctgtgatgatagaagtcagaatagtagttatcctatagaagagcaggattgctgatatagtttgactgtgtccccactcaaatctcatcttgaattcccacatgttgtgggagggacctggtgggaaataattgagtcatgagagcaggtctttcctgtgctgtcttcatgatagtgaataagtctcacaagatctgatggttttaaaaacaggagtttcccttcacaagttgtctttctttgcctgctgccatccatgtaagatgtgacttgctcctccttgccttccgccatgattgtgaggcctcttcagccatgtgaactgcaagtccattaaacctctttttcttcccagtcttgggtatgtctttattagcagtgtgaaaatggattaatacagtaaattggtactgggaatgggttgctgctgaaaagatacctgaaatgtggaagcgactttggaactgggtaacaggcagaggctagagcagtttcgagggctcagaagaaaacaggaaaatgtgggaaagtttggaacttcctagagacttgttgaatgctttgaccaaaatgctgacaatgacatggacaatgaaatctaggctgagatggtctcagatggagatgaggaacttgttgggaactggagcaaaggtgactcttgttatgttttagcaaagagactggcagcattttgcccttgccctggagatttgtggaactttgaacttgagagagatgattagggtatatatatctctatatatctggtggaagaaatttctaagcatcaaagcattcaagatgtgacttgggtgctgttaaaggcattcagttttaaaaaggaaaccaagcataaaagttcaaaaaattcacagcctgacaatgcaacagaaaagaaaatcccattttctgaggagaaattcaagccagctgcagaaaattgcataagtaatgaggagctgaatgttaatccccaagacaatgggaaaaatgtctccagggcatgtcagacaactttgtggcagcccctttcatcacagacatagaggcctaggaggaaaaaatggcatggtgggctgggcctaggttccctctgctgtgtgcactctagggacttagtaacctgcatcccagctgctccagctgtgactaaaaggggccaagatacagctcagaccatggcttcagaggatgcaagccccaagccttggcagcttccacatggtatagagcctgtgggtacacagaagtcaagaattgaggtttgggaacctcctcttagatttcaaaggatatatggaaatgcctggatgtccaggcagaagtttgctgcaggggtgaggcactcatgaagaatctctgctaaggcagtgcagaagggaaatttggggtgggcacccccacacagagtcctcactgaggtactgcctagtggaactgtgagaagagggccaccatcctccagaccccggaatggtagatccacagaccacttgcaccatgcacctggaaaatctacagacactcaacactagcccatgaaagcagctgagagggaggctgtaccctgtaaagccacaggggcagagctgtccaacaccatgggaactcaacccttgcatcagtgtgacctggatgtgagacatggagtcaaaggagatcgttttggagctttaacatttgactgtcctgctgtatttcagacttgctgactttttggacttgtagcccctttgttttggccaatttctcccatttggaatggctgtatttacccaatacttgtatctgcattgtatctaggaagtaactagcttgcttttgattttacaggctcataggttgaagggacttgccttgtctcagatgagactttggactgtggacttttgagttaatgctgaaatgagttaagactttgggagactgttggggaggcatgattggttttgaaacataaggacatgagatttgggaggagccagggtggaatgatatggtttggctgtgtccccacccaaatcttgagttcccacatgttgtgggagggactcagtgggaggaaattgaatcatgggagcaggtctttcctgtgctgttctcatgatagtgaataagcctcatgaaatccgatgattttaaagatgggagtttccctgcacaagctctctctcattacctgctgccatccatgtaagacatgacttgctcctccttgacttctgccatgattatgaggcttccttagccacatggtactgtaagtccattaaacctctttttcttcgcagtctcgggtatgtctttatcagtagcgtgaaaatgaactaatacaattcctgattggaaaactacacaggaaactttcgggatgatggaaatattttatattttgatccaggccctggtctcatgggtttatgtgtacatatatgcatacatatatgtaaagtataagtatacttatatacaccgaagtatataaatatgcattgtagacttgtgcatctcactgggcgtaaagtatgccttaataaagaactgtgaaaaatagcttcaatacaaaaaattatgctaaataatgaaatgaaaccaaatttaatattttcaacaatttggagacctaaaccaatacttgtgaatagacaactctctcccagatggcctaagctgagcaatttccataagtcaaacttatcaagctattgcttgagtttctggggttcagatcacacacaaaaaaagcccaaatcaaaactctgtttgaccctacataataactcacaaatccacttggattctggccagtatgccattctatttcagctgcagtgtcacaccttgcattgtagacatcatatcacctgatatttttgtatcatttgtaaataatttagcagcaacactgactaaaatttactataccacccaaaatacaaaacacaagagaatgacaagttaaaattattttattttaaaaaatagtctatatgcaaatagtcccaagtgtttaactgcatgatccttgtgggtctacacccctgattttaaatcctatgcttgctgtattctttcacagtttgccacagagtattttcttaatgcacaacagtaaaacaaattcaccaatgaaaatttattcttggctgggtgcagtggctcacacctgtaatcccagcactttgggaggccaaggcaggtggattacttgaggtcaggagtttgagaccagcctggtcaacatggtgaaaccccgtctctactgaaaaaacaaaaattagctgggtgtggtggtgggtgcctgtaataccagctactcaggaggctgaggcaggagaatcgcttgaaccccagaggcagaggttgcagtgagccaagattgcaccactgtgctccagcctgggtgacaagagtgaaactccatctcaaaaagaaaaaagaaaagaaaaaaggatttattctcaccaaaataagaacacaaggcaagtgataaatgtcacattaaattgtattaatattgcctaatttgtaatccacaacttcacaatataaaaaatatggattatttttaccaattccctctttttctactatgaatactttctatactcacatagaatagttcagtgaaatatacttggtacacctcagtgaaatactggctgattgattgacacaggtggttaatacaagaggcccttaagatgaagatgacattgatattatacaaacacgcagaatcacaaaatactctcagcctgtttgccaggaggcaaataggacacacaagtgggaagtttggtgtttctggaccacacagtctctgccacggcaaagaagatcagccagcctcctcaactcagtacaattcagacatggtcatgaggtaggggctatagtgagaaatgtgttagaacccacacctatatatgcacatatgcaacacaagctatgtgtttaagattccagaaactgtgtaagaaacaagatgttggaatgttgattggatttacatgttgatgaaatttcagtcaactaagcctagtatcatgcaagattactgtgaaaagtttaattgtaccaactgctcttgtttggaacaaagaactgtcagctctctttacattaaccatatttctctcccccattgctactgcaagaaccaaaaagagagtacttaaaactgggttctacctgcaaaatctgcaagtcagtcagtcatggtttacatgcatgtcaatttctacattatattttcctaaggcagacatttgacagatataaatcttgcctcagcaaggcccaaaggaaacatttgtcatacctccaatggtcattcttgattaaagaaatcacagcaaaacaaattggaattgcaaactcagcttatatcttttctctcacataatttctatatcttgaagccaacttctttaaccataaaatgtgcattctccacataggatacaagactatagctgtgaactattttcccaatgagttacatatgatgccttaatcgttaatagtaaatagatgtactatttgtatgaggtgaggtttttttctcatattttagaaagaatcatcattgtcttcttattgtgaattatcaaaggcaaataaaaaacagcctcttcagtacctagcatattttcattagaaacaaattctattgcgatgcaaattctttggacaaaagtgaagcactttgaagattttctaatatttttgtcaaaagaatacacatgtagatgtgtactttgccttttccataaatattcaaaatgtattctgaaattaaaataaaatatttctataaaataaacacattcacttggtgttttttctttcatttgcatttaaagcagtaatcacaatatcacaagattctttgagtaaaaggccttctcttgaaaaggtagataatagaaagaacatccagccccttgcccctagatggagggataaaaacagatagatgacaaacattctataaattaactctagccacaaaactactgcaaatcaaaacaaccacaaaacctccacaaaggttatgtgcatgccggagcacatgtgtctgggggtcatgaggcatccacatattacaataaattttccccacaacccttattgtaaggttgaactattagggaaaaatggagcagatgctctctaaataaatatgatgtctttatttaatttcctagatgccatgccctcactaattatttttgttctttatttgaagggaaatagataccttagaagaaaactccttttaaatgttttcataagctcaatcaaactaatcacatgttaaaagccagaaaagaaattaaaggagagcttaagctaatatgatgaattttagagaggcaaccaaggcaatttataccaaaagtcaacaaaatttacacaaactcaattgtgtatttttttagattatgcgcacattactatgaaaatatccaggcaaaatgtatgaactgttaaattgcaattgaatttggcaatctatacaactagttgtcattctaataattcatttaacattattgaaatcagtattttgtcccagcgtgttatcatgatattaactgaatttattcaaaaaggagacattatttttatctcaggctgattgctagcaccctcaacttcaattttgtttgatttactgtgcatattgtattattactaagacagatgctctgagacacataatccttattggtctatatatattggtgagctttctttggtaaaaaaaatctggctgggaaaaatatcttgtttgtggaattaagcaaaacattagcatttcaaatatttttgtcttttaaaacaccttgtgccacaactaactcaatagtgggaaaaagatctttgttcagaactgtatgtgtgtaaaagagagagagaattcaagaaacaggtgttatatatttcagaaactcatacttcgggaaagaatagaaacattatttgaacctttagcccaaagactatccaattgcacttagatgctatttctgttccaggttaatttcttagaaaccattgcaatcttattctagtttcctatttaattttatatatgttatttacttttgaacatgggctaaactcaaaaaattttagtcagtgaaggttacagtttagtcccatattacctacaatcttaccgtaagtatgcccacaaaatgtttgccttacgacagctctatgagtaagactatctttgagcttaaactcaatcgccttgggtgatactcaacaggtgtgtatcttttgttttcctttggcatggcccaattttacacagagattttggtagaatgacttgttcttctcatatctttttagcttcagaatccggataactcaattaaggaaataaaagtgggagaccttcaaaggagaacaagtaatttatgggacctgaatttctgaaataatattaaggcaacattgggcttcatggcaaaacaccagaggttgggaagagttgcagatttactcttttgacattcacatcacctccctccctccattttaatagatgcttttaccaactaatttggtctttctgatgctttgattaggcaagttacagatatattttaatagttgcaaaaatgaatacttcaaagaaagcatagaccaaggaaatatattgttgaaaagtaacccctcagcttagagaagaaaaaatacacaatgttattctactatctataaatgaggtactaactggatgatgtgtgattaccagtgtgattaaatggcaaaaacagacacatggagaagctaagtagtatgctgaggcattgtctttttgccaagttaatacactatgcacactgttttccatacaagattctcaagtagtaactatagtaaagagcgtaactcaaaaaatggagtgcctaggtggagaggcatactggaatgcatgaaggtgtttcattatgtatgatgagaacagtctccaccttctgaagagtcttcaaaaaagcaaactggaggaaaagtcacacctttaaggtgcaaatccaacaaagatgtcttaagattctgaggaagaatttgctccttgccagtcagttatttccagactgcagcatgtagatgataagatcaagatatgatcgaagagacttttacttgtgcaagaaggtagtaaccatgctactatttttaatccttaagatttaaaacatgcatttaattcttttaaagatgtacttaatgtatattctgatagcattccaaggcatttccattgaaaagtacatgctataaattcagtagtcttaacatacataatacaatatattatgttgttcgcacgaatgttcattgtagcacttttcacaatagcaaaaacatggaatcaacctaaatgtccatcagtgacagattggataaagaaaatgtggtacatatataccatggaatattatgcagtcgtaaaaaagaacaagattatgtccttttcagggacttggatggagctggaggccattatcctccgcaaactaacagaggaacagaaaacaaaataccacatgttctcacttataagtgagagctaaatgatgagaactcatggacacaaagagaacagacactggggcctgcttgaaggcagagggtgggaggagggaaaggagcagaaaaaaataactattgggtactaggcttagtacctgagtgatgaaataatcagtacaaaaaaaaccctgacaccagtttacctatataacaaatctgcacatgtacccccaaacctaaattaaaaggtaaaataatcatgttttttcaatttaataaaaagaccccccaaaaaatattgcccttcagttaacaaataaagtgtgatgcgaggcaagacatattagtttactgctaattcatagatgaagtctgatgatttactttctgcatctgaatctaacaattcttattgggagaaaaaaatgtgtacatatggttctttggtatgtttgttgagtattatttttgttgattatgtatcagccaacatattgtgaaaactgtcatgctttttaattatgtgtttttataattaaggtgaattattagaaaagcccaatgattaaaactctaattatgtaactgttattttcacaggaagcttattgagactcacctgagaactattccaagtcatgcattttctaatctgcccaatatttccagaatgtaagtttttttaatataaagaaaagtttgcatttgtgatatgttattctctaaacgtgttctatcaagaaaaatacttggtattatacttgcataaatcaatggcagttatattgtcaatgtatatgacaattttatgtacatgatttttatttcattttgctatatctctactccctaattcctacatgattttttaaaacctaaatcaaatttaaattcatttgattttgagcagttcataattctcgatgtattttaatatatcttgggatatggcaaaaccttagctgtaaatctctcctataaacatcccgtagtttataaagtaaacatatatacagatagacaaacatccatctgtcctagtcaccaagtcttgaatcacctttcactactaatacaaatatttacattttgttataaacgtagccagtggtttcagatctctcacgttaaaagagaattaaaaataattctaaaccttaaaaattgaattgctatccacttacagtaaggagaaaagggattttccatattgggttgacaaagagtgaatgaaatgaagcaggtctttatttcatttaattgattttgacaggcaatccagatagttcaggcatgcgaaataatataaccagaagcaacctgtacagtttttggccaaatgtactcactccgtggccattttgttagtgtttctgtcatttcagtagttctcaaccacagacgactctacccctagaagcatttagcatttttggttgctaaatgcccactagagagggggctgctactggcacctagtgggtaaaagtgaaggttgctgccgaacattctacagttcataggacagtccccacaacagaattatctagtccaaaatgtcagcagtgctgaggctgacagaccatcctactgaacatctctgcagttttttatgttgctaacaagtccttcctctttcaaattcttgcctctttgttttccttgatattgctctctcattcctcttcttgtctcacctggctactcttccttagtctccttttctgacttcctattttatttttgccagctacttaattaccagctctttctttgtatattttgttctaattcctctataccccactctccttgagtaaacactcccattccttgggctgcactatttcctaatacagctaatttccaaatattaccacttggatgtcccacaggctcttcaaaaccagcatatccaaaataaacacatcatcttcctcccaagctgttccttctcttttaacagcaccactgtagcatcctataagctaaaaaccttgaattctcctttagctcttccttttccctcatctaccttatacaactgcctatttggtgtctctgtttgcatgtcccaacagcttggccattacttcattcattcaacagatatttattgagccctactttgtgcctggcactttgctaggtgttccgtacacagcagtagacaaaactcacagcagttcagttttattcctaagagagtgatgagtatcatgatggggtcagttattgggtgatatggaaactcacataagaggtctattacctacacaggagcagggagaggagttggggaagacttcctgaaaaaaaaaatagcacctgacctgtgatctgcattatatagcaaagagcagaagggaaaagcctgggctttctgaagaattgaaatataataagtttcttgggggtagagcttaggcagggaggtgggcagtagaaaaaaataaaacttaggtctaagttagtacagggtcttgtaaatcatgtgaaggagtttaaaatcttccctaagggctgagccattcaatggttttaagcaggcaagagaaatggtcagattttcatttgagaaacattcccttggctatgtagtggagtgaggggtggaagtggagcaaggctgtaggcaggaagctagtgaagaggctgatgcagtgcccaaagtacaggggatggcaaattgaaggatgatcattgagtgggaataatgaaaaaggatagagatttgagacataaataagggagggctgatcaagtttctgattaggacatctgtgtggttgatcggcacattcatttaggcagagaagtgttttgtatatttgctgtggagggtcagggggtatgttaggaattcaatttggggcatatggcatttgaggtgcagttatattgagtacacatcaggacacagacagaattttttcattcatttgataaatatttgttcagcccctactatgtgccaatcactgctctgagagctggggatacatcagggaacaaacagacaaagatccatgtccccatggagtttccatttgaatgggaggaaatagacaatgaaccaaaaacacaataaataagtaaattagatactaatttagaaggaaataagtacatgggaaaaaaagtaaattagagtaaagaggattgggagttctgggtatatgggggcactcaggggagagattcaggtagagattgagagtcacaaacaactgggtgtaactgggaccaggaggaggcatccgcagagagggagaagctaaagagagtgaagaaagaacaattttaagagcatgtggtccctgaagaggcaggaggggatgagatccaaatagagggattggccttctagaggaagatggtcactttttacatcataacgaggaagtcatgttgtaggactttctccttagttcagctaaaagccaggttcttgtcacatggccataaaagattaggctcacagacactttgaagggtgacaaaaatagaatttattgggtgaaagaggaaaagagggaaacagggactctcagcaaagcgagagtcctcctagtccacttcccgcctcacagattgaatcccaggtaccaccccacaacaggagaggccaggctcctccccactataaatgaacttcccgaagctccaccccagtacacacttctcccagggcacaggcagttgaaggttctgctagggagcccttttttacttagctgtctcagttgtaggaaaagatgggacagatgcaggtaaactaataggcttattggtggggaattcaaggcattctcgtgttaaagtttcaaacatttctatgacttatcaaattattaaaggatatctaagaagatggaagatggaggtggcagagttagaaatttgatgagaagatttgaaataaaagtggtgagcaataagaagagggttggttgactgagatataggagacacccaggcagatctgaaggctccactgaggcttcccccagggagactgctggattctccagtctgggttaagtgataggggtccctgaaccctatcaagcatttaacaccttgtgttaatcccatttaccttgtacattaatctgtatctgtgagtactgtgagttccttgaaggtagggaacaggcctgttttgtcattgtccagaaggatgtctgtcatacaatgaatgttcaatacatatttgtggaataaaagcacatacacatacctgaataatgattaaagatttgatatatcttggggagaagaaagagatcagtaggatgatgctaggtttgtctgagatggttcaaattcccacttgggattctggcataattgttaatggcaccttgctttaactcacaaaactatcccagtttgaatgataagtcatatggtgactgtaatgattatatgatgtttaaatgcgaagaagaagtaggatctgatttttcctagttgtaaaaatggggtaagtaagcagggaatcacaatttttatccccctgaataaacgattcctgccagttgtcttcacaaccaagcaatcacagccatacaaaaagatgtcattaggttggagaaactggaacttccatttgataatatgggccgagtgactatccttctggaaccttgagaaagactcatacttcttaactgagaaattcagtagaagatttggagcaatggaaaagatgcttagggaaacaagttggcagccttgaaaaatgaatcttgctctgctagcttgctcagcttcatccatggtaaatccccacagtctctacacggtaaattaattcctttcaatctgttccattgtttcctttatgttagaaatatatttgtatcaaaacaatttatataacgttattatctgcaagaggcaaagggttaagagactgggtaaatcaaaggataattatttagagaacaggtaattcaaaatagaaagcacagagccattataatactcataataaccaagataaaaacttagaatggaacaatcagcactcctcttgtaaacattgcatcgatgaggatactttactggcagattcaattcaaactataggtcagtggttctcaacattgcctacacattagaattggctaagaagcttttgaaaaataaaagtacttgactcatccctcataaactctgatttaattatcctagaccgggtcttggacatctgtgtactttaaagcccttcaggtagtttaattgcatgtccagggttgagaatctctgctatggctatggctggaaaccatctgtcaattgttcattttcccaaatgtcatagaaatacctcacaatagaaagtggtcattgaatttggctgcattagtcattctcattacaagatggaatttgaggaaactatttgaaatattccttatatgttcttgacaagttgtatttaggaatttctctgttttcctttttcagtacttgaagcttttatttgaattactttttgcttacaaagtttaagacggagcttgaattttcagcttcatttaaaatcatgaagagaagtcttaagggagtatgtcgtcaacctgtggaatgttccactagagaattgcgattttctcttcatctttgaaactacatgtctaattccatgttattagacattccattaaaaatgcttcttattgactctagtgttcttttctgatgctcatgtttttttgctattttgaggaactcttctattcattcagttgtttaataagagtcgacaacatgccaagcactctgaaaggcactcaagattcagtggccaaaaacaggcacagttctgcatttcagagaacttacagtctagtgagacaacagaaatatcacccaaagaactggaaatttgcactctgataattagtgaaaggagtttatagttttatatatatatatatatatatagtgatatatcactatatataatccctatatatacaccatatatacatatgtatggcaggttcaattcaaactataggtcagtggttctcaacattgcctacacattagaatcagctaagaagcttttgaaaaataaaagtatttgactcatccttcataaactctgatttaattatcctagaccaggtcttggacatctgtgtattttaaaggaaatagaagagttcctttaaaatggaagagttcctcaaaatagcaaaaataaaataaaataaaataaaagcaagcatcagaaaagaacactagagtgaataagaagcatttttaatggaatgtctagtaacacggaattagacacgtagtttcaaagaagatgaagagaaaacctcaattctgtagtggaacattccacagggtgacactatatatatatatatatatatatatatcgctaaatatgcatatgggaaattttaatcagggagtttggggaaagtttctgaaggaagtgacagttaaatgataatttcagataaataggagttaatatacaggaggaattcaggtatcacaagatctgaaaaaaaaagtagtaagtaattttaacataatttggcagaatccatgagggttgtacatgttgcatgatctgggaagcgcataacaaaaagttatgtcaaaaatagtatgtttgaagtttacaaccttactaactttctactttgtcttatatttttctgacattcagctacgtatctatagatgtgactctgcagcagctggaatcacactccttctacaatttgagtaaagtgactcacatgtaagtacaaggaaaagtgcagcatagacctaagccacaaccactcttgactgataatcttggggctccagatggcaatgggagctggtttcttgattgtgagtcaaaacttctgtttatgattaaattattaacctgttctcattctcagttcatgttaattcatcttcattacacctcaattccatggttggaagttaaagacaacattaaaagttctgttcttgaaccactatctgttctattactactgtgtcagcatattttattgatgtgaatgtcagtgagacaataggtatttactgagtaactacttgattctatggtctgtgcaagattctacaaagctggcatattttccttaattcggaaagagaagagttgcttggtgagattagaatagtagggaatttaataaccctagttctggagttggtcagagttggatttgaacaccggcatctctgcctactcattatctacccttggacaagtcacataatctttcctagtctcatttgcaaaataagtgtaataagagctgcaacttcatgtttatcataaatatggaattatataatatctagcacctgaaaaccagtcaatataccattcaaaaatagaataatttttctatttcgctagtagattacaatctataaaaagtgttacataaataatcacattgcattattttaagtagctatgtattactaatcatgaactctattttcttgatgaagaaacaaaaatacttatctacaaatacttagtatatcctaacattacattaaacattgtatgaacattatttgtttggttattatttacctcttaaaacaaccctgtgaagtaaatacaattatttccattatttatataagaaaaacataaatgcagagagactaaatatgttttccttggtcgcacagttaccaagggacagggccacaatctttataccataaatgtatgacttaaaaattcttccctatccactacattaagatgctttcaagaatactgaggtccaagatattgcttacaagtatggtaggctaccttacatcagatcaactattggtctgagaataacttaaggagctgaatttttaaaaaaatgtttgaaagtattagagtgttatgaagacagtaagaactcaatgggcaataagcaaatcccaaaaacatcatttggttattttcccttgaggtatttcctgaattgtaagcaaaagcttaagggctaagaaactgaccagaggtttaggcatctattagggctaggaaaataaaactctgagttccgggcttgctaagaaggattgttcctagtaaacaatccaggattttggttgagatcactaaagagcttcatcctagaagtatgggaaaactgtgactagatcagcccttgcaaagactaaagcctagctttgaatcaataaaaaataactcgagtttgtggggcaaaaaaatcaagagaagaaaatagacaatagaaaatgatccataggaagttcaaatattggttatcagacacagactttaaaataactaacatgttcaaaaatttaaatggcaagagaaaatttcagaataaaactgaaaatgataagaaggatcagttgtaaactctagaatctaaaaagtcaataaaacatctaaatacatgagtttcacaagagattaggcatagctcaaaggagaattagtaatctggaagataggtcagaagactataatcagtctgaagcatggagagaaagagaaaataagaaatatatagcacaataaaaaatctagcatacctatgactagatcccaagaaaagagagaaagaatgagaaaagcaatatttgaaagcaactttccaaaactcttaagagacatcaagtcacgtatgttagaagtactgcaaaccccgaaaggataaatacgaagaaagctacatcgaggcacatcatagtaaaattgctaaaaaccaaagacgaaaagaaaattataaaagccagcaaggctgggcgcgctggctcatgcctgtaatcccagcattttagggggccaaggcaggcggatcacgaggttaggagattgagaccatccaggccaacatggtgaaaccttgtctctactaaaaacacaaaaatttgccgggcatggtggtgtgtccctgtaatcccagctactcgggaggctgaggcagggaatcacttgaacctgggcgggagaggttgcagtgagctgagattgtgccactacactccagcctgggcaacagagtaagattccatctcaaaaaaaaaaaaaaaaaaaaaaaaaagcagcaaggaaataataaataatactttcaaggatgtaacaagactgacagctgacttttcaacagaaatcatggaacttataaaacaacagaaagatatttgtgaacagcaaaacagcaaatatctgccaacccaaccaaaagattatttaaaattagaaaaagatagatacttcaagcaaacaaaaattgagagaatttattaccattaggctcatattaaaggaactactaatgggaattactaagacaaaaggaaagccatcccacatgctaagacatttctgtgcaggaagaaatgaaaagcaacagaaaaggtcaatatatgggtaaatataaatgaaccttgactgcacaaaatgaaataatgtcttaggggatttaaaatactgttctttgctctgcatgatagtgtgggatcataaaattgtgcagactgaaactgtattaagcagtcttaataatcaataagaaaaattgtgttgtgatttctaaaagcttttatgaaaacattaaaatttctcagtcagttataaatggaaagaaaaaataataaaactaatatttcacatactgtaattgtcaacattagaaatacttagaagtaaaatgctttattgctttgtaaaagcttagcaagagtagcttagacagtgcttgaccttttatctttattatataagttacaatagaatatcttttcaataccctggcaaattgtcatacttctttctaagtctagattagcttccatcattttatcctttgctttttaaatattataaaatattttcaagtgtttctttaatgtaaaatttttttaccgtcattgtttcttttgggacatcttcatcctttgcatccatttttctcccatcactaagttcctctgattaatatctagagtttctcagccagcctggacaacatagtgagatcttgtctctaccaaaaaaaaaattagctgagcatggtagtgcaaaccagtggtcccagctacatgggaggctgaggtgagaggattaattaagcccaggcattccaggctgcagtgagctatgatcacaccactgcattccagcttggatgacagagaaagagctggtctctaaaataaataaataaataaataaatagtctcagatggtggtggtatcaacattttcatgccagtgatttattctataactccatttacattttgtttgaatttccctttcagtaatattacatttcatttcttggcttcattttcatctttattggtaaattcactctttcaattagccatttttaggaaatgtcatatgaggtgattactgggaaacacataggaaacacaatgacatgctttattgtttgtgaatgaactgagcaagagatgcccagtgagcaaccatcaatgactttgaagagtgatgtagttggtcacctattataatgtgcatctgttatttacatagtgatttgtggactgaagagctagcaacaaagtttgtactttattcaatgattaatagttaatatactatggtaactgaaacttgagggatgtgttgaggacagttattatttacatttgattaaatcatggtaactgaacttcatgtgtattggagccattcaaagtagaactgcttgtatgcatagaattaaaatatgcagtagctttttaaaaaaagtataggacattataaataatgtgaaagtgttctaaaggtctttgaattatctgagaagtggtaaaagtactaactgaaattaaactttaataaatcataaataaatgttttaactcacagggcagctactaaaatgcttgtagaagactggataactaacaggctaatagtagtggggaatggaatgaaattaattaattaatacaaaaaagcgagaaattggaagaaatagagagtttctggaataaatagtagatttaactccaaataatcagcatttacattaactgcattaaatgtaaaaggactaaatactctaagtaaaatacaaagattgattgctgaatttttaatactcgctgtatgctgcttacaagagacattttaaacattatacagaaaggttgaaagtgaaaagctttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaataaaaaataaatatatatatatatatatatatatatataaaatgcacacagtaactaaaagaaaactgatgtaaatatgcatacatataaagcataaagtcttactctaagggacacttcataaagattaaaggaattactatataagatatagtgattctaaatttaatgtctataagagcatagcttcaaaccatataaagcagaaattggtagaactaaaaagataaacaataattggcaatcatactgagagcttattttaatatagttttatcaataattgatagaacaagcataccaaaatagtaaatatactgataaaaagttaataaaaagatttgaacataatttacaaacttgatcatattggcttataaaaaatattgtatccaacaactgcagagtatatattcttttcaaagacacatggaacatttactaaaattgaccacatgtggggccataaaagcaagtctcaatagattaccaaaaaaattaaaatcaccatgttctctaactagtaaataacctaacttctaaataactctgatttctaattaaccataggattaaggaagaaatcataataaacattagaaaataattttaactaaatgataataaaaatatgacatatcaaaacctgtgggatgtagtcaaagtcatacttagaagaaaacatatagccttaagacaacatatattagaaaagaaggttaaaaataaatcatttatgtatccttcataagaagtttatataatagagcagtacattaaaaccaaagaaagtaaaataacactgaggcccaggaaggctgaggatccagtacagtaaagacaacaacagtcttcaaaattgaaaaccaaatcttctgactccaaatctcatatccatttatcaaaccattttgcttctttgccccttcaccaaaaataaaagcaattaatttgtagtgaagtcctatataaaccccattgatcttaaaagcagtcattttgtttgtattatgatctttttcctcacaaagattccagttgttatttataagtttttttaagtaaacattcaattctctactctgagcaaaagtgttaacttcctaaaccgaaggaaactattaaatacagtaattaaaaagagaatgagtttaaaaataaattattaaaagataatttgcttatatacttgagatattgagagtctaatatcttaaagatttaaaggataatgcaccttgtattcttcaaatgtttctaatatgtatctgacattattgtctgcaaatggttttggtcagcagaaaagattagtgaagatttttgcatgcatgccacccaaatgtttaatacatttgttttataatcatttattaagcagcgactataatcaaagcattataacttgcatgagaaatatagagctgaaagatcactcatctttgctcaaggaattgagaatggttttgtgggtataaggcatgaaactgagtatcgatatagaatgatttgtttaatttatataccatataagtaccatcaaccaaacgttcctgggattcctcagtatagaattaaagccctctgatttgtttaggaaagagagctctttattgtgttggatttgctgcaaggatagatatgtagatactaaacttatgaatacacatttcaaatgccaatgcatattgccagcatttattgaaaagctccaatgaggactacagcagtaaaataacataatgttattccatttcataagtgtgttttctttctaagctgcccttcaaaactgactttttttggtcctgtgatttggtaaatagaaagatgagcagttagtttaccattgccacttctaattatccctgccagtacctgtccagtcttacagagctctatatacattctctgagatggcttcccaattcatgtttagattttgttctgtgatatgaattagagtattagaacataagcactctttagcctaaagctgcctccttgtaaatttggcctaaaggcctctctgtatgcagtgaactataacctaactggatatgtgaacagaccacagaccataatttacttttttaccaatcaccgagtttcagccagtcacaggcgaccaattgttcaaacagtgttcaaataaggcaaaagctaagctataaccaatctagctgcttctatacctcacttctgttttctgtatatcaccttgtttgcatccctcccagctccagaaattctctatcacacagcagcaccaaagtctctctgaacctattctggttagggggctgcccaattaatgaattattctttgctcaattaaactgttaaatttatgtaacattttcatcttaacagtactgacattgggtctgtgacctagaattgtcattcccaaaacaaaaagctattcattcaataaatacagtatgtttaacacagttaaacctgtgaccatggcatctttttttttcttttattattatactttaagttttagggtacatgtgcacattgtgcaggttagttacatatgtatacatgtgccatgctggtgtgctgcacccactaactcgtcatctagcattaggtatatctcccaatgctatccctcccccctccccccaccccacaatgtggagaaataggaacacttttacactgttggtgggactgtaaactagttcaaccattgtggaagtcagtgtggcgattcctcagggatctagaactagaaataccatttgacccagccatcccattactgagtatatacccaaaggactataaatcatgctgctataaagacacatgcacacgtatgtttattgtgacattattcacaatagcaaagacttggaaccaacccaaatgtccaacaatgatagactggattaagaaaatgtggcacatatacaccatgggatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaaggagatcacatggacacaggaaggggaacatcacactctgaagaccattgcatcttaaaaggctatatgcaagattcaaaatagtagatcattctgttcttattcatacctcttcccttggcctctgtgatatcacaatcctggttggactcctatcatgctggtcagtctttcctatcatcttttgctggctgcttccccttccccagctataattattgggctttcatatggcccaatcctgtgtagtcttctcttttcactctaacttctcctgctatgtgatcttatctaacaattcccaaatttatatatctagttcaggccctcattcttagtgttggtatatacctattggtctacttgacctctcttcccagacatcttacacatatctcacgttttatatccaaaactgacatcttgattgtcgtcctgaaatctactactcctgtgtatgttgagccaataaatgccaacttccttcatcctgatgcaaatcccaaatacctgagatgtatcactataccttctttcctcatcacccacttctactccttcaccatgtcctgttgattctactaccctaatatacagaaaatgtatcctcttcctctccactgccaccacccttatttaagccaccatcatctcttgtttgaactatgataattttatatcttaactggtattcccaattgatttcctctaattcagtatcttcacagcagccagaatgatttttcttgaataaaatccaagtatcttaacataaacagccaggcccacaagttcagctggttcctgcccacctctgcgttctcatcatgcttcactcctgcacacctgtgttctttggttttttgaacagtccaatatctttctcacctcagggtattcacatgcttttgcctctgcctagacatttatttctctctctctctctctttgcctagttaactctactgattattttttcagcctaattatgacctacacagagacacataccattcagcccacttctgcatctaagttagatccccatttgaatctatccttgaatgctttttggtttagaacttactaaaatttagtatgacaatgcagatgtttgataataataggtctctggaaggcaggatgctttgtgtgccattcacttacaccaagctgtgaggaaatcaaactaaaacaaaaaatgaaacaatgtattctgaacatgcattttaaaaataatggattggaagagtaggctagtctgaattcatgaaaaatctgattgacagaatgtttagtatatgtgtgtacacacacatattcatacatatatgtttagccaaccttaattgagcatttaccatatcccaagcactacactaattgctcaacacatatatactcatttaatcctcacgacaattctctaaagtagttactatcattttacagccaaagcaactgagattcaataactacatctttatatttaaaatgcatttcatgtaaacatcacagaattggatcttgcttttatatccagcctgaaaatctcagccttttagttggagtgtttaatccatgacatttattgtaattattgatatggttggatttcagtctaccattttcctatttgctttgtcttctctgttctttgttcctttatttctccttgtcttcttttggattaatctagttgtttttgcttttgtttattagtgttctattccattggctttttagtcctttgcaaattttttgtgattactcaagaaattatgacatgcatccttaacttatcacagtctacttagaaataatattatgttactccacatatcatgtaagaaccttttgaaattaaaattccatttaccttcttccatctttcatgctattgttgtcatatattttattcctatatatgttataaacctcataatacattattatgttaactttaaagattcaattaacttttacataatttgagtaaagaaaaaaatagtcatttatatacgttcaacatatttaatatttccagtgtccatgcccttctgtaggtccaattatttccctttagcccaaaaaacttttagtatttcactgtggttctactggcagcaaattttctgaggttttatttactgaaaatatattttaccttaatatttgaaaaacacttttgctgagtatagaattgtagcaaagccatttttgtttcagccttttgaaaatatccttcaatgtcttctggccttctttttttctgaggagtagtcgtatccgtgttattattctcctgtaagtaatgtgttttttcccctctggttacttgtaaaactttttctatatctttgcttttcaactgtttaatcataatatgcctaggtgagtttttttatatttaatctgcttaaggtttgccgaacttcgtggatttatgggttgctggttttgttaaatttggacatttttgtctactatttcaatagagtatgttagaagtgatacaatgccagttctagtcccagtctttaaaagaactggcagcttttactttatatccttggaaccctgaacaaccatgtaagacgtccaactgcactgatggagagaccgtgtgggaagatcctgagatcctgggatggagaaaagcctagctgagcctaaccttctagcaattcccatcaaaaagccaggcatgtaagcacacccttttggaccctccaaattgttccagacaccagctgaataacacccagtgatcctggtggaggctacagagagcagaaaatcacccagctcagcactgtctggcatcctgatccacaaaattgtgagctataataaaatgttattttaaccacttaatctggggtaatttgttatgcaacaataggtagccagaggaagtagcaattatatgtcagttaacaatgggtaaaggcattgaggatttgtaagaaaaaaatacaagaatggtaggttctctgtgagttattcaggatcctaagtggatacaaatcatttcccctgggtagtaacttcagcgaggatactgtttggaccgaaaagtatgcatgtaataaagatttatatctgcaaaatgatgaaacactggacacttccattttctattgtactttctctataagaaagtcaataacatacagattgctgctgttgttactcctaataataatagtgaccaagttctgaatgccttttgtgggccagcactccactaaaagtacttcacatacactatctcactagtttttaccaagcgttagtttctgctatgtcaaatgaagatggtaatacataccttgcagagctcttgccaaagttttcttagctaagacatttcaaagtgagaatttgaacccaaaagtgtctgcctccaaaaccactgcaatgccataaaatctctttaattaaaatatctgcaataattaaagaaaatgctggccaggcgtggtggcccacacctataatcccagcattttgggagactgaggcagaaggatggcttgagcccaggagtttgagaccagcctgggcggcagagtgagacatcatctctatgaaaaatattttttaaaattagctgggcacaatggcacttgcctatagtcccagcttctcaggaagttgaggcgggaggatcacttgagcctacaaggttgaggctgtagtgagtcatgatcgtgctacacactccagcctgggcaacagaatgagacccctagctcaaaagaaaaaaaaaaaaaaaagcaaagaaaaagaagtgctgccctcagaagaatgtttttacttttatgtgagtttttgggttttgtttgtttgtttgtttgtttgtttgtttttgagacggagtcttgctctgtcgcccaggctggagtgcagtggtgcaatctcagctcactgcaacctccgcctcctgggttcaagggattctcctgcctcagactcccaagtagctaggactacaggcgtgtgccaccatgcccagctaattttttgtatttttagtagagaaggggtttcaccatgttagccaggatggtctcaatctcttgacctcgtgatcctcctgcctcagcctcccaaagtcctgggattacaggtgtgagccaccgcacctggcctatgtgagttttttaaatcaaaaataagtgaaaaattttacaactgggataggtgaaatgtgtgacttatgccttatagtacaataagactatattttgctgatccactaagttgaatcaagtggatgcatcagaggtttcaaaatcaccagctttagcaccaatccttaaataatcatgaaagtagctgtatgcacctgccaggcaatttagagaatcacttctataatgttctatttttagtggaaaatctgctgataaatttaaattttcttcaatgtgctttaaaaatctgaatacttataaactctcctcaatatctcttatttttaatttctcaatacattaaaagatacatcaaatcatgaatattgccttttggttatagattatttctttcctccagttacatatggaatgttaataataattcattaataattatcaaagaattaagacttctctcattgaaaatcctcgataatgtaggaaataatttattctgtgaactttcatattatagattaatatgaaaagtaagtgctagtctaacagtcaaggctttagaaactaaggtctaatctataccaagagctttgacagacttttaacttttgacccagtaattccacttctataaattttccctaagaaaatagagtagtgaaaaaaagttaatgtaaaaagccatttgtttcggagttaattatttatattagagagaatttggaaaggacttaaatgcttagctaagagaatggtcaaatatgaaatactaagccaggcgcagaggcacgaacctttagtcacagctacttggagactgaggtgggaggattggttgaggtcagggatttgaggctgtagtgcactatgaccctgcctgtgaatagccactgcactccagcctgggcagcatagcatgaccctgacttataaagagaaaatctgttgctatagacaatttaatcacataagaaaagcttttgtcattatgttatttaaaatatatatgtatgtatgtatgtatatatatatacttaacagaacaaaatagtttttctctgtattatcaaatgatgagagtttttttttacatttaccagcttattataaaggatattacaaaagatagagatgaagattgcatagagtgaagtatgggggaggggcgcagagcttccgccccctcccttggcacaccaccctccaggaggatggtcagctgtcagaaagttcatttcctttttgtatgaatgtgtttcaaagttttttacaataaatatgtattacctctatagtcagatgaaattaactttttaaagatcactgtgcattaaacttgaaattaatacttgatgtcaagatacatcagtaatgtattatgtgatagaaccctgtcctaaaatgttaccttaaaattaatttacctatttattagtctcaggtttcacctagggattgtatagcacttaaaaaatttatagtaacaaaatgatggcttgggcaatatatacacatcttatttttaaaataaatagtaactatttccttataccacccagagtatgcagcaaagtgcacctaatagatgtccagtaattattcacttatattctaattaatctcttcccactctaaccacttgagtgagcaaacctagtcaaaatcaaggtgactgccttccatttttttgaactataggtgaggtgggaaattaaagaaaaataaaattaaaaagaaagagaaataagctttcctatattaagctgacttgtcccagaggcagcaacaggcacagcccagacccaggaaaagtcttgataatactatttaatgtgctctggagactctcccagcactccctcaacatagggagaagaaaaacaaattttcctttgttttatggaataagtttatagatacttgttctctgtcactagtgacttcaagtattctgttttatctaagaagtacaaagaaagtcataagaagcctgagtaggcctgaactacagctgcctgggcaccatagtgaaggttatgagataaaccagtgcaaggctctttagagcaaaacctagataatgaacatctaggttgcttggcaacggtcatgtgcaatcctgagtttgtcctgcctctgtatccctgctttcacaccactgtaaacttgcttcaagctagcccacccccttttgtgaaatgtgtataaaagtcaagtgctgtctttgttctaggcccagtctttggacattgagtctgctaagtccgagtgcactcaataataaagatatcgtcctgtatacaccccaaggtctctctctggtcctcctgatcccacaacacgggcatttaaaagtaaacgggaaaaaaattgaaaatcaaattgaaacaagagttaaaaagaagctggggactggtggagagctaggcttttggctaatattcttgttcaatttattgttttgggtaacaataaattggctgtggcagcttctcttctgacatcatctaactgagtcttcttggtttatgctggtctgaagtgttctcatccccatctaattttgcagatgaaatgcaaagtcggctttttgattgccctcaaattgtttcctggcttggcatgcttctcactcattaactggggcagtttagggtgtggggaaatatctccaagggtgagaagcacagtcaaatgccacgatccaatgcccgttgaataattgaggtaggaagggggacactaggaaaatggaaggaaattagtggttggaaaaaaaaaaagtcttccttaacagaagattttaagtgttttccccttcttctgttcctcattccctcgcctgagaactcccttctctcatcctgctgatttcccatatactctttgaggtgtggactcagggactgagtgcctgctgcaatgctagtcgtaacgggaaagccagatgtcctgtgctacgcttttattgagaattaatcaatgtttcttaggggaagaaaaaaaacccagaatgtagacatgtgattaagtgaacctaactgcatgctgaattattgatctgttgatttgtgaaaactgccattggacagcaatgttacacttttcatctaaatgtttatttcatttgaaatctaatgaaggagaattagacaatgaatatttacatatatttttagttctgctggatgatttccttgaaacctcatttaaaaaaaaaaaaaaggctgtatttgaagtcataagtcctagataaaggcccagtgttgctgctaagtgtataacaggagattattcacttgccctttcaaaacatgtctccatagttttgtctgcaaaatcaggatgatccttacctgcatcacacgagtcagttatgttgctccctcactaggaggaaattcacaccctccctcaggtgaaaaaaaagtacactgtttctttttaccctttaatcttctgtattaatttgtattcatgcttctgtgaagaaatacctgagactgggtaatttataaaggaaagaggtttcattgactcacggttctgcatggctggggaggcctcaggaaacttacaataatgacagaaggggaagcaaacaggttctttctcacatggcagcaggaaagagacatgcagagcaaagtggggtagatccccttataaaaccagcagatctcatgagaactcactcactatcacgagaacagcatgggggaagcaccctgtgatctaatcacctcccgcgaggtccctcccccaacacgtggggattacaatttggattacaattcaagatgagatttaggtccctctcccaacacatggagattacaactggggttacaattcaagatgagatttgggtggggacacagagccagaccatatcatcttccaaagctgaatttttctaatcaatacgctttaagagccttgcatatttccccaacaaagaaaaagagcctcgctccataaaacagcatacttaagcagcatatctggcacatattttaatgttattttttatagagaatatataaagctttacttttttgtttttaaagtttgagattttttgcatcctctttattacttttttttatttagataaaataaaaagtgaaaattccacattccttctttttaaacctatctgctagatgtgaccactatgaacagagtactctatatttttggaattttatttatgcttattagtttgggtaggtgaattactataagaaatagacaaaaatacagacatgtaacagcccttagtgagtgaggtttactgcttgctcatgggagagtactggatggatgagtgggagcacagagcagccaccttcaggcagtcactcagggcctcaggttgctggaggcacagccatcttcagctctggagggcatctccattcctagtgtgctgtattacaaacagcttttctttcttccaatgtctccagctttctggcagcatagctagcctcctgcacactcaggccataattgcttaactcaaaatggtgtgattcaaattcaccctcagaggcatgcttgaaggcattcaaatttgaacgcctctttcacccttctctgattagatgttcttttgtactcacttctgcccttcctttcttcctatctttgaataggttttactagttgcatttgcttcttatgttacctctctatttaatgattgattgattgattgagacagagtcttgctttttcgcccaggatggagtgcagtggcacaatctcagctcactgcaacctctgcctcctgcgttcaagcgattctcatgtcttggcctcccaaatagctggaattacagacataagccaccacacccggctaatttttgcatttttagtaaaaacagggtttcaccacgttgcccaggctggtcttgaactcctgacctcaactgatccacctgcctcggcctcccacctgtctcggcctcccaaagtgcttacaggcatgcgccaccacacccagctgttatctctcaccatttagctaaactactggcagtctacgaccactccaccccttctctgcttcaggagatacttttcaaaagtcacttgtgagcaagtggtaagctgttgccttacctcagaaagcagcttcttttccctgctgttttcttgtggggtctctcattcatctttctcctttgtagctcttacatttccttctagaaatcttctcctccttcatgtttccttctctctccttgctgcctctcccacatttctcctcttccagcctccatgtaagttgccagcctcatttaatcaactgttactagcagctgcatttcatttcccttttattctctaccttttcagctgacccaggtgggctgcattttctttcactctgacgttctcttagaccactcactcaggactactcgttcaacgacagtctcttgtggagcaattttccagactgcaaaccctgctcaatttccaaactcctgcatctagtttacatctgtttgtctctggcagtagttcaaaccctcctcccccaatggaaagctctggcaaggagtttattgctcaccctggaaagagagaaccacctcaacagagattgatagtctctagaggggcaaggtgggaaaattatgagattttggagtagggtggccaactgtcacactttgcccaagacagagggaattccaaggatatgggctttgcattttaaagccaggacaaaaaaatgaaagattgtataaagaggatctttccatgcagggtcttgtttaggtaaaaatcatgacataatagtttaggattagcatagtgaggatttggaagtgaggagttctaagatcttggggtataaactgttgatgctttctgttgaagcattgatggttctttgtttcaaaaactctctgtaatgaacaataaagcaatttgcctgggcaagagtctcctggaattgtagttatgttaatgaggacaatggaccagtaagggtatattattatagacagtaagctgtgtgtttagggaggagagaggtaggtgatttctgttctcagagttaactccatcctctcttttccaaggtctgtttcatattcagtgtccttagttgaaatgcctagttgaaaaaaccagagagttttttctaattttgcaagaatgtcacaacatctccagtcccaagtccctgatgtctcttctagctttcattgcacttatgaaaataacaataataaaagcattattttagagccctaactatgtggaggccaaacataaaatccctcatgaatattatttaatcctcacaaaagccccacaaaagaggtgttgttaattgttcctattttacagacaggaaaactatggctcaaagaggccaagaaacttgtccaaggtcatataatcagaagtggcagagccaagactctatttcgagtccatctgggctattcagaaataaaaaggagtgaactactaattcatgttacaacatggatgaacctcacagacattatgctaaatgaaagaaggcagacacaaaagactgcctgttatatgattccatttatatgaaatgtccagataaggcaaatttataaagaaagaaaactgatcagtggtttctaggcataaaggagcaagtggagactaactgcagatgggcctatggttacttttgtcattgacagaaatgttctaacctgtgatgatggtttcaaaatcatgtaatgttactaaaaatcattgaactgtatgcctacatacaatgtttgaagtttatggaatgtaaattctttttcaataaaactttaaaaattacagaggtcacattctaagctttctgactggtaccaccaatgactagatgctggttcttttaggtgccactcctaaggagaaatgctaaaggtttactgggttcttatatacttttcatgtaagcatagggaatgccttaaactcttttagccaatcaacctatgttgaatatgtttaatttaaccagtgagagttcatttctagcagttacttatttctctaatgctaactgtgcattcttgatcagcatttatataaacctaagtatgtaagttactgacacacgatattgcactatacatgcagaagtgtcttcgattgctgacatgacaaaataaacccaagtgaactgtgaagacttaccacttctgtacatctggtatggcaatgacagagccttactgtccatcttgctgtgctgtcgttcatcataaaattccctcatcctcccactccaacactcattgtcttggccagaatacttataaataataaagatatttgtcttcaactcctcaccaaatcattggagggatttttcttttttctctaaatgtaaaagaaaaaaaattctgatactacaattaagaacaatgtagcccataaattaaagtggacagaaaccaagccaacaatgcaaaagagctgagcagccattgggtccccgtgaggagacaggagtagtttgtcattgatgggacccctggcagctacagcccctggggtaccctgtggcgtaaatgcatatttttctcatgaacgtttgttaaaactgatttatgttgttttgtctttgataagaacagatacggatgcattatagtgactgtgttccttgtaacttatacagagaaattcggaataccaggaacttaacttacatagaccctgatgccctcaaagagctccccctcctaaagttcctgtaagtattaaatcctctcccatcctacttttctggggggagggggtcagatttaatgctgttgtctcccaggaatctccctagatgatgtggtccaggttcattttaatggtgtatagcctgggtcgggggcaaggtatcgggtgaaatgatccacatttttaaaacctattcaaaagtcagcacataatgctggaaccagagacctgctccaagaaacaggagggagaaaatgctatcatgtatatgtggtccttaaatgtagtatttcagaacaaaacaaaacaaaattctgagagccagttggtcaattttgtttgaaaatgggtatcacaacaatattattagagtggctgttacacaggaaaaaaaacccacaaagagtaaaatacacttccatggggagtggagggaaaacagaagggacaacagtttcaacctcccactccagcactcaaatgtccagcactcactgctttgctttgaaaacaccttatgagctaaccataagctccatgaatccagggaccacaacattttttttctctgttgaatctttactgcctagtacagagtaggcgctcagtacaaatgtgttcagtggatgtgtctgtatgacctcaggccccctggataccaggtggaagagtcctttttcctacttgcatgcattataaagattagaaaacaaagagtatgaagaagaaaattgttaaaaaaaacttaatcccaaaccccaaaataagcactattaacatttcagttcatcttcatccagaccttcaaaacaaacttatgttatcatagatattttatgagataagcccttaaggatgaatagagggtatcttgaacaagaatggggagatagaaaagaaatttagctggatggaatagcatgataaagacacaaatgtagggaaccacgcagcttctttggggaactaaaaatagttgcttttttttttttttttttgagatagagtcttgctctgttgccccaggctggagtgcagtggtgtgatcttggctcactgcaaccgccacttcctgcattcaagcgattctcctgcctcagcctcccgagtagctgggattacaggtgtgcaccaccatgcccagctaatttttgtatttttagtagagatggggtttcaccatgttggccaggctggtgtcgaactcctgacctcaggtgatccacccgcctcagcctcccaaagtgctgggactacaggcatgagccactgtgcctggccaatagttgtatattgaagaggtgggtgtgagagatgccaggggaatggaagacactgatgggatatgaagatgaaaggatgtctggaaagccatgaaagcttatgggacaagacaatcactcttcttatggactctgagtttcaaataatacaataaccctttgatgtgatgatcccccactatatgctctgtggggaacatacaggtttctaagacattgtccttgcctgtaatctagttgaggagatgtgtatgaaattgaaaagtgcctctcctacagaagaataatggaaagtgacgaaggagagacatatacagtgtttgggggttcaggtaattagagaagacatcagaaagaagacccacagcatggttttaagggacttgtttgagatttttgaagaatagaaagatcttgatccaagtatatggaccccacttgactcttggacctttttccctcctactgttcttcatgagcacctattgcaattgaactagttcgtttactgtatttcaaatataccttatggaatctcacctctctcctttgttatctggaatgtccctcccatttgctgattttgagacctctggctcctgctgcctcttcaaatcctatgccttcttctctagaaggagtcaagtctgaatttgcctcagaaggagtatcaatggatatagtttttctaccagaagaccttctctagagctttactgagtagtgtctagatctcactctatgctatgccaaattctcaaaaaaaaaaaaattctaattacattcaagtagctgcaacaaatgttaaaacaactaaatctgggaggcatcaggagcctgagaattcttgtattcatggtgttttatgcatgtcttttaatcttaacatttttctgtagatgatataaactacagaaggtaaagactttgtctttgattggtttccttccttttctggacactgtctttttttgagacagagtcgccctctgtcacccaggctggagtgcagtggcatgatctcggctcactgcaacctccacctcccaggttcaagtgattctcatgcctcagcctcccaagtagctgggattacaggcgcatgccaacacatgcagctaatttttgtatttttagtagagacagggtttcgccatgttaggctagtcttgaattcctggactcaagtgatccacctgccttggcctcccaaagtgttaggattataggcgtgagcccctgtgcccggctctctggacatatttttttaaatggtactgttataatggtactctcaggtcactgctgtaggaaagatattcttggcaaaataacagcataatatcatgtagagcttgaaagaggaagctggcttaaagtcatcatatcttcctgtcccatcttcttcttagcccttcactaacaaacacataattttttccaattaaacgagaaaatcacacacacacacacacgaaaactgaatttatatttctagtaaacccacttggttaaaacaatctccagagcattctaagccgagcagatgtattgacaccagtggactggattaaattattatgccttgagggaatatcatctcatccaaccatcagaacttgcccatagttactcagatatttagggaaggtgttgggagtttgactacaggttgtcttcagaacccatgctttcagctattacattattctccttcctatgtgttgatttttttacctaaattctatgcttttttttctctttttttcattaatttagtggcattttcaacactggacttaaaatgttccctgacctgaccaaagtttattccactgatatattctttatactgtaagtatgcacacatgccatgtttgacaatattttgtttgtcactgacaagaactagaatacagtcatgagggtaggttgaagataagtaaagcaattgtttcaaggagtaagcaatgatcaggtgtgactacactggcatgaagtaaggcaaggactgagaaataaccactggctttagcaatgtggtttgttggtgactctgccaagaacagttccagtggagtgctggttggagtgggctcaagagagacttgggtagacagaattagaaagagttaccataattaactcttttgagaggttttactattaaaaggagcagaaaatagctcagtaattgcaagatattgagtcaggagaaaagattttgtttgtgtgtttttgtttttaaatggaagaaattatgcaatgtttctttgccaatgggaatggttgaatagaaggaatatttgatgataactatgataccttatttttcatagagttttaatagttttttaaacactttcccacacatgacatttgctcctctcagccaccttataaggtgtaaaacaaagttactgcttttccatttatgaatgaggaaactgaggaatagaaacctcaagtgattttgtctgagcagtgtctcaaggaacagtcagaagtggtactcaaattactgcctgtgacctttgattggcacccatgtgccctttttcaaagctggtgacatgggtcagttgtcttactaattgtataggaatgaaaggacgtaaggcagagagaattacaagttgagtttgcattaaagagtcagcaaaatgtagaatgataagcttcaaactcttggggttttgctagaaaaaaaaattgatcatacttctttgttgcaaaagagctcagttcaaaatgtaagcaatcttccagaaactagaatggcgtagaaaggttctccaggagcctggcgaagtttggcaagtgaaggacattttagaaatactcattaaatgaaatcctttaatccttttatcctgaccttcttaaaggtccatgcatgtagaaaactctagttgttgtggacaaagtgttgcagattcgggagaagcctctcaaatccatctgcctaccccaagatgaggattaagtcagggacctccacccacacctaaagctctcacttaccccacatttgggctccaggtgcatgtcatctaggacagctctcaccacctcaccagacctctgagccactagcggttaagaagggtcagtgaaacttaaaaagaaataagattaagctatattgtgtcctgttatttaagtgcatatgcgcagcaagacccctgctgcagaaggaaagcattttttcattaagtgtttttgtccctctctcttgcagtgaaattacagacaacccttacatgacgtcaatccctgtgaatgcttttcagggactatgcaatgaaaccttgacactgtgagtattaccagttctactccctccatcaactaaattctattttgagccattttcatatgtttacagaccatccaagagccatactgccttatcatatatactctatagagtacaaagtgttttacacaattaaataatagtattgtcttatgggatggtactctgtagactacaaaacagtttaggtaacaagacaagaggattccattacggcagtggttggtacatttttcacgtgaagaaccagttaggcattacagaccatgcaacctctgtaggaactggtcaactctggcattgtgtggcaaaaaccgcagtactcaatatatacactaatgagcatgtctgtgttccaataaaactttatttatagaaagaggcagtggactagatttggcctgcaggccttatggaataatcatctgtatccaagtgtccccattctacagaagaagaactggggtttaagcaaattgaagtgacttacccaagatcactgagttaaaaaaaagtggtgccactaagaactttataaattctgcactcacacttttactcagtaatcacaaactgttattaagctcctgtaaggggatattacatagaaagcatagtgctgctataggtcagcatttttccagagcctgaatgggggcaaagccctttagatggtcaaaagtagatgcttaattagggatattcacaaaatgttctaaaggagaagatctaatagaggtataaaggataagttaattctccaagctggtagaaagttcctctctcattgtgtaagtcacaaagtagagttggagctacctctgcagggtctcctctctattttcaggaccactgcccaagttcaagcctggtgaagtttttgtctggattgtcaccccagtttcatttctctgctcacactaaagttggggtggaggtctttatcagatacaaacctgatcaaattactcaccagaaaaatggatccaagcttcatacagttcttctaaggggctattttctgagccattcctagtttatcagtttgggcccaatgaagttacctcaacttctgagagcaatggagcatttcagatgatccttctcatcacaacctggtgagcggtcccttgaaaagacaaaggaggctccttctcagtcataatttcttcttaccatgcagaaaaggcccaggctcttagcctgctcagctccaaacttcaaagccatttacttcctcagtaaagctttccattgcgccatatagtgctcatcataaggaaactcctacatgctaaacttctttatagaatattacctctaccccttgacaccatttctctaaaacccccatatctcaagcacccccctcaagtgaaagctcattgtcccacacctagcatagagcccagcatgtgtttctagaaacatctgagtgagggaagcccatatttcctaaaatatagaggagaggatggcatggattattcatgatcttttcagatgattatttctacattttggcaaaagtccttgcttcttcgaagctcaggctcaaaaaactatcaacttgaaaagacacatgttccaacaaccgactttgtacctgtattcctggtaggagaaagtttcagtcaaagtttgtaattcttttgtcttgcttcaccatgttcccttttcaaggccgatttgttcattaagaattctgtttaatatctgaaatgcaattcaaacaagtatttttaatgtccaggactctcaacaaatttaggaaaattaaaatgccatatgcacagttctcacatcttcataaaagagttctagtttagaaaaaatttacttatccacagagttttctcagccattgtgcttatattcctgggatattgcaatcctcacccaggacatgttagtagctggaattaaactcgctatgtaattatttaagatgaaacaaaaacaaacacatcaacaatgacaacaaagccacgagaatcttgctcagtttcccacaactatataggataaatccaagttttagaattctccttttatttatttatttttttaattttttttttttttttttttttttgagacagagtctcactctgtcacccagagctggagtgcaatggtgcgatctcggcttactgcaacctccgcctcccaggttcaagcaattctcctgcctcagcctcccgaatagctccttttaacatggtcacctaataagtgttcctcactttgttaaatatatagttatttgatcctctctgcaaccttttgattgggcattacatttatgtactaatttatcacatttttagagataaactgaggataagacaggttgagaaattctcaggatcatccagctattaagtggcagagccaggtctaattccaaatttgaactttcctgtgtgcttcttattgtgttcccaaggttcacatgtggtagattactgtggttttcaaggttcccttacaactgccactaggagttctcactagcagtgcctgagtgtggttatagctgtcttctcttatcttcatgccaataaccaccaataacctcttgcattcccatatagcccagaggtcccaaggctggggctccttctcctgcagaaaggggggctgcttttggtaggtggaaataattatatttgaggttggccaggcacagtggctcacgtctgtaatcccagcactttgggagaccgaggcaggcagatcacctgaagtcaagagtttgagaccagcctggccaacatggtgaaacccccatctctactgaaaaatacaaaaattagccagacctggtggcaggcgcctgtaatcccagctactcaggaggctgaggcaggagaattgcttgaacccgggagcagaggttgcagtaagcagagatcacgccactgcacttcagcctgggcaacagtgccagactccctgtcaaaaaaaaaaatcatatttgaagtcagggatcctaagtctcaacagtcctagaccaatgtgtttttggcaagtcaccctcatgtctcagtaacttcaataggaaatagaagtaataacatttcagactggctccctgaatcattaaatgaattaattagtcatagaaacacagcaacaagttaaaacattaacatttccagcccagtggttcacacctgtaatccccagtgtttcgggaggctgaggcaggcggatcacttgagcccagactagcctgggcaacatggtgaaacctcatctctacaacaaatacaaaaattagccaggcatggtggcacatgcctatagtcccaactgtttgagaggctgaggtgggaggatcgcttaagcccagggactcaaggctgcagtgagccgtgattgagccagtgtactccagcctgggtgacagagtgagagaccctgtctcaaaaaaaaaaaaaaaaaaatccataagaggacatggtctatctactttcttagattcatctatgaggtttaatttaattcagcccataacccttaaacatttaatctgtgataagctctgaggataaaaagatggataaaatacaaaggtgaaataacatttaaatattaatagaaaaataaaaacatacgcattcagatgaatgtctttcaaaatgtttatcttaagagactgcagctgctcctccactattgacattgggttaactattacctcaaatccctttttctgaatgtatgtggaatattcttttaaaatcttcaatggtaacaagtttgttactcaaagtaaatatgattctgagaaacaccttaaatttactaggagctaagtcaggagaatgggcattcaaactgagaaatattatcttgtttccaacaacttgtactggaaagttttcttgtgggatacatatgtgggacctgaaaaacctttatgtacatttatgacactgaagaaatatagtccaactctccagaaacaggccagcaccacttctcaccagtcactgatttctcttctctctgttggttgtaggaagctgtacaacaatggctttacttcagtccaaggatatgctttcaatgggacaaagctggatgctgtgtaagtcaagggtagccatgaaaactgtcactttcccttaccctaagaaccatccaatggggcagaatgctgttgagagataggttctaccagagcatcttccacgccagagttagtgtgaccaacatggaaatgaggtcaaggaacttggcaggggcccactttagtgggcgcttacgttagctccaatggtaagttccaaagcttttctccctggtgtgtgtgtgtgtgtgtgtgtgtgtgtgtaaatgttcatctattatgtacatgaagtaaaaggatatctttaatgaagcccaaagctgttcagaaaataaggtggtttctcttttagtcctttctgacatgtttttgggaaagatgtcagtttatatttgattcactcagaaatagctaaaaaatcatatccaacttttgccttttcaaaaaataaatagtgctgggaacagctgaaacagcaaacaatagactttgtgtttgatgtgttttataacactttttgagtatttctttacaaatgatatattttttctatttcacctttttctatttgttgtttttttcaaatttacctgctcatttttgctagtgtcttgttatgtattcatttttgtaattatattatttgtttcactttaaacatttcatacatagtaattttatgttccagaaatgatccctgcaaaatctgaaggccttatgacacaaaatctgttgcgtatggggcttctcaaaccttcctgggcatcagaccctctgagaggtcttatcaaaatacacagtctgattctgtagctctggatttggcctcgggattccatatttctaacaaactcccaggtgatgccgacactgctgttcatagaccacactttaagtagcaagggtgaggtcaataagctgtctaaccctatgcagtggctctggatggagaagaacactcatgtagattatgtgattttggttgatgttctggtttaggggttaggtggtaggttctggaacaattccatttttaaatggtaaatggtaaaaaggtgtttgaactcattacactgaggcaaggctccctgagttctgtttgaagtgaagtctcactctttgctggcttttgtgcttcataccagtctttatgaaatgaagagttacagtaccattctctcgattgtctggttgtggagtcataatggttcatttccattatttttttactacataattataggcaaagtctaaaaagactctatcgagtaaggtgatacttaccccctcaaatttatttacagaattggagagaccctccttccatcttaactttatgatactaacttcttacaatctttcatctacttttcaacatatttattagacacttgcaatgtaccaggccctgtgccattcactgggaaaacacagatgaacaggagccatgtgctccctgcccacactgagcgtacattctggtgggggtcagctcaagggcagcaacatcaaagggcaaagtacattagggagaagtgtacccaatccaaaatatgcatctcagatagaaaataactgaagcctaaatatcgaataacattgctttccttctttggagatacaagctagattttttctaggtttatcccattgttttttaaatcattattaaaattaatgttttagaaatgaattatcctatattccaggtttcaagttctttttctaatctagcattctggaaaggtggcatttgattttaatattgtatgaatttcaccaaatattttcctctttgattcaactattcctagaaagctatgactcttagggtaatgatcttcaaattcaaattttctatgaatggagtatggagagttcttaaaataatgaagatagtttgtaggtacttagggtataaagatttcagatgactatcacacagttctagacatagagtgcaccaaaagtttagttagcataaaggcaacaaagactcacattagcaggggcagggataggaggtagtaaggaaatcttcaaccagggaaaccaaagctgttaatatggctcctgaattcagtgtgttcacctgactcttgcctgaactagaactgcctttccagaatggtggattagagaaagaacctgaaacctgggatatagggtaattgatttctaaaacattaatttttccacaagcaaaagattttggagcccaagataagaatctatgcttcaaattaactgcctgtttttcctgccgtatttagtcattggaagatatgaccctcagacactatcaattatcatttattcaagatagagtataaaattcagaccttaaggtctacagagcaataattctcaacattagggagttttcaaagcactaatgcctaggttttgccgtcagacattctggatgtagcaggatcatggggatttaaaactctctccaagtgagtccaatacagagcaaaagtcaagaactactgctgtaaaatacattatcagtcttcttgtccaattgtcacgttttacatatgaagggaatgaagcccaacaagaacacatggctttttttttttaacgtggctgttttaatttgatagagcttcctagtggccaagtcaaagctgagacctgggtcccctggttcagaactctttccctgccctctgctgggattcatcatggctgacttaccagccatcaccaaggtgtgaacatccaactctggcaagtgcagcttgtttcttagccctgaagattgcttagacttcttagctcaatctattaaaggcgctaaacacagaagttaaaatatcttgatcctgaaaagaatgagatcatgtgagagaaagaaggcaactcaaaactcgaggcataatcaggagaagtttcagaggacaatcacatcaagaaacagtgttgttagtccacgagaacctgactttaccaatgctgcaaagccattcgtgagcttccagatgaagtctggtcggcgataacctgacaaaaatgctgggatgataaaacgttattcaagtcaaagaattggtattgaacttagtttacgtatattgactattttccctcaaaacatctcactcctcctcatgattggcctcctggtcatgtttagagaactctgcaaagacttcaagagattttcaaaagaggtcttcttcaatcaggaagtgttagtgtgctaagtggatctcagtgtaggtctagcagcttattatcttatgaccagccataaaattagacacagagtatcaaaggagtttagagacattttctattgaaaggatggaaaaacgaacaagtgaacaataatttctctttgagcttctcctcagcctttgtgataagagaagggatgggagagggggagctatgttcctttaaactatatttcttcaactctctttccatagtaaattaatgggtgttactttttaaaagaaatttatgatcttataaagttaaacaagatatataagtggacttttcagatcttctaataaaatcatctgaattattcatatcaaagagggggccttagtttgcagagcttctcaagcagttctcagttacaggagcatctctctggtctggtgttctacagacttttgaggggaataccgcctctgataggtaggaaaaaaatcaaggtgtttttctaccatcacacactcaatacaacagttttgacaccaaatgtttggaggcttttcccccacacaacaagtaatcaattctccaatgcacaccagctggatgtcctacaatttaactcagttctgatactctacctggagatagcatcagatccacaggttaagggctcagtcccacaagactgcctgctacttcagatgccagtcacagctcccaggttgtgtcctatgcttctgactgaccaattataaatcagggttcccccagtcccctcctcagttcagttaatttgctaaagcagctcacagaactcagggagacactttaaaggatattacaaaggagcagctgtgtggcaaagatgcatagggtgagaggtaggaaggagtgcagagcttccatgccctctctgggcacacaccctcccctcagctccacatgtgccttgaccaccttccagctacctggaagctcatccaaaccctctcctctctggctttgtatggaggtttcattacataggcttgatttattacatcactggccattggtgatcatctcaatcttttcagcccctgtctcctacctgaaggtgagaaggtggagctgaaagtccaaccctctaattatttattgatctttctggtgaccagccctcatcctgaagctatctagggattgacagtcaccagtcatctcatcagcatacaaaagacacttgtcactctggaaattccaagagttttaggagctgtgtgccaggaaacagataagaccaaatacatatttcacaatattacactactgaagaagaatctttcgatataccatctgcttgggaagcaggtaaatttaagaaggtttattcaagagatagctgtggagattctaagaactagtaaagatttcaaatgatcagatggccttctgaaattaaccctatggaaaaagtacgcaaagtcctcacttagcatcccagatagggtcttgaaaactacaacttgaaatacaaacaatgtataatgaaaccaattttaccataggctagttgatataaataggagttgagtttctatagcatatttctggtcacaaaaacaaccaaacttttgcataaggaccaaaatgcttctaatgttaaatatggaaacaaatatgagctatacatacatttaaggtaggttaataaaaacaagagaattatttgcccaattattccagttcaaggtcacaggtggccacagcctattccagaagctcagggcacaaggtgggagccaaccctgaacaggacgtcaccccaacatgggacacaatcacacataccaccacactcacttgaactggcaccatctagacacaccaagaaacctgatctgcacatctttggggtgtgggaggaaattggaatacctggagaaaacccacacagacatggggagtgtgtgcacacttcacataaacagtagccctggcctggaaaggattttattctcattaaaactaagcaggccgggtgtggtggctcatgtctgtaatcccagcactttgggaggctgaggcaggtggatcacaaagtcaggagatcgagaccatcctggctaacacggtgaaaccccgtctctactaaaaatacaaaaaaattagctgggcgtggtggcgggcgcctgtagtcccagctactcgggaggctgaggcaggagaatggtgtgaacccgggaggcggagcttgcagtgagccgagatcgcaccactgcactccagcctgggagactgagagagactccatctcagggaaaaaaaaaaaaaaaaactaaacaatagtgaatgagacaatattattagaggatctgctgtatatatagagactctccgtacgttcacaccagctttctcctcagaccatatcatggattctgtgggaggcttagctgacggcagagatattctgtcagtgacaatggattttcaattcactggtgccatgacttactgtctaactatcccttgaaacataggaaagaaatcagtgtactatttcacaatactttcttgacatttttatgttaagtattaaagttatttggaagagtttaacaaatgtggaaactatttctttgttaagaatcttttgtgtcttggtttctaaaagtctagatcaggggtcagcaaactttttctgggaaaagcccagatagcaaatatttggggccttatgggacatatggtcttagttgcactacttaagtctgcctttgtagtgtgaaagcagccatagacaatatataaacaaatgagcatggttatgttccaataaaactttatttacaaaaacaagggcaaggtaggatttgactggagggtcatagtttgtagacctctggataaaagtattcagtgaggatgaccattgtgtggcgaaatatgtactctgtttctctgaatttctggtaaaggttaaagggcaagcgtgggatcaagataaaaagtatctggattaaaatatttggcgttagaaagtacagatccaatcataatagaaaacaaatttttttaatcagtattttgaatccaagctggaaactgctcctgttataaaacaatgctccatcattctaccctaagtttctgactcctagtcaatagaaatttattctttcctagatttaagcacttcagtaaaaggtatcatgtaaatccagtgtaaaatcaaaatgatggttgtgataaggagccctgggactggaggaagacaaggattgagctataggtgaaggaaagaaaggtcaaggttccatggtaataataaaatagtattcacattgtgtttttaacatagggatgttgcttttggtgtcaatgctaattaagattttaaactaaggcaaacacatcaatctcctgtaattatcttaatagtgttcaaggatttcacatggcatgttagcaatttggtaatttctccagaagtttgtccaggtatcattaggttctcatttaaacaatgtgtcatccaaaagagcaatcatcccctatcattccacttcatgacaatttactgaaattagcagatcgacctcatttacactcattttttaaaatgtaactgaataatacaattacagccaagctggacaaattccacatcgagtgcaagtgctgatgcctcagcagcagtcaagcaattagttaggatttcatgaaaatgatggcagatgtgtaaaagcacattgtcctatgacttcctatggcgccaagaatgttgtcatcactcagaggtgaaattaataataatacaagcatcccttgctcaacagaagttgaactgtacttggtcacaagttaagtcacacattcattgtttggaatttcttttccatcctctttccacgcaatctgcgtggggatatgttgcttctcacagaatgtctgattctctgtatcacatttcctattgtcaaactctagtaactagctactatctgacagtaaacatttaggcaggaataaaaataccattttgatatgctaagagcccaccaatacactaattattatgaacagagtcaacagaattaatgtgctaattagcatcatgcattagctgattcgaagtaaaacaccacatcttggcacactgggaaaagacaatgatagagaatattataggattaagaaggctattatttatcatggggtaagtatttgaacagcttgtaggatatactctaaggctgacttttccctctgcctattgagagcttgagtattttctcacaggttactatttacaaacagctgtcctgatttctgctacaaaaggatttccatagagcaatccagcttctctttaaactaacatgagaggtaggcagggggtccctttaattttctgaattagcaacgctgtgggaggaaaacatggttccccacagaagtgttcccatgagagtctcacaacataatcaaggcccagcccaagttccccataaagggactgtggaggcacaggctgaaattccatcttggagctgcaatgtatcctaaaactccccagagagccaagttcagcagcaatagcaaattctcttgccacgacatcacactcctctctctggcatagatcacgtctttctaaacctggtatagagggtgcctctttctaggagtcacccaacaatcaggctttcattccttcctccagcaagtctttactgaatggccgctatgtgccacgagtgagtccaacagaaaagggcgtacataaacacacatatagtacacataatactgagtttgtcaatcgaatattttcctcagctcattcctcaccaccttcattttcctgactgcattggtcttccctaactgtgaactattcacaatcttaaatcagggcagggcttcttaactccatgtatggaaatctgacatctcttttctcagaagaacttcatttcttccaacaggttctcaaagaggaataagaccccaagcggtgaaaagctgttgaacacatagagatgtagccatgtctatcttatttttaaaggaaataccagttcttttctcataagccctttccagcatagatatttagaaaccctgactttcaaaaagtatttcctttcgtctcttactacaagccttttgagtctcttttaagctactttatgttcatcttctccttgcaagggatagtttttatcactcctctctaaaataatcattttctagagtaggttaaccagatagcctaccaagatttgtgactgatttatccaagctggttacaaatgtggatttcagaagaatcaaggtaagtcatggtcaaggaatcagtttaactagactgataatcccaggaaatgtcatgtgataaatgaggttgatggaagcactttcctggatatcaaggcttctgtatatgtatttcccctccccactgtcttgacttcagatggaaggcaagagcagcaagctgatgcaaggttgaaaagctaaatgaggcagccctcaaatctgctgaaggcagagtgatggtttcacttttaagcatctaattaactctaagaggtaaagtaccccaacagcagtgctggttttagagaacacagtctcctgaagtgtcagttcatctccgttcatcttggccagggctcctctgcatcctcctcctcccctcctggactctggctggcttttccagtctgaagtcttctgcagagtttctggtaaactgcaatgcttatcaaccaggctccttatcctcaggagtatattaaatatcagatgaaaacactgcagaattggacaagcaataatttagttttacaataatttctaatgattagaaagaacaagctgaatttcacttgcagcagttagagatgaagaggaaaaactgagatgagttcaccggctcttacttgattttcaacagcctgggaacagaatgtgatctgcaagctgcattgtccagagaatacaaaaagagatgcaagccagtgcagcccttgtactgaacttagttgtctttttacaaaatcatgctgttcaatatcttctctgcagttgtttttttttttcaaggtggattttgcccactctgggtgtcactgaccaaaggaattccatggacatagtgggttaaaggagagtcaaacaatgatcaagtggggattgtgattgaagccactgggaaggcacagattggctgctttagcatcttagccaggtctctgaatgcatttgagatttattgactctccctttgtcatacttaacaatgccctgaatactgggtgttctgccactaccagaagatgccaagtttgggctatacccttgaggtgtttgtaaaccagatgcctcaaaaatcactacctcaacaagaacagttggtcaaatgccaccacaccataagccaagtcttctattttttcactctttatgattttttctttaaagcaatcgtctgtgtcaccctaagagtttaacactgcccactttactgtcttgatgaaaaagtatgttgatttattttctactcattcacatattcatccaacaaatagttacagagatggtgaacttggcactgggtagacatagaactttcattctggctggggagacaaaaaataaagtaaacaaataaataaacaaggtaataattatggattgtgataatgctgtgaaagaaatagagagtgtatggaggcaaaatggtaatggctactttagattagctagttctcaatctctatttaagaagaaaattgggccggcacggtggctcatgcctgtaatcccagcactttgggaggccgagttgggcagatcagttgaggtcaggagctcgaaaccagcctggccaacatggtgaaaccctgtctctactaaaaatacaaaaattagtcaggcatgatggcgatcgcctgtagtcccagttactcaggaggctgaggcaggacaatcgcttgaacccaggaggttgcagtgagcagagatcgtgccactgcattccatactgggcgacagagtgagactccatctcaaaaaaaaaaaaaaaaagaagaagaagaaaattgaaagacccaaaaatatataccaatttatgacatgtcattttgtggagtctcagcacttactcgtcatttagtgattccctcatcctgcccagaaaggagagatttcttcagcactggtgattggtaaaactcttcttcctcccacggtttcaacgaagactcatgcctgggtccagttaaccaggagggaagtttctctgtgagggctctggagaagaaatccttccgactgaaggcttaatattattattaaccattacccttaaaaatgttccaccatgaagagcaaaccccgtaagtagaataatggaagcattagccatatctaagcagaccttctgagggtctctgctatattcttttgcatcaacaggtggccactcactaatgtttaagtggaccaggttatgttgtgagttattctaaatgtgtaaattgggagcatttgtaacaaggatatatatatgtgctatgcttctttttagataattttgttgtgtaataaagttatggggaaacagccagtttcaaaatccttggaagcttttatccatttggagggaattttatttcaaaatcactttgtaacttaaattgctccaaaaacattttaccctctaatgcccagtgtgtttttaaaatggaatggccaatgtgcccaccaaacctcttccatggaaggttgatgagattactctgtaatctcatctggctaaacactgctcacacacacactattgggttgtcagatcaaatacaggccacccaatacaatttgaatttcagatcaacaacagacaacttttaatataaatattttttaaattgcatggcaaatatttttactaaaaaattattcattgtttatctgaaactcaaatttaactggcatcttgtatttttatttgctaaatctgacaactttacccaaagaaaacatctgaatctctgacagtcctcagcatctctcaccaccctcaccatcttcattccattcctaatttaagcctagtcttcaaagttaaattggaatataaattaatactaacaaacaaaatttggtattacagaggattggcattaaagagaattaaaaaatacagttgccactggcctgaaaaatagggaattaaaacaacttttaagaaatttaggtatgcaaactagatcataaacatgctcattttcaaaaacttctgccataattaatgtgtaaaactttatacaattgaaacctagaatgttttaagtgctcaagccagaagaagataaagtatcttctaaattcttgaaatcagtcaatactatggtcacattttattctgatatttgtactaatttgatgtgatttcttaaaatcacctaattcattctctctctctctttctctctctccctctagttacctaaacaagaataaatacctgacagttattgacaaagatgcatttggaggagtatacagtggaccaagcttgctgtgagtaagacatacaaaagaatattttagtctttttttttctttttttttttttggaataaatggagacattaaggggagaatcttatgttcaagggtagaaaatgttgctgtctcgggtaaaggcttctgcaagtccctcttttcctggctgtataggctacctcttggaagaaagtccttgtcctttgagactcagaaggccccacgctccagtatgccatcatgatgcctgctaaggcagccaccttggtgtacatgctcacagaggctctgttcatggagcagctgctgtttgaaaaattttgaaatgcaagatccacaactagatggaaggcactctagtctttgcagaaaaaaatgtacctgaatgtacattgcacaatgcctggcacaaagaaggaagaatataaatgatagttcgactcgtctgtggaagaacttacaatcatggggaaagatggaataaaaacattttttaaacagcatgaaaacata

SEQ ID NO: 105 - DNA, 153426 bp, Homo sapiens; identical to SEQ ID NO: 104
